United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 19

SEQ ID NO: 560 - DNA, 97820 bp, Homo sapiens
gtgcctgttcatgtcctttgcccattctaggcataggccctggtaagtatttcatgatgaagatgccaaacaaaattgcaacaaaactaaaaatagacaaatggggcctaattagactacagagcttctgcctagcaaaagaaactatcaatagggtaagcagacaatctgcagaatgggaaaagaaatttgcaaactgtgcctctgataaaagtctaatatacagaatctataaggaatttaaataaatgaacaaatatagtacacctttatggggcatttaccatgcatggggcttgcaggactgaaagttgccctgggtgagtcagtgagcgagtggtgagtgaatgtcaaggcctaagacattactgtacatttctgtaaactttataaacactgtatatttaagctacactaaaattataaaaaaattctttcttcaatagtaaaataactttagtagcttactgtaactatttaccttataaacttttaaatttttattaactttttgtctcttttgtaataacacagtttaaaacacatgttgtacaactgtggaaaagtattttcttttaaaaatgtctttattatataaggtgtttgtttgtttttagagatgaagtctcactgtgttgcccagtctggtctcaaacttctggcctcaagataccacccaactttggcctcttaaagtgttgattacatgcataagccatcacaaagggcaagtttattttttctattaaattttttttaatgttttgttaaggtacaaacacatacattaatctaggcccgcactcggtcaaaatcatcaatatcactgttttctaccccaacattttgtcccactgaaaggccttcatggacaacaggcatagagctgtcaatctcctcccttcttctggagtgcttcatgaagtacctgctgttttacagttaatgttttttttgttttgtttttcagataaatgtaagaagtgcactctaaattaataaaaagtataggaaatacataaaccaatacatagccatttgtcattatgaattatgtactgtacataattgtatgtgctatacttttatgcaactgatagcccattaggtttgtttataccagcatcaccacaaacacatgattaatgcattgagctgcaatgttatgatggcttcagtgtcactagatgataatctattttatttatttgctcaatgtttgcctaactactttacatgtattatcttatttaatgcttacaacaatctgataagtaatttaaattacattcactcctatttgaagatgagttcaaatcaagagaggttatttaacttgcacaaagtaatcttatagatgagaaaaatgtttatatggaaaagttaagtataattggtttatgtataaacatatagatggatgctacattgtaaattcttagcactttgtatgcatacttaagtttgtgtataaagaaataaaaccacaagtactgtcttacaaagtacttatttccactcagaaatattatatccttatttctcatgttttaaatggtttcgaggagatattttatgtatgccttaacccacataaatgtaccacctacagtagtcctcccttatccaaagttttgccttctgtgtttttagttactctaagtcaactgtaatctaaaaatcttaaatgaaacattttagtaataaacaaatcatcaatttgagattgcacgctgtcttgaataacatgatgaaatctacctgcgatgtgaatcactcttttatatggtttatccctgctttagacacttctagtccatagtcacttagtagcatctcggttatcagattgactttggaggtatcatagtgtttgtgttcagttaacccttgtcttacttgataatggctccaaagggcaagagtactgtgactaatttaaaaactaaactttatcataggtatgtatgtgtaggaaaaatatcgtgttacaggatacttggggtgtcgtttcaccagctgaaaacctttgtggctggtggcatctttgcctgagttttgcactggcccactgggcttattctgccacttagcctggcaggctgagctcggattgcacttctggcctggatcccacgcctgccaagggcaagccaggcaaggagcagcaaggggtgtgtgagcgagcttggggttcattcactgcacacagccaggcatgccggctgcagcagggcagacagctccagacgctggcacaggcactggctccctgcaaggctgcagctagaccatgtataccacaagcagcttccatggctgacaccagggaatgtggtggtacccggaagagatccctaaagagagtgtcacagtagatccctaaagagagtgtcacagccctggctcgaggagctcctaggtcagggctccccaaaggcctgcagctcttctctcctctcttctctccatcttgttgcctgaaatgtggtgagcaagaggcatgtttcagtactgtttgtgttacagctcgttcggccctgccattcggtgggtcccacgtacttgtcctgcttccaggaagaatgagatacacagacaactggagggtaagcaagaccaagacaggctttatcgagtgctagaagagctcacaggggacctacagtgggtagctcttctctgcagccagggtattccaatgagtgttcagctcttagcagagagagtaactcctctctgctatgcaggtcatcctgatgattgttcagctctcagcagagagggtagctcctctctggaagcaggtcatcaccaggaatgttcagctctcagcagtgagggtagctcctctctgcagtcaggttgtcccgagtgtccagctctcagcagagagggtagcacctatgtgcaggcaggttgtcctgtcaactattctggtctggctaagttcagggcttttcatgggcctcagaggggaggaagtgtatgctgattgattcaagggtagccatgggtgggctcagaaaaagcacaagtttccactccagtccaccagagtggcagcccaggcctcaggcttcaggccctccccagcttgaaggtggggcttcaccaggaatccaacccctctgcccagaagcctgtctgcctccttctgctgttcatgccacccaggctgttcttgccaagaggcacctgcaggccagtgctgagctgccctcagtgccccctttagtctccctcccatggtcgttggtgcccaaagtcctgagggtgctgaggaagaagggggttggtgtgtcagcactgccccaagcgtgtgcacacctagacagattgtgacaatgcctgggctcagtctcaactttgttccctgactacagtgggtgctgacattggggagaagccagaaagtaggggcaggcacttggagcctgtaggtgctggggaagcctccctgcgcccccagaatgtggagatgcctgggtctgcggctgcaacttgggcagctgcagctgcacctgggagggtggagctcctgcctgatcctgactaccaagagcacagggtgcccaggtcacggccacaacttgggtggctccagttgtgtctgagaagctcccactgcaccaacttgaaaggggcagcaagctcccacttgtccctggctcccatcagctcagtcaagcatgtggagcatgcagccctggccttgcttcctctctgttttccctgcagcagcagtgggtgaggtacagatggcacctcacaaattaatctgatgctcccaaggcctgccctgtgagtcccgggatgcagcagggaatgaagttgaggccgcagaggaggctgtgggcctgggagcgggtcctgcctggccatgcaagagtggaggtggcacagtttactgcctcagggacgcagggcagaggggacccactgctgctccagcagctgtttctgccaccactgcccatgtctccctgcttcagccagtgtgatggcagcagccactccagatggcccgctgctgccatcaataatatatagagggttcagtactatttgcagttttaggaatccactgtgggtcttgaaacacataccttgaggatacgggaagattgctgtaaattgaattatttattggtgggtgattatattattattttccttctctgtatctccttacctctctttcttctggactccctcttttttcctccctcccctccttcctcccccaacttcttttttctttctttcatttgtactgtgaaaggcagttatttctttctctgaaattgtgaatggcactgcagttagccctgacatctgtcttctccctttctttctctcctatcttggcaatactagttgtggaagaataatggatatgaatcatgtgaatagccctgaccactaatcagttacttttagatgtcagtttgactgaatttagagatacttagaatggctgatgaggcattgttcctaggtgtgttcatgagagtgttttgggagattgacaagcaatttcatggactgagtggggaaaatctgccccaatatgggagggcatcaatcagctggaggcccagacagaacaaaaaggtggaagaatggtaaattctctctctctatttctctctctcccttacagtgctagataccttcttctgctgttcttgcacatcagaactccagattcctcagtctggattctgcaccttgcatcagtggcctctaagggctctcaagctttcaatttcagactgagagatcaccagctttcttggttctgaggctttccaagctggattgaacaatactatgggcttctctagttctctaacttgcacatgtcctattgagggacttcttagcctccaatatcatctgagccaattcgcttaataaaaaccctctgatatagctatatcatctatgtgtgtatctataactatctatatatccattggttctgtctctctgaaaactctgactaatgcagcaggagaggtagtggccacctttctcattccagaatttccaatttctaagactttcaatcaatgatggcagagaaaaaaacacatactacaatgtaatttgcaactacgcctcatggcttattatataacattgacattaatcaaaaccagcaggaaaagcactaggtgagttctgtgagcaagaactctcaaacaaacacattgcaaatggtttccttattcttgtagcatatttttcacccttggtacagtcctttggctgtggtacaataatttcaaaatttttctgccaacaattcccatgaggtgtagatactgggactatatttggcctcactaataattattcttcacttcatttgcatgtgtttttattataactttattccataaattaaatttctgtatttcaaatttgattgataagtttaattctatcttgttagctttcgaccatcttcttttcttcccttaatgatgcacttaaacaatgtgcatctttccatacatctgcttcttgtctctttctgttctctcctgctgtcactcacttgccttgttttgcactttttctttcctctccataagatctgtatcttttttatatctggttgacattaatagattcctgtaaatctgcagtttaactgtgttcatttataccactaatattaacgtctttcttttcttctattcagtgaatttgcttttgctccttaaattccactctcaacaattgcctgggaataaaatcctttacatgaataactctgtgaaagaatatgaaacatatggagacctttgatgcacattgccaattacattaaaaaaaggacagcatagtggtcaatagcactggctccagaccatggtaactgtgtttgaatcctgattcctgtatttgtttgcaatgtgacttaaggaaagttactgaacttctctaaccgtcaattttctcatctttaacgtgtgagtaataatagaagctaccacatacggttgctgttaagattatatgaattgatacatgtaactagaacaatgcccagcataaatttgagtggttattattataatttctgtttctaagacaatatctgtttattatttcaagaagagttaattatttcatgtaccttcttacaatgcttatctcttaacaaagtatttctaaatttacaaaaaaaccttcttttttaaaatttatttttcaaagaaaagtgttaacagcagccctgtaatctcttctgtcctcgaggcagataaacaccagggaataaatagcctagaggagatctacttataaacaagctgatgactttaactcatctcataaacatgttaatggttcttattaggggaaagatactagagtcctcatgtataaaatattttgagaaagatatacctagtcattctagactcctcactgtaaataattctgaacttcgtggattcatgcaacgtggctaattagagaacagaagcatctttgtagaaaccagcttctatttatgtaatcaacagggtataaatcataactgttcagaaaggaaaatgacttctttttctaaccagtatttatccttatcttgttcataatcctcactgctaatctagaaccaaaatattttcccaatgtgagtaaatagaggtgactttaaaagctgcatttaaagatttcagaatacaagagaaatccctcatttatacatgatgtttgtttatctcttttgaatcactagatatgttatatgttgatatatggtgtgtgtgtgtgtgtttgtgtgtgcatatgtatgtttatatgttttttatgtcaataatataaatataaaattatatatctatgtaataaatatataaaaattatattttactatgattttatatataatcatatatgattatacacatatatatctatagaatcatatataaatatatgtaaattgcctaattctgatatggcaattcaaccttttgtgataaaagaaatgtgtatttgttttattgtgttttatttctttgttatttgtaaaccatctatcataagctgtcaatgaacaccttaggcagtaaatatcaggaatttgattaagtgtgtgatctaaggtaggcttcacctataaagcatttgttatttctacttaccataaaatatggtaagtttagtatgtctttatgactaacattctctcaaatcaagtgttctaatcataatgcatgtaacagtcatagattgttactgatttctgagttatcttcatgtggccataattttgaacagttctttcttgtttttgtttctctatttttcatgatatatcaatataaatttagccacatttttgtagctttgtctcgtttgaaagcaactcattgtcttagtcttatataagtgattttttttttcctttggcatcatgacatctttctgtccctgctctctgaatatagatacaaaaaactgatacaggtcagactgagaggagcttctaaggatgatgcaggattctgggaaaatccatccgcgtctggtgaggaaacaacgagttaatgccaaatatgacacccttaaaagcattacataaatagaggcaaccaaaaagtaatcaacatatgtcaaaagtagagacaactaatgcactatgtagacaaatatagtgatgtcttttatggatcctttttgaaaaggagaaaatgcagcagaatctctcttctccaagtcttaggtacccttcccaaaagacttcacagttgtttaatttttttcaaaaactgtgggaaataagtaaggaaaatactaagccaaagttaaataagttactgtattgtagaatagttcaatctttaaagtgctaatatattgttggagtcttcaggatgagaaccataaaatgtggcttttcccaaataaaatacttctctttcatatgatatccaataatatctcatagaattttattgtttcatggaacacattttgaagaagttaactttaaaatatctgggaaaactggctagccatatgtagaaagctgaaactggatcccttccttacaccttatacaaaaatcaattcaagatggattaaagacttaaacgttagacctaaaaccataaaaaccctagaagaaaacctaggcatgaccattcaggacataggcatgggcaaggacttcacgtctaaaacaccaaaagcaatggcaacaaaagccaaaattgacaaatgggatctgactaaactaaagagcttctgcacagcaaaagaaactaccatcagagtgaacaggcaacctacagaatgggagaaatcttttgcaacctactcatctgacaaagggctaatatccagaatctatgatgaactcaaacaaatttacaagaaaaaaacaaacaaccccatcaaaaagtgggtgaaggacttgaacagacacttcgcaaaagaagacatttatgcagccaaaaaacacatgaaaaaatgctccatgatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtgaaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaatgggaaaacatcattctcagtaaactatcgcaagaacaaaaaaccaaacaccacatattctcactcataggtgggaattgaacaatgagaacacgtggacacaggaaggggaatatcacactggggactgttgtggggtggggggaggggggagggatagcattgggagatatacctaatgctagatgacgagttagtgggtgcagtgcaccagcatggcacatgtatgcatatgtaactaacctgcacaatgtgcacatgtaccctaaaacttaaagtataataaaaaataaaaaaacaagaaaaaaaataaaaaataaaatatcaattatctttcttctgactttctctcctggtcatcaagttgctatcaggaactcccagagtctagagagagtttccattcagctatttgtcatttagttgactgaataaagaaattgagtttttttgccatatataaaggcttgcatgaatatcagagagcagtctaaaacgtatcaagagatgaaaaaagtgttctctttcataatttctgattcagcacccactatacacagaagatcacggtttttgtctttgaatgacaaaaaagtgatctctttcctctctaggcttctgatgtactgtaactttcacaatataaatcgctcattttatgtattaataacatttacctaatttttctctcacctttaaatgaccatagaatttatactggtgaaagttatttcagtgatttttgagagccacaattttatcctgtcattccaaaacatgattttaactgtacctcccatttttcatctttataatctaaaagaatatttgttgcatagtaggtggggcctcattcatatcaatagttacacattgctttacaaagttgcctgctcctatattgccatattttctttatcaatattctatttggaaatgtgattaatttgtctcaccatgtttatggagttaataaaactgcttaaaatctatcacttatgttaacttcttagttaagtcctccagcacctgttactaaccactttctcccaaaatatgttacattttaccaaatttgttgttttttgtgtcttccgtattttgtgctattttaaactaatatatattcttgaaccaaaacaacgatgaaaaatattgatcaagtgttctttagattttttctttcaactatttaaagacttatataaatctgtattttctctagaattctttaaatcttgtatatcccaagtaaaggacatatagtcacttctatccttaattgacacttcttcctgagaaatggttgagtcacaaatacatatgcttttcaggaagtacagttttatttcaaccaagtccttgtgagatatttctagtccttctgagaatgcaagtctttatgaaacagaacatatgttccattttacagcctgtcccactttcttggtagttgtattattttctgtagatttattttcttccaagccacctgatacattttccaaatagttgctcacatatatagaatgtttcaatagctaggtaataaaaattattataaatatacatgtgtattaagaaattatattaaaaagacttttgtaaaaacatggtgttctctgaaagtgggcaaaagctcattttcagattttagttgttatctaaacatatttgaaaccagtatcattctcacttgaagcgaaagtgtgaaatggtaaaatgctaaaactaaaaagagttctttttagttctcaagagcagtagatgagcataagtatctgaagaacaagtcaaacgaatgagcttatgaatgataataatctaaattcaggaatcaaatttacttatctttgttttaccctcataacttccttcagtgtcctgtccataagaggtgagtaataaatgctattgagtaactgattaaataaatgaaagggtgaatatatcaaaacatatgacttatctctctgtacatatacatatacacacatatgtatgtatatgtaaatatatatgcatgtaaaacaaactcatggctgctaacatatatacatatgcaagtgtgtatgtatagcagtctccccttatctgtgacactgctctctgtagtttcagtcacctgcagtcagtcagccatggtgcaaaaataggttagtacactacaataagatattttgacacagaaataaagaaatcacatttaaataacttttgtaacagtataccatattttctaaattttattattagttgttaatcttttattgtgcttaattcataaattaaaatttatcatagttttgggaaaacatatatataagatttggtagtattcatagtatcaggaatccacagggggttttggaacatctcaatcatgaatcagggggagctattctatagtgagtgtgagagagaatctcaaatcacattaaggattatatcatcataaaaaataaatatgagaaacatactgaaaaaaatactgaaaatctaccacatgcatgacatatatataggcttattgcttaccaagatgtataggatgaatatcttgccattaatggattccctgtctagttttatagactccaggagaacatacacacacacacacacacacacacacacacacacactctctctctctctctctcctattttgctgagtgaaaatatcttctcaaaagaagatattgatgtaaagcttaataagtcattctatcctaaggctaaatgaaaataaatgaataatttgacaacttcaaaaatgcaaagtcgataaaagattccaatctcaaccaatgttgaaatgaaagctattggagaccttgtaatgcttagaaatatatgtgcagccaagcactatcccgcctctcaagacatgagcaaaattcttctctttgtagaatataaatccagaccatgttcccattggcagcgtggatctaaagcaatgctggagattcattaagttcccaaagtgcatcactccatcctcaaaaatcctgtgatgggaacttatgaggttagattctcttcaagttcaccttagtggttttgatacttttgtcagcattacagctagaaattgcattgaaatatcttatgattgatttttttgtcagataataatgttattttcatgaattttactgaatctagataatatttgttgcctctctatggtgtttgcaatagaagtgctgaaggcactgtgacactttggttaaagggataatagaaaaaggttacatgatgaccagtgcctgtgacagttcttgaaattttaacacaagtaactgtctgatagcaaggctgatatctgacagctgctatgatgaggaaggccagactcttgaaagtatgtatagcttctctccattgcccttcaggtataatagcactacacactcctgcatgacaattctgaatggacagcttatatgtaattgatatattcagggtggtggattttaagttttgatagcttccataaagcagtagctgtattttattcaaagtatcttctaaaatatgattattgtatctcttaacaactaaaaatgtgaaaacatttacatacatgtatgtttacatatttagataagtataacttaactataaataatagaagtggagtttctgtttaaagaagtatatttaacatttttatatgtcataatatgtttctctaccagatagttgataaggactttcaattcacaagaatgttaaaaagaggattggatcaaacttttgaagagtttctcaagctacttggtgaaaaaaatgctatctatactttaaatgtttatttatctaaagatgagtgtgataatctttttcatattttactggatatttgtaattatttttctattaacaacctgctaatgatatttggatagttttctgttggattattatttatttttatttatttatttattttgagatgaagttttgctctccttgcccaggcggagtgcaatggtgcgatcttggctcactgcatccttcacctcatgagttcaaatgattctcttgcctctgcctcccaagtagttgggattacatgtgctcaccaccacgcccagctaatttttgtattttcagtagagacaggatttcaccatgtgggccaggctggtctcaaactcctgaacctcaagtgatccacccacctcagcctcccaaaatgttaagattataggcatgagccaccgtgcccagccttaagttttttataataggtagaaaactagaaactgctcagtctacctctccataactacttgctgaagagacaaaaaataaaaacaaccacacgcagaggagcacacacagagacaaccctaccaacttttcttgggtcggagaacccaagaaaaagacatggttttgagattaaaatcccagaagtttaatccttaaaggaaataaagaaacaatgattgtaaaagtaataagatatgctggtaattatattttttgtttgtgtatcccattaatgaagagtttcaaaggattagacaaggaaaagtatagatggtcctttcacttcatcagaactgcataggaaatatgattattagattccaggagtcttaatggatgctatgtctgttctccaattatgagtattaaaaatagaatatttcacacattttctataagaaaagccaagggaaactcatgtgatctctctgttggcaaataataaatcatgatattataagcatcttcttattcaggaaaaaacagatacataataaaacatccaaactatacacacaaaactatagaacagagttttgggcattcttgtaaagcaatcaaatttacaccctcaatatattcccaaagcggtgtggaagagagtgagactagcatacatatgggaaaacctcctagaacaatattctagaagcccaagcaaaaaagaaaaagaaaggtgaaaatttgaggttgttaaaggtagactgaaaaatatgggcatattaaatgtattttaagatggaattagcaatacttggtatttgaaaggatcttagtggtaaagaaaagggaagcatcatagatgatgctgatgatattccaggatgaactagtaactaggtggactggaatgagatagggaaccatgaaaaagaaggaagatttctgtgttggccatgttctgaggtaggagagagattataaaatcagttttcgacaagatttcaagttttgtgtgagagatctgggtatatcacttaacatcaaaagagtgttctgaattgtttatatacattactaaatattagtcatatttcactgatagtatgggtctgaatatgatcactgaaaaaaacagtgtagtgtgagaagggccagtgattaagccctttagagaaacaataacactgaagcagtaagtagaaagaaggagccaagaaagagactgtcttagtttgttcttgttgcagtaataaaatgccataaggggggagcttgtaaacaacagaaatttattcctcacagttctgaaggctggaaagtccaagatcaaggtgccagtagattcaatatctggtaagggccaactttctagtttattgattacgatcttcttgctgtgtcttcaaatggtgaaatggatgagggagttctctgaggactcttttatacgggcactaatgccattcatgagggatctgttctcatgaccttatcacctccaacgactccacttcctaatgccatcaaattaggggttaagatttcagcaattaagtttttggagaatgtgaacattcaatctgtagcaggaccgacctagaagaagttgagaagttatttgaagaaacgagagaaaaaatatgaagttctagtgttacacaagccaggaaaagataactttcaaggaaagacaacattgtcaacctaaaataaaataaaataattctgcaaatttgattagaataactgaaaatatgtatttttattgagtactatataatcatttttaagtttagcaggaacatcttgaaattcttgttattagtacatgcatcaaaccagtgaaataatgcctaaatactttaaatcattaagaaaataatgtgtatcacaactaacttattttgcagttaggacaatttaaaatattttagatatgccagaaatagtaaaacagcatctatgcaacatttttgaaaatgactataatactggtgctaaaatcaacagatagattaatggaacaatatatacagagacctgaaattatctctaggatctttaagatctcaatacctaataaaggaagcatcactaatgaataaaaagtcatgcattccttcaaaaatgtagacataaattttgactatctaaaaaaatttaactcaatatattataagatcatttcaggagaattacatatttattcataaaattactataattaaattcattggaaaaatttaagtaattgcttaccaaatttaaaaaaatcacaactggacactgaaaaatattgccaactgatttcatgcatttgctattttttccaaaattttttaagaaaaattcaagaaaatgtaagtatatataattaagagagaaatgaaatattaactaagaaattgtaacaatatattataaagtaacatttcatgaccaagtacattttatctcagaaatacaaagatcattcaacatacaacataattccatataattttttgttaatacatcaaagaccaaaaacatactattacctcaatagatataaaaaaatcttttaataaagttattcaactaagtaaaaacatacttgtaaactaagtaatgaaaagatttgagtaaactccaaattaaaaatcgtaaggcagaaaactgattattataataattgtgaaattaagaatctaatatttaataaagatcataaaatacaaagaaatgaaaagaagacaagttttaaaagatatttacaatgtttataataagcaaggaagttaaagagactcctgaaaattggcacaacaacaaagggaagctgtgggagaagactctcaatggaaaaataaacaaagatataaacagattcacagatagggacaaccaaaaggtaaataataatagaaagaaatagtcaaactcattagaaattagagaaatgagaaaaaacaaaaacagaacataactttgcttctaaaaattaacaaaaattacaaatctgataagtgtaggcagatatttggtattcaggaatttttgtctactaaagttggaagtgtagattagtatgttcattatggagaacaatccagcaacatttagccaaattagaaacaaatgtattatttgtttcagattttttgctactagttatggaggcctaggaaattctcacatatatccataaagatatgcacacaatgaagttcacctcattgtttgaggctgtgaggtattggaggcaatctgcgccaccttctctgggaaaatggataagtaaaatatgttgaatgtatattaaggaatattacgcagaaattagaatcaattatgttagaaactacatttagaatgcagtgtgaacacaaggaattaataaattcaggtttataatgtgatttccctaaagttacaaaaaatacatatactatatatagttttatgtacatatatatcacacaatatataacataaatacgtatatacatgacacatatcagaatggcttcctttgtagaattgagaagttagagtgaaagattagaaatatattggaataaagtcatattacatacaccaatgttgccatattgtaaagattcagatttattaacttaattctccctacctaaaactttctctctctttatctaactgatttagtttacaggagattataagaaaagttctaaagaatatcattgatatatgtgacttcataaaaatgtatatacagtcaaatagcagatagacatatgacaaactgaaaacacactttgtagtaaatatgacaggcataaatttaaatgcattgacatgtaagttttacacatcaataaatacaaacatagtttctttaaattatatgtaatagccttttcacataaaataaatacaaagtccaataaacatataaacaatattcaatctaattcaaagtcatgcaaattttttaaactatgtggtattttttaaccaaggaataagaaaatataacgttttcatagtatggaatgctccttaaatgatggttgaaaaaaagaaattaataagtctatatgaaaattttttgcatggcttatgtcaagcacaagtgcccaaaatgatgagcaaaaatgaaggctctttttctggcaatagtgtgacgataaaattttatcacatgaaaaacaagaaaaaaagaaagcaaaagttctcatttcacatatgtcaaaatgctaagagccatctatgactaagccacagccaacatcatactgaatgggcaaatgttgatagcattccccctaggaattagaataagacaaggatgcccactctcaccattcctatttaacatagtactgtaattcctaaccagagaagtcaggcaagtgaaagaaataaaaagcatcaaaatgggaaaagaataagtcaaactatctcttcttgctgacaatatgattctatgtctagaaaaccctaaagactctgccaggacctcctggcaataataaatgacttcattaaagtttcgggataaaaaattaatatacaaaaatcagtacatttctgtgaaccagaaatgtttaggctaagagcaaaatcaagaacaaaatcctatttacaatagccacaaacacacacacatatgcaaacacacacacaaaaaaaaacacctgagaataaatctaaccaagaaggtgaaagatctctacaaagagtactacaaaacactgttgaagaaatcatagatgacacaaatacatggaaaaatattttgtgctcttgggttagaagaattaatatttaaaatggttatattgcacaccataatgtagagattcaatgctattcctatcaaaataccaatgtcaaactaccagcatcatttcaacagatttagaagagaactattttgtaatttagatggaaccaaagaagagcccaaatagccaaagccatcttaaacaaaacaaacaaacaaacaaaaaaatgggaggcatcaggttacctgacttcaaactatattataaggttacaataaccaaaacagcatggaattggtacaaaaagagacacagaaaccaatgggacgggatagagaactcagaaatgaagcctcataactacaaccaactgatctttgagaaagctcacaaaaacaagcaatgcggaaaggactctgtatttaataaatagtgctgggattactggctaaccatatacagaagaatgaaactgaactctgaccttttaccatatgcaaaaattagctcaagatgaattaaagatttaaatataaatcctcaaaccatacgaattctagaataaaacccagaaacaccattctggacattggccatggggaataatttatgactaagttctcaaaaacgattgcaacaaaaaagaaattaacaagtgggatttaagcaaactaaagagcttctacacatccagaaaaacctaacaacagagtaacagaaaacctacagaatgggagaaaatattcacaaactattcatttgaaaaaagtccaatatccagaatctataaggaacttaaacaactcaacaagcaaaaaacaaataagcacattaaaaagtgggcaagatacactaacagacacttctcaaaagaagacttacaagcaaccaacaaacgtgaaaacgctcaacatcactaatcatcagagaaatgcaagtcaaaaccacaatgcaataccatctcacgccagtcagaatggtgattatttaaaacaaaataaaataaacagatgctggcaatggtgtggagaaaagaggaagcttgtacacggttggtgggaatgtaaattagttcagccactgtggaaaacagtttgaagatttctcaaataacttaaaataaaactaccattgaacccaataatcctattaccggatatatatccaaaagaaaatgaattattctaccaaaaagacacatgcacttgtatgttcatcacagcacaattcacaaaaacaaaggcatggaatcaacctaggtgttcatcaatggtggattggataaagataacgtggtacatatacaccatgaaatattacacaaccaaaaaaatgaaatcatgttctttgtggtaatatggctgcagctggaagccattctcttcagtgaattaatataggtatagaaaaccaaatactgcacatctcacttataagtaggaactaaatattgcattctcgtagacataacaatagcaacaatagagagtggagaccactagagggggaaaagaggaggtcggtaagagttaaaaataactattgggtactatactcagtacttgggtgaaagaatcaatcattccacgaacctcagcatgacacaatatacccatgaaacaaacctgcaatgtacctcctgaatctaaaattaaaaagttgaaatttaaaataaaataggtcctcatttctctgcaactaaacaatggaggttgttaaataaacatttttaaagtaaggagtctgaaattttataaaataatcaattttgaattattccccacttttgtctagatacaaaaaagatcagcatttaaacaaaaacaaaatacaacatttgctttattttcctggttatttgtttgttcattcataccaaatattaaaaattattttatttgagtggtattgatgtgtgatttttatttgtgcctttgacatttcttgattatgtaaattttcaactatgcacacaaattacatttatatttacaagtatatttaggagaatattttgagaaaattcaatccacaaaagcccgttacatgaagaatgcagttaactttaacccttgtagttttcttgtgttcaaatttgaaacatttgatttttattggtagtgtttgttgggtgggctagggagaatctccagaaccgaagaatcttgtgaaataaagagaagtaataagagctatgtctgtagttataattcatctgagaagtaacaccatttgaaatgaacaaaaaaaaacttgaaaaaattttatttaatatatgtaggataatatggaacatggaaaattctattcaaaattatttaagataattttactttccctagacatttgtgaagtccttctgacacctttggagatagttaggtacaaagtaaatctttgagcaaatcatgcattttaagaatattcagaaaagtaaagtgtattgctgtggcatgttaagtaaaccaaccatgtgatcagagggttggaactttcagcctcacccctcaacctccagggaggtgagaggggctgcaggttaagctgatcaccaatggttaatgacataatcaatcatgccaatctaatgaatcctccataaaaaacaaaaggagagcttctggatagctgaactcacggaggtccctggagggtagcagcacttgagagggcatgaaagctccacaacctttccccctacctcaccctgtgcatctcttccacctggctattatctgcatcctttataataaactgataaacttaagaaaactgtccatttatttttttaattcagaattttaaaatattattaaacagtactataatactttggggaattaaaaacaagagaagaatgaaaattttgctaataagggacaagagtattgagtgacaggcaatttcaaaaccaaatgattctatcttttcacatagctgtcatagcttcaccaccaagaaaattgtcacatttttagagaagcccctaatttcaaaagaatttctgccaacttctttcactgtgttttatttcacctgacaaaagtgtttacctcatgtgattggaacagtttcatagcagtaattaagaaaatgtaatgaacagaggttggtagcaaaacactttattattgagttttgcttatgtcttttcaccgtgtggtttataaattcaaaatattattggcatttataaataaaatagactctcacataaaaataataatatctagtaagtactagctcataaataaaatttcttatatttttcaatgaaatgtattccttaattgcgaaaatcaccaacctgaatttagcacactaaatatcttcaggtgcaatttttatttgagtcaccattcttctttcttcaactacatgtttctgttacttgttgtttcaccttccttcctataaatatatatcacagcctatatttccatggcaacactgctctgttctgccagttatcatgaaataaaaaaatgggaatgtgttccctatggtaaacagttagctcaacagaaactatcaaccatgggtgagaaatttactggtatattatctatgccatgtgatcatggaaaacctgagtttatgaaaaaaacagaaattttgtatatttacctgagaactttatcatatcaaattgcattttggaagatcaagcagtcaaaaatatgctacttacctgtattaaatcagaatatcccactatttgttatgcaatgagtttgtggtatactaataaacttacatgttaagaaatgtttcaggaatgaagacatttgtaaatgcttatttaaataatgtaagtcattactgaagaacttagaatattttcaaaaaatgtgaaggtctggggttttatcccacttgcaagctaacaagttaacttgacacagtttcatggatgctgacaaaagtcattaaagtcctgggtcagagacaaattattttattattcatggcccaccaggaagcatgagcatcagcatatttttgatagttgccttcgttcttatgtttcacagaagcaatgtgaatacgcccagaggcagccagcatatgcagcaggttgcattacaacagaagagctctaagtttaggaaacccaaatttcttataatggacagtaagcatgctttttctttattgaagaagtattatattgaatagcatctatgccttacatttgctccagaggaagacaatatgtctatttcccaagctgttcactataataacgtatttgaaaagatagtccagattaaatggcatcctgtgtctccactcagaagacattcagaaatacaatagtctatggagaattgtctcctaacagtccttccatatgcttatttccattgtaaatctttaaggagtaagatgttctaaatctaatttgcatatcaaaagtgtgtgtgtgtgtgtgtgtgtgtgtgtttgtgtgtgatgtgtgaaatcttagtaagaggatgtagaaatcaagaaaaaattgaagtaaaatttttttcagtgctggatattttcaaacaacttaacattcctctactgttgcattctcaattattttaatgtgtaatgggaaataggagcataggagcttttcattcgatttagtaaaaatatttatttaggtataatggcctatatttgaataccatctccaatattaactgtttagatgtcaagaaaaaaaaaaaagaaaaactctctgaacttcaggcttttcttcctgtggaattttaccatatgaattcaattttttgactaaatgaaataatgcatgtaaataacttaatgtctgcctaataaatacatattttctatataattatattaatatattattatagaatactatatcttatattaatttctatggtattataatttgagtaattatgaaataaacctgaaaattataaaattaaagtaagggtaaagtaaaaactgaattaaatatttgtgcatgcacagaggcacatgcatatatatatatatataagacaatattcattagaaaatatcaaacagggacatagaagaatgctgtcaccaagatggcaaagtaccagccctcaatcccaccacataagaacaaatatagacagctatccaaatatcaaaatagccccaaaaaggctcaaggatccattaaaatctgcagcaacacagtagagtgaaaaactggagaatatccacatagattgctggtgagattcacataccttagacaccaagagacagctaggagcaaaatagaaaggcaaaagctattggtatcagtcatgcagcaggaatcactgtggtcctcagtggcctgctccacaaaggacactggcatcttttgctatgaaggtaatcaacattcatttctaccagaaaaccccagagatggagatatggctgcctcagtcctcgcctacccaaggagtggacaccgttgagctgctttgagaaataaaccacgacctctcccaaacccatgagtcccctaaccttggagccatggctaaaatgagagtgcccacactctcaacccaggctctgtggctgtggtgagccaacccacctttcagacactagggccattatcatagtatgctagtttgcactatgtgttccagaggctagttcttgttacatgtgccaaactccaggcaccagctcagctgccatcaaaactagtccctgcctggacaccagaccctttctaatactgctcatgcctgagttcctgttcttggctccctcattacttcacaaatatccatgttttgcatactgttaccagtgcagtaggagggatgcctgtgtcttagacgtcagtgccaatacagacatggatctccagagttatagtcttccatgcatgactatacttcagtcctcagctgtgtggctactcaatggacaccactcatcaaagacaccaggtgctactgccaccaaaagtgaacccataagtgagacccaatgccaagaggggccacatcagccacaactttccagtgggagaataattgattgggaggatgttagaagccactgccactaaagaccccaacaacccttgctgccactgaagacatccacagcattggtgcctgaagatccctgcaatcttcatcaataccatccacaactcagagctacacaaagactacacctgtgtccacacaggtgccagaagccctacaacagatctagcaagtgcccttgcatccatccaccccaaaggggagagaaggtttttccttggaaaaactagcctgtaaaatgctagacatcaaagtaaggcaataaaaatccatgaaaaaaacacacaaacaaagaaacataacaccactaaaataacacaataattcccagtatctgactccaaagaaatggcactatataaactgcctgacaaatgtttaaataattgtttttaaaagctaaacaaacttttttaaaaatgcaaatagatgattcaacaaaattacaaaaacaaaaaaggtctaaaattagaaattaacagagagaatatatatatatatttccagaatttctggaacaaacagaaattctggaaataaaaataaatagaatgaagtgaaaatgtgaaatagagtgttaaaggcagaaacctgtttccagtttgttaaagaatataaactggtactttctatcacactagtacctgatatgtccaggtggagtctcctgaaggtagcaattttaagaaagagattgttgttgacttatagggctatctgctgctcataagagatgaagaggggcccctagaaggcgtagtttgccatgcaggtgtatgctgttatgtttttccacagcttggagaatgtggtaagcttgcagactgtttgccactactacagttgaatggccaactaccagaacacaagggagattcttctagttctgatgggaactcaagatgccataagttccactaacccaaaggtcatcgatgacaccagggtgaagaagccctctaatgacctaaaacggtgcatgtactacgagatgtgtgctacacacaggctaaaagtggagaaggtcttccaggacattgaccaaaaaattgttgccacaaggagctatttctcctctgtcccatcaaatcccagcaccagccagaaggaactttagattgacgttccttctactgccaacaagcctatgcccaatcataagcagtccaagtgccagtccaaccttttcacctcttgaaaatggagtgacccagacaaagagaagaaaggcctgaaaagtcacatggacagcatggggagcagctgagccatcccagttaaacaggacttgcccttctttgtctttgcactgagagccagtacttatctccagcctgctgtagcctatgtccattatcctccccctggccagggccgagggatggtcagaccagcctgcattgtgctgaaagcccacaatcatcccagctttccaggccttaatcaactggtggtgggagtgaactctggattggctgattgctcccagactgccactgtttgtcctgacttcaatgcatctctgatagacctttgacgccttgcaacaaagagtttataggagggagaactgtagaaatggagtgctcctcaagaaagctgggcaactcacaaaataccccttaatttctataacaggcaattcactccacaaaggaaggaaatcaatgagagtttacactttttctttgaggaaactttctttaaagaaaaaaatcatttacaggagctttgcatattttgggtacaagcaatggtagaaacataagacattaaaaagcaaaagaaagaatctctgaactaaatgatagtttattgaaatacatacagccagaggaaaaaaaattaaaaaggaataaagaaagctcatggaatttgtgggacagcatcgaaagaacaaatattcaacttacaggaattcaaaaagaagaaaagcacaaaagtgcataaagcttattttaaaaaatcatagcagaaaactttccaaatctggggaagggtataaaaatccagttacagcaagataaaagtttccaaacagattcaattcaaagactacactaaggcatattgtcaaaaaccaaagacaaggagaggatcctgtaagcagcaagagaaaagatgcaaatcacttatgaaagagttgtaataatgctaacagcagatttctcagaagaaattttgcatgttaagagagagtggaatgatatattcaaggtgctgcagttaaactgtcaatcaagagtatttcatccaggaaaactattcttcagaaataaggagggataaagatgtccccagacaaacaaaatctgagggaaaatatcaccaacagacatgtcttttaagaaatactaaagagtctggcatggtgactcgtgcctgtaatctcagcactttgggaggtcaaggcaggcagataacttgaggtcaggagttcaagaccagcctggccaaattagcaaaaccctgtctctactgaaaatgcaaaaattagccaggtgtagtggcacacacctgtaattccagctactcaggaggctgaggcatgataatggcttgaacctaggaggcagagtttgcagtgagccaagattgtgccattgcactccaaccctggtgacagagcaagagtccgccaaaaaaaaaaaaaaggaaggaaggaaggaaggaaaggaaggaaggaaggaaaggaaggaaggaaaggaaggaaggaaaggaaagaaggaaagaaaggaaggaacgaaggaaaggaaggaaggaaaggaaggaaggaaagaaaggaaggaacgaaggaaaggaaggaatggaaggaaggaagggaaggaaggaagggagggtgggaaggaagaaagaaaaagaaagaaaagaaaaactagagggagttatttagttatttcagctgaaagaaaagcatggtaattagtaaaatgaaaacatataaaagcaaactcttactaataaaaatgagtacacaaattcaaaataatctaactctcatggtggtgcataaaccatttctgtctgaagcatgaaggttaagagataaaacaattaaaaaatgactgcaatgatacattaagaaatgtaaaatttaaaatgtaatttgtgacataaatcataaaatgtggagtgatggagtaaaaatgtacagttttttaaatgtaatcaaagttagttaatttatcatcagcttaactaacctgttgcaactataagatattttatgtaattcttacagtaagaaaaggcaaaaacatatagtagatatataaaacacaacaagtaaggaatcaaagcataccactatagaaaatcacctaaatacaaaagaagataggatgataggacaagaggaagaaaggaataaagaatctacaaaacaactgaaaaagaatgaacaaaatgacagtagtaagtccttacctatcagtgattacctcgaatgtaaatgaattaaattatccaataaaaagacatggagtaaaagaatggacattagacaaaagaggtcaatctatatgctggctacaaaagactcatatcacctttaaggacaaacacagattgaatatgaaaagttgtaaagaatattccatacaactagaaaccaaaagatgcggaggtagttatatttatatcagacaaaatagactttaagtaaaaaattttaaaaatagaaaaggttattacatattggcaaaggaatcaattcatccagaagacataaaattataaatatgtatgtactcaacaccaaagcacttaactgtataaagcaaatattaacaaattggggcaatacagtaatactaggagacttcaaaacaagattgttaacaatggccagatcatccatacagaaaatcagtaaagaaatattggatttgaactacattttagatcaaatggacctaacagacacataaagaacattccatccaacaactgtagagtacacattgttctcaagtgcacaaggaacattttccaggatagatcagatgtcatgccaccaaataggtcttaacaaatttgaaaagactgaaattatatcaagtatccttcttaaccacaatcatatttaactacaaataaataatagaaatatttttgtaacattcatgaatatgtggaaattagatgccatgctcctaaacaaccagagtcaaaaaatcaaaagcaaaatttaaaaaaagaaaaagttgaaaaaaacaaaaagggaaaaaacacacaaaaactcatgagatatagaaaaagcagtcctaagaggtgctttatagcaatagacacctacatcaaaaaataaggacaattcagaataacctaatattacctcaagaaactaggaaaagaaactaagtcaaaagttaaggaagaaaataaagatcagagcagaaataaatggaacagagactagaaaaatgatagaaaatatcaacaaaactaatattcagttttctggaaatgaaaaaaattgacaaaactttagctagactaagaaaaaatgagagagggtgtggatgaatagagttcaaaataaaagaggagacatttctttgataccatagaaatacaaatgatcataaaagactactatgaacaattatatgcccataaattggataacctggaagagatgaataaagcctcagatgcatacaatctaatacacaaaatctactaagactgaatcatgaagaaatttaaattcccaacagaacaatgaataaggagattgaatcagtaattaaaaagtttcccatcaaagaaagcccaagacctaacagggtcactgaattctactgaacatttaaagaagaaggaaaaaaaagcaatctttcttaaacacttccaaaaaattgaattgaaaggaacacttccaaatttatttattacaatgacactaaagccagacaaagacactacaagagaaaaagattacaggccaatatccctgatgaacacacatatatgcaaaaaaaaaaaaacaacaaaatttccatttcaaataaggaccaaatataagatagaaacaaacatcaaaaaataagactcaaaataaactttaattttcaatatttcacgtttgtttttaaattagctatacatttatgatcacaaagttgctaactggtccatcttacttacagtctggaagcaaaaattgacatagtgttacaattaaaagctgtagtaaggacaacctttagagaataaaattgactgatcacatatttttttcctgctctaaatagttccatcatatagacacagcattggcacatctttcctattagctcatattctcaagagtgtatgaaaataatgccaattatcagtttatattatttttatttggtaagaatgaatattgtaatttatagaaaatgcaatgtattaacatttaattatatagtaatatgttaaataatttataactagaaaaaatatttttcctttattaacatcagaacaatgtttcaaccaaattccttttaagaagcatagggcttagattaaaactgactttaatgaaatcagattaatggcatctaagaatgaaattcagacttagtgtgctcattacttgtgttgtagtcaatcgttataccctatttttttatttttctatagtaattaattaacaccaaagagtattttttcaatttttaatgttgattgtctctgcaacgtttttttttctgtctttgagatgaagtttcgctcttgtcacccaggctggagtgcaatggtgagatctcaactcactgcaacctccacctcccgggttccagtgattctcctgcctcagcctcccaagtagcttggactataggtgcccgccaccatgtctggctgatttttgtatttttagttcagacgaggtttcaccatgttggccaggctggtctcaaactcctgaccttaggtgatccgcccacctcggcccccgaagtgctgggtctgttacatattctaataagtaagtcattgtcaagtatatttatttcaatgatccatttttttaaaaattcatataaagaaattggactgaaatttgtgaagtgttaaactaccaaagctccaaaacaccttggcagtgttgcactcattaacgagtttggcataaaaattctccagatgagatgtcaaactaaggtattttctgtaagtcaaaatttttacttgtgctctttccagatggccttatctaagccattatttttcagttttccatggaactaatgctgaactacacatttgcttagaaattactttgttagaatcattaatataagagaaaaagacaaatttaatcttgaaagagctgaatttgaggtgtgttgcagacatccaagaggtactcccagcgagttaggcaaatatgtaggtatgttgtccggaggctaggtcttgattgacacaatctggaagtcatctgcatatagataataattaaagctgtgagtaaagatgagacttcctagtgtaagcatagggaaaaaaaggtttcagattcacttgaggaacacaaacatttggtagaaagagaggaactggcaaaagtgactgacatatgtgatctgagaagtaggaggaatccaagggaagaaagtgttacagaaagagataaattggtaaatgtagtaagtgttgcttggagttggaatataatgaggcatgaataacatctttagaatttaatggtacagaaatcatagttagcttagtgattctgaaatattagaaaaatggagatgaaactgcacaaaattatttgagtatattaacataaattttatcttcagagaattaatgaatttactatataatgtgaagtgtaatgtaaagtgggaaaatgttccatctcatcaggcagaaattgattcttttacctaataggttaactatttaaaattgacaattctcaagtatttgaggcacataattttatattgtgaggaacagcataccatgatgattagaaccttgaccccaaagatttttgttgttgttgttgttgttgttgttgttttgagacagagtttcgctcttgttgcccaggctggagtgcaatggcgtgatttccactcactgcaacctccgcctcccaggttgaagcgattctcctgcctcagcatcccgagtagctgggactacgggtacctgccaccacaccctgctaattttctgtatttttagtagagacggtatttcaccaggttggccaggctggtcttgaactcctgacctcaggtgatctgctcgcctcggcctcccaaactgctgggattacatgtgtgagccattgcgcccggcagccccgaacttacaacacattgagtccaagctaaacttcctcaaagtatgcatctttcgtgagtctcaatatcttcttgagtaatttaggtttagtagaataactaacttatttctcagaactgttttaaggattcaaaaatgaaaaaattaggatatgtacaggataatgttctttatctacaacgtcataggcaaataaattatataagagacagactgtctggttgtatgtaataatgatctgatatcattatctccacttctggtcttgctacccagtattcaatcctctaaactctgccttgaaaatgtgttatttacatctccacaaaaagataaacgtattgtacattacatgttcatacatacctagaaccttccatttaagtactgtcatgtcttattgtggtcacgcaataaatatttcttccactggcttttagaaattgtaattacttgaagtaaatagttacaaagcaaatgagtcagtattgacagttgcatcctttaaaccatgttgaatcagtgtaatctgtacattaatctgaagtcaaaatgctgacagttattaaatacacttatttgatctagctctttgtaaaacacaattgtattttcttttctttcctagctgctttgttttctcctgctgcctctaccttgggtaagttaaggatggtcatgtttcactcagtgctaaaggatatacagacttagcttaataaataccaagttgaagcctgacagaaatcagctgtgctcctctccagtttgatggcccctttccaggtaggtttaatgtgcacataaaatgtcaactctctgaaataatttgtagaagattagttccatcgtgattcaatttgataagaatgggtattaagaactacctcagtggacttatttgcactagtctggcttattggtcatttccataaagatctctgaagtgtggatgataaactagcaggaggaagagctcttgaatcagcagcccccagccctctcaacctgccagccttgtggttgctgaatgttttccatttccctaatgtatttatctgttacacttatgaccccggatttaaatagagggctctcactgctggtctttggcctccagttacagcacctgacttctagttgtcttcatcatattttatttgttttaaaataagagagctacactgttatttatcattttaaaagtgatacgctggaggaaaatatattaaaataggaaacatttttgcccctgaatgatgggattataggtaatgtttctgttttgtttttgttattttctctactttcaaattctttaaataacagaaaaaaatttcacatgaaatatatttaaaatgaacaatgaagactaatgcaccagccccacagatcattaaaaataccccaaaatattaaaacaagagtccgtgtcaaacctggaaaagatccattatcatttcagttgagattatgagtgtcatcaaactataacacttaacatatgagaaaaatgttaagcaactatacacatggagaatatttcatagttcacaatgaggtagcttcaactcaaaatacccaaggattgaaagttatatttttcaaataacacttaatgattattttgtggactggagcatttctgtaaagcatttgttttcaccatctaatatctttagaacacaactcacattcatttattttaccctcttttttacctccctgttttatgttctctttgaacttaaagggactagttcatattctctaaaattttcctttttttcctccacattgccctcttcaaatgtttttctacttaaatcttaggatatacattgaaacagattttacaaactcagataactaaactacaaaattagatgtttaatatattagtattcagtacttgggtgacaagactgaattaagttagaaaaaaatgggttagaaaagttaaacataagacaggattgccatttatacacatctgatggaaatgagtatggtgacaatgatcttagatgaaaatattatataactgtatactcatggaactgaaagctgcataaagaagaaattttaaatccatgtttacttatcttcctaagtataaatgatagactagtaccaaagtatgttagagtttctccactagatttctgataagatacatgagaagtagaatcccttccaagtggtacttaccttatagtgtgactattttccctaacccactgaccacccttactattacagggaaaacacacagttgtttcctgctttgcactatcgactcctgggcactgctgctcctgctgcaatgccggcttcctcatagtaccacaacacttcaactagccctacttatgccttttcatggtactccattcttcaatgtgctgaagttacgtttggttcattgagggcaaaagctaatgcttatttattttttatactatgtttcataaagcttatttttacccccaccccaattttagtaaatttttggttaaaaagcactattgtagatttaacttactgattcctttttttccacgagtacaggaggtagattggtgaaggatttaagtgacagacaccactttgtgtctcgcaataaaattatttcttctctccaaacatgatactctcttatgcagtcaagtttgatatccttgaattcatcttaactgaaaaacaattgtatagcacttaatttgtgccaagtgctgttgtaaatactctcttaacatgaactcatttaattctcactacaataacagaatcaggtactgttattagcttcatgtcacaaatgaggaagctgtggcacacagaggtaagcaacttgctcaaggtcacacagctaataaaataaagacttatacttcaaacccaggtattgtgtgcccttactgcatcactgaaacaggctgcctctttcttcacaagaaaatacttcagtacctcaataaatgacatatagtaagcctgatttaccagttcactatacattccaggttagtctgaaactgcagcccacaacatagacaccgtgcacatgaataggcttcagtcataagaaattgactacatatgttcatcagtcctttttcattttatttcaaagctgagataactgtgcaaatgcatatgcattatctttccttctgtttctaaacattcatgttcttaaaatagctttgcacttgtaatcatattattttgttttttgtacaatgttaggcaagtagcaagaaaaccatttaagagcctgtgttttgctgccagactgcattggtatgaatccagattgtcacataatatgtgaccttaggcaagttacatactctgttgctcagttttctcatatgaaaaatagagattataatacaacttactttatagggttgaaatgagaactaaattagcaaagaatgtaaagcatgtacacagtgtttagcatgtggtaagcattatgtcagtgtataggttatatacaatttgcaaagtatgctaccattcatatatacttcagtttggtcttttctcatttttggacaattattgatatatttttataaatctagaggtgcccagagtttgattcttaagcctcattagcattctcaaagaaaaattacatattaaacccatttacccatacattgttgagaagtagcaagttagaaagtaaaaaattaaaaacttcaacatagcacaaatttattgaattcagttacagccctggctctgtggaattcctgcaagcctttagtcttccttctaattacatgggaaacacatccattaaattacaagggtaaaataccaatgataatttggaaatttgtatagatttcttaactttttggcaaatacacacataaattaagaatcaaggaaatttcagtatcctaaacaaacatatcatgggtcatatttctatacattttagccacttattgtataatagtttgacttttgaaatgacagacaaaataatttatatgtgtatattattttacctagcatatgtaggtatagagaatgcttagtttcttatggggatcttattattgaatggtattttgaaactctgatagagtaataggatttgaagacatgtgattacaaatgtgctcacaaattgaggtcaaatgtaagatgattagtcaagttatatctaatgttgttataatcctgtgctatttagaaatgtcaactgagtagtgacttagaaaaaaactgacactccattttcttatctttcttttaaatgtcatactgaagagcaaaatacatgtgggccagagggtattttgagttgtttttgaactaaggtttttatatattgaagtcaatatatactttggtctcatttatatgataacataacaccttatttcaatgaaacatagaatattaacacattgaaacatagcataaaaagggaaagctctagagagggggcagtgaaagaggaagtttaacccttcagtgcttcttcatgggtcattgaagctgtgatgtcagttttccaatgtacactcaactgggatagactgctagaaaaaattatcctttcataagtcctctattacttgtttttttttgttttgttttcatgttattccacactttcagattcagaattcagattcagatcagattcaggctttgttagctcctgacatgcctttaccaaatttctactggacaatggaacttcctcatattcgtgtatatttattgaagtcgtaatatatgacagtctggcaggttctgagaaagtatgtactatagtaatgtttactgatcacctagaaaaatatacaagtaacttcacagtctcagtcaatatgatgaattcttgtcagaaatatctacaagattgattgaagcttgtggagaggtacccaattcagaggggcacacttagaaaaggaatttgtaggaagaagagacaatcaatctgaagtttgaagtattcactagagttagttgagtgacaaaagagtgtagtagtgacaaatacacgtattggaagaagtgaatctcagtttcatcaataacaggttgtgtgacctcagtagggacatcatgcagagttgttcagggtgatcttcataccaatgttttgggccaaaattgctaatcaacatgaaagccagccagaggtctgcttgcccacccacagaccacactaatttctatgcctgcttagggcagacatatttttctaatccacaggtacaatgcagctctagaccttaaattagttacttaacatcactagccttcagatgcttaaagtggagattataatagtagctacttcatagtgttgtgagaattacatgaaacaattctcataatttgttttaatgtgcttaaataagctcaggaaattttttgtcatcatgagaaaagatgaagtcggggagataaacatggataagaatgattaccaacaccaatatttttccaagtggaagtctcacaatatgaaataaaacaagattctgagatatgagataatatcaaacaaaaactatatctgacatcttgaatttagaataagttacttctcactaaatgaaactttttgtttaatttttatggtttaaaaaaatctctattcacattatatttcttcttttcacttttttttcttctccttttccctttatattcagtgtataaagagacctgccggtcttgtccataaatattgcttgtagcaagtaaaaagcttcaaaaccacaaaacatctgcatggttacccattgaatttatttttcatataaacggctttgactctgctaatagataaataaattaactgtcattttaattttcagcaaaatttagagagaattgatgtttcaaatatcatacactttgcccctgctgtttctgtttcttccttctgaactactcagaccagtaccagcgacaaggaaatgactccttttgattacaaaataaatgaaaattgaagatctgtcaaaatgtatccagtagaattgcacagagcaaaataattcttcaactctgtgatgaaaggatgagctccctctgtgatcatcacttactaggattgaagaattcatggttgtgtggtttgaaattaaactgagttcaaaagtctgaaagaatttttttttctttctggttatctccttgaaaacaaacaaacaaacaaacaaaacctgaaaagtccgtaccagtaagatatttggattactatgcagcaaaattcactattgagctattaagtaaatgaacgacagtggttgttaaaattttcttatatcattatattatccagatatccataagttatgctaattttaacctacatattttgatatttaattctctgttattaaactcatgttgctacaaatatttgaaaaattcctaactgtatagagattttgatgtatggcaattatgactagcttatgtagaatataaactaaaaataccagagaacatggacacatagcaaattaaataataggttaggaatctttcagaaatttgttaattttaagattgaaaaacaggtattattcatcaaaaactcacaatatcatagatgagaaattacatgtatctgattcaaatttctgcaatagaaaatatatatcagcataaaacatgataaataattacactgcaaaaatttccatggtaaattatacctttattttacaacagtgaaaacttttcatcaaattagaaatttaaaaaaacatagaacataagcctttaatttttttatagaatttttgtactcactcttcattcagtgttttagtcatgatcttttatggttattatcttcattcaaaattgaccccaaaataatatgccaattatttatttactttttatctttcaatacttttttgttcactcctcatttccattatcattttgtataaggattattggttaactttccaatgcttcttttaggtttcatgatattagggtgggattgtaactaaacaagaagaggatgaacatgagtgctgggactgaggccaaagatagatgccatgattgttaggaatttgcatctggcttcttgtggagagagtgagagagatttattttgtactggggagagtcgcattttgttaggcagaagcatgttgcttgtatttgctacatcaacacaaatggctgtagactggtatagtctgtattgtttgtcaattttctctcagctccaaatacgacaaaatagaaggagattggaatgcaggaagagaaagggggacaaggtcctactaaatgctttgtttactatttttgcccagaagtagacctttcctcctagagcagcaggtagttctccacgagcttcttcagacactctttgaaccagtctcattattcttccttagtggaaccagctacagattagtttcttcttcaggaagaagttccagatctgtgttgctcttcttcccagactctaggatgtgacaaagtaacttcttccttttgttctgcaagtcattttttttcttttttttgagttattatctctggatcctgttttctctttttgcttatacagccttccaacagctttgttacaaattctctatattaaatatagggaatttgttgaaataggtagtgtgatttctttttgtccagttgtgtgtagctcaatagaaatattaaaaccatattgtcatatcatttgctaaaatattaaagttcaatttatctcatatttttatggaatcttgatattttgaacttcatagattttactttctgttagttctgaagattcttgtagtccctgaagaaaaattcttgctagagaactagctaaatacaaggttactattttaaaatgtcaaaagtaaacagaaaatttcaaatcagatgtattatcttgaaaacagtataacttggaagtgaatattaatgtcttggaaaaactttttttgttcactaaaaataattggaagaaaataaagtgatggggaatcacttttttttttttttctttgagatggagtctctcactcttgtcacccaggctggagtgcagtggcaccatcttggctcattgcaacctccgcctccagggttcaagcaattttctggcctcagcctccctaatagcagggattacaggttcgtaccaccatgcccagcaaatttttgtatttttagtagagacagggtttcaccatgttggtcaggctggtctcgaactcctgtcattaggtgaccgcctgcctcagcctaccaaagtgctgggattacaggcacgagccaccatacccgactgggagtcacattttaaggtatttcatttcttgtaaatgttctttgatacaaaaatgaaaattaattttatgaatagggtaatttggagagctattaaaaaacagagcaaaaagtaaaggagaaagcatcccaagttatttgtccattaatttatatctttaaaagtagacaaatctaaatagaagtagtacaataatgaggactaaatgttcccagttgttgtgaatcaaatcaatgtctcccataatacttcactaatgtataatgaggaaacaggcaataaaataacaatatgttataaataaccaaaatgcatgaagtactatcataattaaagaatgtttcttggatctcataaacatcaaaaagatatttgacaccaccttacacatggttataaagcagtggtcctcaatgtttttggcaccagggatcaatttctggttgtatgaaagacaatttttccatgcttggggcaggacgatggggatccctgttacaaagaatacattttcaaaaaccaaaagcaactgcacacaaaaatctgtggttgatttaatagaaagtatggttctgtccatgataatgacaatgggaaaaaggacttctagtaatgacagcagagtggcatgtttgcattaactactttcagattataactgtaaacattatgtaaacttttttgaaatattatttcatttacagcgtacaaaaaaaagtaaagcaaagctaggaaggggttaatttcaaaaactacaactgaaaggaataaaataattgtgattttcttccttttgaaaatttatagaaaattgtagagtcacattggtctaataacagtaagtgattaggagatgatgccatgtaaaaatttagaaattattcttattcctaatattatgtggtttattatgttttaatttttcacctactttgatttatacaattgtacattttatgatgcaatccacattaagtatttttggaagtaatttcctaaatatgtaaatatataaaaagtattctgggtacctcaaaagaagtaatgaagtgggtccactcccatcaaaaggaagtagaagtcatgtacagcattgttatgcttgtcactagtaggaatactcgttatattttattaaaatgacaacttttctggccttgcaatggtcaggtaaataaatccttatcactacctaactgaaatagctctgtaactgaattcatcactcttttcttccctgagtcactcccatcttacaccatcaataatggtttcctctcccatatagcacaactccattcttttaaaactgttattttaatcacttacttgattatttgttatccactccttctttcaattactgtatctaatatatcatctttgggtacttctatttttatgtagatttgttcttacttatctcaatttaacaaagaactattcatatacttagcgccttatgacttcattatttctttctaaaatgactgttttcttctcctttcaaacttttaatgtcttagattagagtcctctcatggttgtccagtgtgtataaacactgatacaaaattatttttaaaacaaaaggtacgctatttttaatcttttgatgtttcagttttatccactgtaaaatgactgacactttcagctcccttgtaatagtttccaaaatctgacctgactctaagaagacaaccataactcctgcttttcccaagacaaatctacttcttcagcctaaccattctcctcatctttcttattcttcaccactcctaacaacaacaagaaaaagggatatgctctctaggtttgaggtgcttgtctttttctgctatctatatgaaagcaatatattttatcaaagacaaattcagttcccactttctctagcatcctttgtcaaactacatcagtaacatctgtgatactgtaccatgttattttctttattatatatttgattacttaaatacatgtctatatatttttcaccttaatcgtcagtgccttacctctttaccttggtggaagctcctccaaggaattcatggaggtaaccatttcttacatttacatatcccctcagtgattagtaaaatgctttatgtgtagatgatgtccaatgaatatttgcttgagcacagtgcttatatatttccagtttgttaaccagaaacattcgacaataacaatttattttttcaataatcatttgtttgtgctgatttgcaatggacatccaaatgaatctttgggacgacttttttttgtgtcaaaattatcaaatgaagagccacagcaagaggtcttccaaatgtgctttcagaaaaaataaaataccgtatggttttaacaacaacaaaatccagttccagacaattttgtgtgcctaacagattggagttttatcgcaaatatgttggttagttaatgaattcatttgagtgtgattaacttctggattgccgcaaacctgtttatgtatgaaattatggtttggaatgatcacttgttggcttatgaatcaaataacttggtttgtatatagaaaatccaatgtgcatatggtgtgaataccacttgtaaaaatataattcataggaaatggatagtgtgaatttgtggtgactttgtaaattggctgacaacttgttttgtgacatatgcccagaaggaatgctttatgtatctcacaaaagagagttttaaattttaggttttattctctttatagattataatcaaaggggtatgaaattatctcctttggattcttctttcaatacttcatcttaatcattgcatataattataataaagccttttgattttaagaaattaatctatgtttttacatgtagcattttgtaatagctgcataatatgaatttttaaagttgtaatatagacaaatcttcactgcacttatgaatttttaaaagttgttttaaaatagacaaatcttcagtgcactgatatctgtgtaacattggctaagagaaagaggaagcctttgaactacatgtttactaagcctttttatttttaagctaccatttcctttagtttcatctaccaattaccattttggtcagttaattggaaactatttgtaaagtcttttatttctgagaaggtagaagaagaacaatctgaaagaattcagacagaaaatacctagaaatgtttgacttgatgttatgctttcaagctaattataaatcaatgatatagcatacgaatttttgaattttctaatgcaggaatcatattttaccacaaaattaaatgtgttgcctaccaatagctatatgccttaaacataatatacactggtggtttcttcttttccattagtgttgacgatagagtgattctctcatagtttcatgatgcagtatatttttataacaaaggtgtgacaaagagaaattcttcaacctattttaatataagaggataaattgaattttagttttgtgtttttaccttccttagttaaaatctgacaaccagcaaaactcaggaagagccagaggtaattaattaaacagttattgagtgcttatcatatgccaaataattttcttaattttagaatgtacaattacaatcaatgtttacttatataatttctaaatgcaatcaataatgttgcctcttctgactggacatctcccctggtatgttcccaatagtgtcaactacatctcccctggtatgttcccaatagtgtcaacaattaaagaaaaaatatatgccacaacaagtataaagccagggaactgcaaacttgttttggcaaaagtacaatgtctgttatcatggaataatttttagtattttaaaataatttaatttttaatattaaaactcatcaatacataattcccataaattcagaattttgtacttaatttcaaagtttagataaagaatgagggcactcaaaaataataccagatatttgacatgaaaaataggaagtagtccgtgaatctgaaagattaataaatgcatgtggtttaaatgtttaaatgcaattttcaagaaagagcaaatttcacattggaaatttaaaagactgaaacagaacaatctatgtatctatctatctatctatctatctatctatctatctatacttaaattctgataatgccaacaaagatgataagaatgattttaaaatgatgacacatttagcattgctcttagagtcacaggttttaggtatctaaaaggcacattcaacataattatgactccaaaagcttttataataataatgattccatgccaggcttactggctcattcctgaaattccagttatttgggaggctaaggcaggaggattgcctgaggccaggagtttgagcctggataacataatgaagccctgtctctacaaaaaatatatatatttttttagatagccaatatctaaaactcttgtaggcccagctactcaggaggttgagatgtgagaattgcttgggtccaggggtttgaaattgcagtgggctatgatggcaccactgaactctagcctggaagacagaataagaacccatctctaaaaatatatagatatataataataatgaccccaccttaggtttatactgaactttgcagtttgctaaactcttttatagataatatcacattttgttcttataagtctaaaagactaaaaaaattgtcttacacacacacacacacacacacacacacacacacacacacaggcttactttaaaattaagaacgatagtacatgttccatagtaactactgacaactaagctctttccatatgctgttgtgatgcttaatttatgtgtcaacttggagggcattttggatgaaattagcatttaaattggtaaactttgactaaacagactgtcctccataatgtggctagggctcatctaatcaggtgaaggtctgaaaagggcaaaaatatcagtctcccaaagcaacagggaattgtccagaagacagtctttggacatcacccttgccatcagttttccagagtctccagccggccagtctttgaactagaactgaaaaatgggcttttcttggtccttgacctgccagcccacactgtagattttagaattgtcaacttcaatttatttttaaaaatatctatctatctatctatctgtctatctatctatctatctatctatctatctatctatctacctacgtatctatctatctgtacatacatacacatcctaatggttgtttctctggaaaacactgactagtacacctgctctctcattagtacacattccaaacatgatgcatatgtattatgtgcatatgtgcatatatgtgtttatgtacatgtttgaatttgtgtgtacatgtacatacacatacatgcatacagaactagagatagagatagaaatagagatatatccagggacacttgaataagcctgcatctagtggactgagggatttgaggccttttccatgtaacaatactttatcatctatgaatatttgaaattggtaaattattacaagaagagcctattagagccaggcttaagccattccattcctatgatgcaatttaattcagttataacaagaaaatataatacaatgttcttttgtctctgtttcccctattttgagaaattctttcttgcttgtcaccttgtgatatctctgagggtgaatagacaatctggttctttagtgatgcaaatgagaatgaaagaattgtaattaggtgccatcacagtcaatcattgtaggcttaatggaggaagggagactatctcaaggaggagaagtgacatatgtccataaaaacatgtcccagaatatgtcccagaatatgtcccatatgtcccagaatatgtccataaaaacaaaaaccttttgttcaccccttttcaaacatggtacctggaatctaggattggtaacttaaagtattaagagaaaagacttaagcatcagaagattaggaaaaagggtcaacagctatatttattattccatattagctttggtagagggaaaaaaaaatcttcataaaaagttacttctgactgatcttcctcagcttcctaatgtcttggagttcaaattgacaaaagacactgatttattaatataaaccttgacaagttaaaagatattcttcttaatcttgtcccaaattcccctaagacaatatgactatctgagttctaaagataaaatttatgagttggaaggattaaattacttgccccaggtcattcagcttctaaatgggcatgcactggtttccaatagaatctgattctgaatccttttgactggagcacacttatcactaaaccacccaccccttgtctctccctgctggaatgtaagtgccatggggacagggagtattatgcgtattgctcactattaacttttcagtacccaggatagtgcctgacatgaagcaggcactcaatgaatatttgttaaatggtatatatttggaccagtttgaagtgcctcactagtattttttattgtgtgtgtatatgcatatatacatatatgagtaaacactaagttaatagagtttttctgtgtcttttattgtataatttatctcatccatattgttcactagtaaatcaaataagcaagcaaacaaaaataatttttactttaagcaaaatattgtacctttaaagttcatgattgattcaggattttaattcttcctttaatatcagtcttagccacaggccactgcgaagatcaaacctaaaaaaagtcatttacttttgtcaagattcagtccttaagtatgtaaatatttcatataatattttattgatattagaataattggaataacttatttatgttccaaatgaagtcaataatctgtgatattcactgctagaaagataaagataaaataaagtaattatgataatgaaaatttgaatacctacagtattgtgttagatttcttcagagttacagaaccaacaggatgtgtgttgttgtgttgtgtgtgtgtgtgtttgtattatacacacatatatacatatatgtgtatatacacacatatatacatatgtgtgtatatacacacatatatacatatgtgtgtatatacacacatatatacacatatacatgtataacatgtataatatgcaacatgtatctgtatataatatatgcatacatgttatatatgtatataggtattatatattatataaagagagacagataatatatacatacatatgtacagagagtgtgagagagatttattataaagaatggactcatgcaattatggaggatgagaagccccatgttctgcaattagtgcactggagaccctggagggccaataatgtattcccaatgtgagtttgaaggcctaagaaccaggagggttgatggtatcagttctagtctgagaaccaatgttttagttcaagtccaaagacaggaaaaatctcttgttcttgctcaagcaatcagacagaaaaaataccctcttactcatacgaggtcagcatttttgttccattttgtgccttatctgataacctgaggtttacttacatcagagagggcaatatgctttacttagtctaacaattaaaatattaatttcatgcaaaagcaccctcacagacacactgaaataatgtttgaccaaatgggcacccatagtccagacaagttgaatcataaaattcatcatcacaggcatcttttcttctaatccactactagaaatgctcttcgataaatgctttactcacagaaggtctctttattccaatactgcagtgttttatctctgtgaaaaaactacatttcagtttaagaacattattaaactgtgggtttatgtttaaatgtcaaccttgaaatacattgcatttcaaaagatcaatagagttttaatttatttttgataaatgtctttcattgaaagaaaaataagaaactgtcaatgatctgttctcatgtagttattaatgtagtaattttttaattgttgtagagacttaaggaaggaacactttctcagtcagtatcacatttttggattagtgtgtgtgtttccaaattctcgacaatcaatcctgatcattttttttcttaatggctagattgttgagccatggtttatttatttacctgagccacacaaaatcagatattctaaacttaaatgatgtattacatacatttataaaattgtctttctaattattttattatctgaaaaaatataactttgttttctctttgtgtgtagctgtgtgctcgtgtgtgagtgtgtgtgtgtgtgtgtgtgtagaaggggagtaatttatgtgcttagagagatttgttgttgttgttttttaatgtttttagctaaacaatactgttgtctgacttcagtctttttcaagagcaaagaaatgtcaatccatgaatccagagagatagagttcagggacttgtttcttctgataaacctgcagttgactctcatggtgtatttggaataaatgggtcagattagtgaaatgtcatttttgttgtttctattttgcagtttataaacttggaatgctccagaagtttaagagccaagaacaatgctggcatgatcataaggtcaattacatcttaacatttgccaaaaatagagtagtggcctcaaaatagtttcatttcagagaaagggatataaaaagagtgggtaccaataattatataaaagtattatactaatctaaaccatgatcatctgatgtcccatttctatggctcctgagtttttctccaacttgaataagcctgaatctagtgacatatgcattctatgtgttaactaaatatcaaggatcaataacactgggtttccactgaagagcctttagggctactaagaatttaaaggtgaaacagagtctgccagcactcctgctccaaacagaaacatgtgctgtcttaactattttaaattctgggatttgacctcaacattttattatgcaaccctattatactgtctaaaaataatattttcaagccagtgactctccagcaagtctgtgtaactaccaccaccaccatcatcaaggttaattacaatatttcccaagactcttccaaaatctttacatatattatacatttgtggcaaaggttaaatgtatatatgaggaaaataatacattaactgaaaagtatataaacattatatctaatgctatccaaaaaggttgctctagaaatctaaaaattactttactttggctcaacttactttatttccaaccagattaacaagacttatgactccattaacactgaatcgaaaatgattcactgtggtgacctttctaagctgaaaagaggactatagcatcttgaatagtcaacgcctatattgtaatttaaaggctaaacaatacgtaaactagattttaaagtgtaaatgccatccttaccgtgtcactttttcagttggaaacctctgcggctggtggtgcctttgcctgagttttacacgggcccgctggcctcttctgctcactcgccccagcaggctgtatttggctcataatactgacctggatcccacacctgccaagggcgagcctggtgaggagtagcaaggggtgtgttaataagcatggggtctggccactgcacacagccatgcgtgcttgctgccactgggcaggcagctccaggcgccagcacaggcgtgggttccgtgtgagactggctggaccaggcgttaccacaaatggcttccactgcaggcactgggaaatacgatggcacccggaagcttggagacaccagaaactgcggagccccaaagagggtgtcacagccctggctcaggagtctctaggtctgggattcctgaagggccacagcagttcgtttctcctcgtcgcccacaaagtggcgagcggtgggcatgtttcagccctgtttgtgttaccgctctttcagtcccaccattcactgggtcccagggtcttgttccacgacaagaatgaggtacacggacaagtggagggtgagcaaggcagagaggagcttcattgacagaacggctgcagaggaccggaagtggacagctcctttccgcaggcgggttgtcccaatgagtgtccacctcagcagagaggagacccgtagtgggtggttccgctcacatgcaagttgtcgtgatgagtgcagctctcagtggagcggagaaccagaatgggtagctcctttccacaggcaagtcatcctgatgtctatgtgagtttggctggtttcggggattttacggtctcagaagggagaaagtacgtgctgattcatccatgggcagccatgggcaggctggtaaaaagcaccatgagttcccactccacctggatctgacagcccggccaccaggcttcaggccgtctctaccttgaaggtggggcttcacgtgggactaatccctttccacccaggaacctgtttgcctcccgccatcaacatgcagtccacagtgcccaggctgttcttaccaagcagtggcctttgccaagctgacttcagcccctcctcagcctccatcccatgttcgtcggtgcccgaagtccagagggggctgaggtggcagaaggctggcatttcagtgtcaccctgagcgtgcgcacacacacccggtctggttgcaacagcacccaggctttgccacaactttgatcctcaccagagtgggcgccaggagtggggtgaggtcaggcaatgggagcaggaactttcaagcctgcggtggcaaggagcttcctgggcccctgacaatacagggatgctcggatctgaagctacagctgggcagctgtagctgcgcccaagaccacagggctcccactctgccagctctgtagggggatgggctcctgcctgttcccagttcctaccgccctgaggagtgtgtcacccgggccgcacttcctcccctgcagctggcgtctttgcagtggctgttccagaccagctaccattgccatcaaaaacatgtggttgagtatgaaagaaagcagagattaagaagatggattattttctggtcttattcttttcaatacacagttgaccctagagcaatgctggtgttatgggtgctgacttccatgcagctgaaaatctgagcataaccactgactgcttaaaaagttaaatagtagaagcccactgctgactggaagcctcacccatatcacaaagattcaattaacacctactgtattctaacaataaagtaagctagagacaaaaaaacgttattaagaaactcagaaggaagaaaaaacatatttactattcattaagtgaaagagggacatcctttctgtcttcaggttgagtaagctgaggagaaggaggaagaagaaggggggttggtttttctgtctcaggggtggcaacggcaaaagaaaacttacttataattggactcatgcagttcacacttagctgttgaagtgctgactgcattttacaatattaataattatacttgattataaaattttagaggtaagatatactaccaactgaaaatgtagttataattacagaataaccatattagtaactgttgcttcatttttgaccatgtaagatgtgaaaaatatgcactactgaggaaaaggcagaacaaattttagtaattgatttccctaagaattcctaaatggtgatgaacatgaactgtgatggtttccacctttaatgtgggtgggcactatccagcctgctgggggtctggagaaaaaaaacaaacctgtctatctgttagaactgagatgcactctttttctgctgtccttggacagcaactccagactccatggcctttttattctttttttttttttttcttgagacagagtctcgccctgtcgcccagactggagtgcaatggcgtaatctcggctcactgcaatctccatctccctgatttaaatgattgtcctggctcagcctcctgagtagttgggattacaggcacctgccaccatgcctagctaatttttatatttttagtagaaacggggcttcaccatgttggccaggctggccttgaacccctgacctcgtgatctgcccacctcggcctcccaaagtgctgggattccaggagtgaatcatcatgcccggccttgcctttatattccaagacttacacaagtaccaagtctctcctggatgttcacacctttggctttggactgagagttacatcttcaacttctttcgttctgaggactttggacttggactgagctacactaccagcatctcatcctccaccttgcaggaaatctgttgcaggtcttctcaaccaccataatcaggtgagccaatccctctagtaaattccctctcatttatgtatgtatgtatgcgtgcatgtatgtatgtatgtatgcgtgcatttatgtatgtatgcatctatctatctacctacctatctatctgttattaattccatctctctagagatccctgaccaatacatggacaaaatgtgacttcaactgaaagccaaaaatagcaaatggagtttgatatgccaccttgcctgtcaaagtgtgatacagagtccagtagcatcaacatctccagggaggttttcatagattcagtatcttaggccccactacaaaatcaggatctgcattttctcaagatcctcagataaattgcggaaacattcatggataagaagcactaatataaggaatgtattcaatgtgggttcaaaaacattgatgagaaagatgaaattcttggatttttatcttattttattcaattactatcaagttatctaatttttagagatcaaaagatagctttataacgccccttctatttttcttaggatgatcaaagggattatgaagaaaatgccttggaaaagttgaaagtaatctatttatataatgaataaattattgttattttgggataaaatctattgcttttatttaaacttggaactttgcttcaaataattcacaataatatttgatttggaaagaagttaaatttatgaaatattgagaaaaacttcaaaagagatttttactgaataatgaattaataattctaaaacttttctataagcagaatcttacttttttattctagataatgctctatatgcaagaagtgggaaattacataagctaatttgaaaataagtttatgctctaaccatccctggtcacaatgccttttttctttccttaatggcaaactaggctcgcccgatttgtacaccatgctgtctcagggcagggagtggtttagagttatttctgattcagtcacttgtacccttatgttgaactaacatatattgagatcataaagataaagaatacttagttaagtacactgttcactgagtcctcctaaggtggctcacatgggccaagtcggggaatgtaatgggtttctgtacattttatcaaaatgccctgtctcttttctacctgatcctactggacaaaaggtgtaggtatgagtagaagacgattcaacaacaacaacaacaaaaaggcaaagttacaactcttggaaatagaggcaccaattttgtggaaagcaacaatcatagcacctggagagaaaataccttagactcctggagatatgaggaggggaaaacgttaatgatcttttttctttcagaactaccctggaagctccctcaaagaatacatcctggtttgactatcctaaactgttggaagtgcattaaattgtaaatgactgctgaatgtcattccttgccagttgcttctgaccatgatttgatagatattccacctcatcttagacatctattagaaacagtagaccatgatcctatttcttacatctccgtgtaaaatagctgttggactctctgagtatctaccccatctgcattaccacgacagtcactcggtcattccaaggatagacaaatgttgtccagtgagtgtctggataacacagggtagattgatggcctttaggcagtttttttttttttttaaatcaagcactaaatgtaattattctaacttaattggaaactctaaggtttaccagccagagagaggccatgttcactgtgccatcaactagtacttcctgagtgatgtaggtatactcggtagatctccaacataattaactttccctttagggacaccatatacatccctgcggctgtacttacgggaagccagaaattaagttgcttccctcccagaaacatggtaattgcacctaaggggtgatagcgtgatagtgaaagacttttaattgtttaagaaaacacgacagtagattatgtagccttcaaataaatgcttagatagctaaaaaatgaggttatgcttggttacttggtgcatttggctgaatgatgaccccccttccccaaatatatatccatattctgatacttagagcctgtgaatgccacattattttctgataaaacgggtcttggcagatgcttgagataaggatatcatttgtattatctatgtgagccctaaatgattaatgacaagggttcttataaaagagaggtggaaaaatattcgagagacagaaaggagaaggtaatgtgaccacagagacagagatagcggtgagtccactgcaagccaaagaaaaactggaactttcaaaagctggaagaggcaagaaacagattattccctagagcatgtggaggaagcattttcctaccaacaaattgactttggacttttgcttttaggaactgtaagataatacatttttgttgctttaagctgcaaaatatagcagccagagaaaatgaatacatttgagaaagcttcccagaaaataaatgactcataaatttcgtttcttacataaagttatctcaaagaaggaagtaatttaattagaaagttcatatgaaatttgttactggctttagcaaagtaattaatgacacaaccttggctcctggaggtattcaggtcatcccctactctctgggcaaagatgtcatggatgataggtttgctctaacttcctccttgcaaaccaagacagtggctagaaaattgctaatgcatcttgctgcaccaggagtgatgccttctgctaagtagaaagatcccaatataattaataaacctaagtagaaagccacttggctttctagggtagatactgatggtttctgggtttgttcaccagattggattctggaccctgaggtacatactaaaatcaatatggcaggaatcttgttgataatagtcttgattaaacactgaatggacaaactgaacaaatttggtcccagcttctgttttcagattaatcagagtggtcaatggaatagtgtactcatgggaaaagtcactggaagtcaagatggtacagcaacaaggtgggtttattgttaagagacaatttatccatgggcctttcatgtttctgaatgtcttacagacagaggcattggcttctttttttctgaaaaacttttcaggaatatttttagaacaaaatatttcataaaggagaaatagtttatccctttagactagaaaggatgttggtttaccattcagtataagaaaggtaaggtgtccttctgggaaaaggcttactgccattataaaatattcaagttctcgaaataagggatttttctcttgtaatgcccccgccaccccaccactgcatatgcaagtaccatctggccctctttgcactgtattgtggtgattgtggctcagcaaactggagcaaatgctactgttgtgagtaataaaattatttgtttctgatccaggagcctcttctgcaagcataaatgaaactgcggcaagctagcttgtaagcttgcaagtcaggtaaaattgaagttcctcagatccttcactgttcttgctaccgtacagcagtccaaaagggatgaacttcatttatgcatatcatatctcgttaagaaactgctaataaaaaaagtgattgaaaacatcaaaaggacaaattttttaaacctttttttctcttttttctgaaaatacaatttacatctgttagatataccattttgattaatataaatcttactaaatttagtccacttgggatgctattttttgcatgtttgtgtcctctccaaaattcaagttaaaatttaagccctaatgcaatagtattaagaggaggggcctttagaaggaaattaggccatgagggctctgccctcatagatgggattagtgccttataaatgagcgaagggagaactagttaggcctttttgctctttcatccttttcaccatgtgagtaaggacacaacattagtctcttccagaggatacatcaacaaggtaccatcttggaagcagagacaggaccctcaccagataccaaacctgccggtcccttggtcttagactttcagcctccagaactgtgagaaataaatttctgttctttataaattatctactttaaggtattttgtcatagcagcacaaatggactaagacatggagtgattaagtgttacggcagaagtatagagcaggttgttttctctggaattacatatgaggggccaagagcagttatgtggtggcgtgtgggagggaggaaagtgtcaattgctgaaagcttcctgactgttgttacaaaaattttacatattgtgacaccatatcttctggagatatacagaatctaatcagccatcatttaaaaatatataaaatttatgacaagaatgttaaaataatgtattatatactagagtaacaaacatattagttgagttccatcaagacatatagcaacaggaggtttgagggttagactgtcacatgaattatgaagtatccactataagactactcttttttgacttgaaatcacttatggttgtagacatggtagaggacatttcatcatggcagttaacacgtacaaaaactgcaccagagatttgttccttagcttttacaacctgccttaaatttctggcaagtatgcagcacaaatcattggaggtgttatcttcagaacttttatgagacttgtattaattttatattgcttctgtaacatattattactaattgagtggtttaaacaagagaaaattattaacagtattttatagttctgcaggtcagtagtaccacacaggcctcatgaagctcatatcaaacattagcagggctgaatttttttctgttgagtttcagggagaatccatttccatatgcattcaggttgttggcaaaattctgtttctgtgattataaaactgggtttcagctgagggacattcccagcttttagacacctacagtttttggcttgtgccatcctcctatttttaaagtcagaaaaagtggattgagtccttctcctgtcatatctttctaatccttcttctcttgttatatgtctctctgacccagccaggaaagcttcttccttctaaggatttatgtgattagattgggtcaaaccagaacatttcaaagtccatacccttaatcacatctgcaaaatctctgttgccatggaagataaatattcacaggttccagagattagagtgtgaacaaacaggaggaatgggtgtcctctgtttgtagtcctctgcatagcagaggactacataattgttccttggtggttttgtgtatgttactcacagaaagatttaaaattcagtacagaaataacaaaattgattgcatacataaggactgcttttatgttaaggaatattctatgaatatttggtattattaacatttactatacttgagagaatttagcttaattgagtaacagctcttctgaaaatattttatgccatttgttatgtgtaattattattataaattgaaattttagtcaggttatatactttactagagcacttaaatgaacttaatagtaaaaatatttatatgtttaatttgttagattcacaagtattatttaagtacttgagtagatttattagcgtacttaataagaaaaccagatgtgttcatatgtaaatgtagtttaaaattttagcaaatttatctaagtttttagaatgaatattaatcaaaagaccacttaaagtaagtgttactattttctagttttataaatagcacagtaatatttataaggtataaataagcatttaattaaaatatggagttttaagtttaataatttaaattaatagaataaaatgtaattttacatcaaaataaatacctgagtataattttctgtgcatagaatacacagacacacacacaaactgttaacaagttaacataaatatcatgtcttagatagttccccaaaattatgtaggaattagccaggcataggataggaaaggggaagaaggacaatggacaagtagtaaaattaagtgtcaaggaaagagaaaaattgatgtttttcaagtcaacgagccaacagaatgcctatgtaaagacatcaacatatgagaccataaggcaccctttagcttaagccattgggatctcctgtttttcagttaatattaacaatccattattgtgagaaatcataaaagggaaaacaaatcagtcataaattaaacatttcattttaatttcaaatatatgcacgtgtttattcaggactttgagtatgggatctacaagttaaaaattaatttaatttttttcataaattatacccacacttcataatctatgttcctcaattttgtttttgttttgaatggagctggagagtaaagataatcataagcttgaaatttcccctgtcttttatagttgtccatttcacttaaataactcacatttatcatttttctgaaacatttcatttagttttcatggaaataaggccttttctcacacatgtttcattaatttactcaatagttaattaaattgaaatagcaataagacacagctgcataaaaatttgaaaacaaaaattatatactattgacaaggatcaagctaaccagaaagggacctaagtattgatttgtaagtgaaataataattcacattgtagattccgttagaaagatttatagagggaatgaagaaccttagttgatatggcatacaggtaaggaggaggcacgtttctaaaataattccactgtatttggttataatgcagtgtagagtttggtggaaaaaaaaagagttcccaaattaggcaagaattagataattgaaggcctcatatgccataatattaataaataggatagattagccttagggaaatgtcttagcattacatgttttcttaccttttatcatcttgagttattgcatcatctagctcagggccttgcacacaatacatattaaacagttgctgtatggatttaagtgaggtggtactatcaggaaaactacttgaacagtgttccatggtgtttacgtaggacattttcttcatccggtctatcattgatggacatttaggttgattccatgtttttctattgtgaatagtgctgcaatgaacataagtgtgcattaaaaaaaagatcatgtttcttgcagggacatggatggagccattattcttagcaaactaacagaaacagaaaaccaaatgccacatgttctcacttataagtggtggctaactgatgagaacacatggacacatagagaggagtaacacactggggcctttcggagggtggaaggtagaaggagggagaggatcaggaaaaataactaatgggtactaggcttaatacctagtgatgaaataatctgtacaacaaaaccccctgtcatgtttacctatgcaacaaacctgcacttgcacccttgaacttaaaagttaaaaaaaaggacattgaacagtggatgagcacctcaaaaagagttaaattatactgaggaggccaggcgtggtggctcatgcctgtaatcccagcactttgggaggccaaggcaggcacattgcgaggtcaggtgatggagaccatcctggccaacatggtgaaaccccgtctctactaaaatacaaaaaattagctgggtgtggtggcgcatgcctgtagtcccagctacttgagaggctgaggcaagagaatggcttgaatctggcagacagaggttgcagcgagttgagatcacgccactgcattccagcctggtgacagagcaagactccattaaaataaataaataaataaataaataaataaaaataaaaataaataaataaatataaaaaatttatactgaggaaatttgggggcctattaaagttaataacagtgtgtaatttgttgtaactcactaatttgtgaacctttttttgttcaaacactcacacattattaaaataatctcttttcaaatgaaagaagtggtatgaagtttacaaattccacaatcactaatgcaattgaaataactgattcttttttacaagtcaatctcaaaattatccaaatcatcttctttcctattgatctaacctactcgggaggcttaggcagaagaataacttgaacccgggaggtccagattgcaacgaggcgagattgtgccactgcactccagcctgacgacagagcaagactccatgtcaaaaataaataaataaataaaagttttcttttatatcaaacaagccctaaatctctgtagcttaatcactctcagtactttgcatccaatacatctcatatgacatctcatcattatatcaaaataaaatatccattcatcacactggtttgaacatgtaaaagtcagtgaaagattggagagatgagggaagagcaaacatagaaaaatgaacaaagaacaaatctaaatgtcattaggctagttgaggtttttaatttagccaaggcgttatctcattagcaaggtgtctttataccctgaaaatgtcttcatttcctctttctttattttcttcattagaaacaaattactcagttggttctttacataaacagctaagacctgcagtaatcaagtcatagatttctcgtggtttgtaacatgaggacaggaagactaaaggactgctcaatttcatcatgaatagggtcccatagaaattatatggttttatttctaggaattttgaccactcactatatggtaaaatgttttgtcttttcagctgcaattcttgatcaaaaaaattttaaaatatcagttgtatagttcatttcaaacatgaccttagaagtaacctactgctgattacttaaagccaaatttatactcaaatatattttgtccccatgcatatcattatgttacagtgttggtatagtaataaataggatacttgttttaagttaatggaatatttttatcttagtactagttttgttatttttaattatatgtaagtttccagatacacttgatagcaccataatattttgaatttgttctattattcagaacaggaaaataactttttgataatatctccaagatcccttattatacactctagaagaatgttgatttccaattaaatgttatacaaaatcttgactgggagttctgcggattgccaaaatctccccactcccaccctgaactttcagctggtaatgctgcaagaaatacaaaccatcaaatcccactaaactttaaaaaatgttttacatcacagattgacctctattttccttttaaataatagcatttcttagccttcactccttatattctgggcataatttatatgcaaatagcctccttcttataaacctcgatctccctcaaatgagcttacagaagattgtaaatgtacttttggcttgctgacaacaaacatatttaggaaagaaagactgcaacttacaaaagcttccttataaaagctaaactgatttcaaggcttctaaactaatcagagagaattagcagggaggagggaaggatgatgagtgaggaatgtgcaaagtgttaaagaacatcatggtggtttgcttcctctcatggcctgacagcctcgatcagctaattaggaaacctttacccaaactagtgttaatttgttatttagcccccatgggaaattttcacagctagaagtcacttgtcttataatatgtagagatatttagtttgaaaacaaggagaatctagaaagatatgagaggatgaatggaggatatttgttatgaattatctattactttatgccatatcaacattgatgttaagaatgagaagagccattttgtgtgcagtatgccaacctgtgatcatttgacatataatgtgaatcatgggctgattaaatccatctcctatgctaagcatgaagcttaattatataaaaaatcacccaagtacaactggctgcttgggcctgactgacaggaacagtatttactgtcaggttccatctaggcctggccccttcatttcttaaagccttcatatatcagacagtgtgaatattagaccccatcttctgggatgggacttctcaaataataatagtgaagtactttgcttaatgatttacttacatttttgaaagctggctacaatgggcactgacagtggaaaaagcagtagcctgcttggaggactaatctttgatcattacacagagaatcatgatttatagagtagtattgatttttccacattaatcattttttatttctaggacaaaatgtcctttcacaaaatccaaatatttagagaacttcaatatattaaacagctccaaaaataaaatacttcattcaaatatatttaaaacttacagattttatttccttcaaattaaaagaaaaacctttagacaaaaacaattttaaaattcactttaatctttaaaaatattaacaataggtttaaaataacttgaagaatttcaggttagaataatggcaggaaaagctaatacatgttgcctacttattatatataaggcgttattctaagtacttagtaaatattaaatcatttaatccttacaacaaccacatgaggtaggtttattatctccataatgaaaattagaaaatagattctcaaaattttaaataacttgcccaaaatcatatataagtaggtgttagaaatttgtttcaagtatacaggctttaaaattcctccaaggtagtataacagacattgtatataattagcatgatcattcttcatgtgttcattgcgtttcctaagctctttgaatccatttattagcaatttatatagttcttgcagttactgctctaagcatgaaacatgccaaaaaataatcaactttagcagacactccactgttgaacaccatatccttcatcttagagtctgaagccatttgtaactgaggggctactctaattgcccttggcatttctctcatcctctgcttgttttgaataaactttggaacataggtgagtactcactttctgtttaggaaggcctgagatcatcatatatcaaaaagctagaaccctaagaaaaatcttaaataaatttttgctgaaatgttgtcaattcggacattgatttccaattactttttaaagaaaaaattcagtctttttcagtgtaagaattgaaagcaaagattttctggctaaaggtaaaaattatatttctataaaacataatacttttgcatttaatttttaaaatatcagcataataccctatctgcattcaaaatgagaaataaaggacattaatttataacacaataataattctttagtttaatttctacaacatgattatgctagaaaacctgatatagttgttaaatggttgtactgagaaggaaaatccatactaacataacaggtacagatatgcactgtcacctattgcattgtatttaaactcaattatctcaaatataatgtgctgtgatgctgggggtgatttatttttcaaaaatagtgaagaactattggtaactttctgaacaaactaagtacaattttatctcaagaatacaacctgaatgaaataaattgtaaattcattgtgtaataaagacaggtaaaattttccttatcttcatcttctaatcagagctatattctagacacaggtaacagatttttatatacatgaatcaatgacaagacagttaaaagttgtaaggtatacaagaaaacactttcatgagggtatgactgttgggtttgttgcagtttttatagcagctctagcttctgctttctaaaagcaagtatcatcccttccccaatcatttcacaaatgaaaataaacctgaaaatctttaggattactacagatctatagtaacacgagtaaaggcagaggaaatgagtagaggtgcaagttggttggctaaggtgtggagaggagctagtaggatcaattctattttccaactgtgagaatggggaggacatattggaagttgaggaggaaagaaaatctctgagtaagtggctgtaatgaattaaagaaatattgtcttaaatactacaacaactgaataccactgtgtgaagaccacagcatttgtttaagaaactttgaggctttctgtttatatatatcttacagtgtttttgtttgtttgtttgaaatgtgtaagctttgatttaaaccgtttacttcaatatattaatgatatagtaaaaatatgtattgaaaggcaaattagtgtattttaatgttatacctgtcatttttttttcctagaatatattctttgcatctaactgccagtgccattgtcaaaacttattttttaaattgttgtacatttcttattaaactaagggcttaattttaaagtattatgttgcgatcatatagtgtataaaatgtataattgccaattgattgtaactattatttatttttaaataaaagtataagaatgctttctgattcaagaaatttgttatcaaactgtttctttatcctcttttctgatgtagcataaaagttgtccctgtttgagctgtaactgccagtagatgaccagtcacaagtgaaccacttcccagttgccagtctttgctcatatcaaacactacttacaaatgcttagtttttgtatctaatctctcattattaaaatggttataaagtttatttttaccaaagaggatgctattcattatgacaaagtattgcataataactttgttttataacaaaaaaaggaaatgttgtaagattgttgagaagagttataggctcagataatgctagcgatccaaaaattgagatcagtcttatgactttataacttcttgcttgccaaattacctacatgaggtggaattaaccagacttgagcaatctgagcttgagaagaggagcgtttaatgaaagaactatttttaaaagtctaaaggaggaaaaccataagggagagtgagaacagggcatcatttttttctcctaatcttgaagggggcaagaggaggaatgtacagattgggaaaaaactgtgtgaagaagccgcctgatagaagtgttgatctagaaaatgctaacccatagtagcttcacagggagaatgcttgaggaataaatataccaaacccactcttctctctctttctctcagatcttctataactgagtcccattgactgcatccaatcagaggatagtacaagaaaattgttgatgtagcctgtgttaatcactatctgggacacagaacagaatggagaagcatagagagtaaatttgaagatgtgggagatgagggtcagattatgggacacatgggcttctcagtagataagaattcaggttatgagagatgacccaggagcctaggattttgtgtgacctgcataaacaggggaagaagggtctgataggattagtctaaatggtcttgataagttttgatggggtaactgtgaatgtaagagttgagaggaaataggaatagcaaactctccaaggatcatatgaacctctagggccctcaatttgttatactttgtgtatactttacatatatttagttccacaaaatttttgactaattttaaatgtaaaaagtgcatttaatacttaaggaacattttaataataaaaataaaatctgtatttatcacattttaataagttgtgctatgttccatgtacattatatgaactaatcatttgatacttcacacaaaaccatataaagtgtgaaattctatcattcccattttatagtcattgaaattgaggcaaaaagagattaagtaacttgccatgcttacacaggaagttaatgacagaatgtaaacccaccttatattgactattaaaagcctaacaaacatgcaagaaagaattatattaattatcagttatgaaaatgataatattagtaaggaaaacattctgaattataaaatattttaagagtaatttcaaaaattacattttaaaataatacatgtcacctaagacattaatagatttatgtaatttaatgagttaactcattaaaatattaaatcaacctataaaagtaatacactaaggtggttatgtgtacaagatacagaattgaattccctggagttaagtccctgtcaaggaggccttggaaaatcttctctaacttccagaattctcggctgcggagtggaaatgctaatacagtagaatcaaacctaaggtgttgctatgagaaataaatgagaaatgtaatgtaatactcttaagagactgtttggcccctagaaactgctcaatgcatgttgtaattagtaatttattgtaattcaaaccattaggagtttggactggagatgtactggagaaaatgacaatgagtcaggagtttatatcttcaaggactgaggggaaacttataataataatcttgtcacaagtgtactctccctttaataattatttgctaaacccaccagtttgaacatagaattgctattggagctaaacagaattttaatgaatatcaaacatagcattttctaaattagttgggtctttgttaatgaaaattttgtgtgatcagtttgtgatcagtttgttatcaagtctaattgaattagatcatgatcttttggaggatggtgagattactgaacaattgtcagagaagatcatcacggcaacttagaaaagaaaaagttataagtaattcatttaaaagtggtttagagttgcttactatgtaatatatatacatatatgtatatacattatttatgtatattttttcaaagcttgagacttagtaaaaataaaatagtcttctatagcagtaaaattgcctattttcaaattgaagttctaggagaagattaattttattaaaacttccacttaataggaaatcacatgtgaaatattcagtttctttatttagggaacactttattaatgcttccaacttattcccaaaacatgtagaccttaatgtagacagtaatgttacttggccttacctacctatgatcagaccattttcagtgacttctagatcacaggctccatgataatggtccttgatttctctttctctcctcagtggtagatgttgtcaaggcttgagcgtcattactccctgacgtttcaagagccaaatcgctttttattttaattgtaatttaaatctacttacaagtgtacagaatgaataatcaaaagaactcaatggattaggataatgttttttgttccagaagcctctcttattaacattttgccttttgtattaacatctgattttgcattgccatctgagttcccatttttatgtaaataatggctgacctctggcactcaatgtgttattaaaaatgcactcttggaagcacatgtatttactaattagaaccactcagaggctttgcaggaacagtaaagaatagcatttgtgacaattaagttttaccacctcttactgttgctgaaattttaaaatgttatttgttcaaccaaagtctatttttcaaaatgatgtttaaaacatattttgccaaagatgcttggaaaataacttagtgaaatattactctgtggagctaaaagattctgggcgcaataaatctaatataaattttaaatatggcatttttctactaatgtttatatgtagaagaacttagacattgttgctgtgtggaaggcttaaattttattcctatcaataacatcagtgaaaattaatctgcaaagtagatcttgtaaggtcattcttcagaagtttctaattccaatttattttgaattgatttttgctttaaaatattttttaaatcacattttttttaaattttgagccccacagaaaaaattacattattactctatttacttctgtatttgaacagattaaatattaacaagttggaatttctctaacttttatagatcatgccttgtgttattgagaatacaatgtcttagggcatcttattattttaatgatttaggtagagtgaactacttttaaaattcacggggtaatgttaataaccatttatgggtttttaaaatagatgcttaaaacatttagatttgttctctctctcgtctgatcaaataaacaattcagttcattataattactcttacattcggacatgtatgtgtgtgagagtgtgtgtaacagtattaaaatgttagcaaattatatatttataattaaaatgtaacatattctcagatgtgaaaaaacagaaaacacagaagattttaaaggaaaagttgcccacaaacccaccacacagacataactgcttttaacaatttgttacataatcttccacactttcttctgtttataattttgtgtgtctatatacccaatgcctccatctcaaaaaataagatcaaacttccactttttataatctggttgttttgaaccaacattatatggtgactatttcatgagttaataaagaattgttattatctttatgatgacaacgttgctttatattatgttgagatttcataatttatttaaccaagcctttctcaattgacatgttagttgatgttgctatttttacgccataaataataatgtgaaaaatattttttgtacatctttgcacttttccgattatttttctttgcataaatcactggaggtgaaattgctaggtcaaagtgtatgcacatttttaatttttatgcatattggctttcagtaaggtcgagcaaattttcacactggtcaatagtatatgacggtggttatttccatatgccctcactaatcaaagtgggttaaagtgtcaatgaggagaaatggtatctctagcttgcctttaataaacattactgatgattgcatgaatcttttcatatgtacagtgaactgactttttaaaaattacatttatatttagtacatttttctgttatttttctcaatattttttatagtagtagttatttgacatgggaactttaacatttttatgaaatactaagtaaattaatttctaaattttggaatacaaatgactatgctcatcattattttcagggagtaattttatccttttatttactgcttcagcttacattcaagaaacaatagatccctcttccacaaataatttagccttgtattacactactctctacaacaaaggaaaattatcctaatctgtatgtaaaataattacggtagaaataaggtactttaatatttccccaggactagaaacctcccttaccactttaaatgaaactttttctcttcttcccattcccaagatctcttcgatatgaatactgattgggcacaggcagctccaacccatgtatatttcatagacatattttgtatttcttgagaaatattaaaccaatagctactgagaagttattgcgcctttgctcctaagaatattttataatattctggtacaactttcttccttaaataaaagataattaaagccattggaatattattattgtacttatacccaaacttttattgatttaaactgaaaagcagagaaggtatttcctacatataaggtaagtgaatgctgttgtctaagaacaagagatttttaaataatgaccattattttaaatgtattcgtgaattttttaaaaaatataattttaaagtaaatattaaaatgcaagatgtaaaagaaactgcagcaaggaacagggagatttttcccagaaagattactgactttatatggataatactcaggcaaacctcgatcaaggaagaaataataaaataagatcatatagttctgctcaaccattttcatgtaatttaattgaaatcacataattcttacatttctgatttcttcaatatgtaaatgagaaaacttgtgattgaatcaggcacaataaggcagattcataggaactgtcaatcaagtgcaaacatataataaaaacttatttagacatcctaaaactcaaaaaaaaaaaaaaaagaaaaccctcacatctataatttcttacaaaacctatggtaagcgtacttctggaattgaaggaataaaccaagtaaaagaaaatcataggaagtaagaaacagaaaactcaacagagaaaaatggtgatgtcgtatcctaagatgatacagatgccacagaccctgagaatagtcaggtcagaatggaggggaagaaagaagaatggcaagggaggataaaaaggtgaaactggtagactatctgacggagtttccctttgagaaacagtagatatccaagacagcatgtggaaacgaagtaacagcaagtctacagacaactaaacaatttaaaaaataaaataacccataacttctagaaaaatgcaaatacataaaaaaggaaatataattatatataatacatttacttggtccttcagtgaacatttattatggatcattttaaaaaacataattgctggtttaattaaatagcaagacaattatattgagagaatgagaaaagggagaaatcaaggtatggggcttagggtaggggtcaaaagtaagtcctcacccatcataacaactggtaaatagaaatgttacaactagtaaataaaaaacagcaatagaccataatatttagaaacataacataaatagtacaagaaatatctggaagaattaaaaacaatcaactatacggagcagaatgtaacaaaaaatgggttggagcataactgtttgctcttatgaagctttttatagtatctgataattaaaaatcttatctatgcatgatcttaataaaaataattaattaagataattttttcaaaagaaaagattttaaacattatctcaatatatcaaatatcacaagtttgctgctgttcaactattttaatgctgtgtgtatttgtaagaaatgttccactgacatgtaaaattggctaatgcaagtattattcttatgccaaatattaatgttttctgattttttttcctgttagcctttaaaaccccaattcccataactagcagtttattagttcattcttttccccatcatttttatcttaaggcagttttgaaggtaatgtgattttaagcttctagaaaaactaattacagaagagatggcatggcttcaaaaagatgttgcccagcactcacatcacaaaaccagctttgttttccttagcaccagcagctattattatctttttctcctattttgactgtcttttactttttccttttaaactgagttaatcaaagtcaaggtgctctcacttgctatataaagccatatagtacaaatctaagaacaattatttacaaccctgagaagcacatcaatcaagaagtgtgcagaaagagaagacaatgtaattagacaatagatctattaccttattgttgaaaaaataaaagtaaatcatcctatttttttctatttgtgctgtgtttaaatatgttaatataagaaataatattttcttttacaagataatgttaaatcatcttttgcaaaaatagacaaaatagaacaaattggtgacattccttataaaaggaaataaacaaaaggaccatagtatttttgtgtgtgaaatataataaagctttgctgatggtaattggaattgagatgttgaaacttttagattaaaaaaattgcatgtttgtaaatatatttttttagaaaattttaaattattaaagattaaaatgaaagatagtgggccaggtgcagtggctcatgcctgttatcccagtgctttgggtggccaagacaggcagatctcttgaggtcaggaatttgagaccagcctggccaacatagtgaaaccctgtctctactaaaaacacaaaattagccagatgtgatggtgcactcctgtaatcccagctactcaggaagctgaggcaggagaatcacttgaagccaggaggcagaggttgcggtgagctgagattgcaccattgcactccagcctggacaaaaagagtgaaactctgtcaaaaaagaaaaaaaaaaaaagatagtgaatacaatattaaaaatcaacaaaagatgagtcagtacattaaaaaattcagttttttgatcaagtaaaaaggttatcttagatttctaatattgttacagtatatacagcacagctccaggcagaatgatagacaagattaccttgaatcctttacaggcatatgattctaaagcatttgagcacagatagttgagctgaaacaacatctgtataaatgagctgcttgcttttgtgattattgaacgtaagatttttattatatgaataagattaatggattgatttatcaaagcatagcagtataactgcttcagattaaactagcttgtatagtattcactacagaaagaggaatgctctaaatctacttacaagtcagcattactaacctaaatctaaattattcattacactcaatgttaactttcggatggtctctaagaatatttgaaataagctttttacagaaactaatttttttccaacgtgagtcttaatttcaagaatttttaaacaattgtgacttcaagcatcacattattattttaagctaataaaaattaaatattttattgaaagaacatgtgtgctattcaaggttttaaaaaacatctatagattcaattctggcatccatgtgaataattagttaagttgcattttaattcttggcccacctctctgtcactcttaattccaaatatttaataaatatttttactttgatgcaaaattatgttatcaaatttactttaagtacttttgcatataagcctttctactctgttttctgatttctaaccttgggccaaatcctattaacctattctttaagtatttcaacaacatctttgccttcaaatccccctcttgttttccattctgcttatcacaactacatttatcttattaaagatttttctgatcatgttgcctgtgatagtaaattttgtttcaacttggttgggccatgggggcaaaatatttgattaatattattctgaatgtctctgtagtgatgtttggattagattaacatttaaatcagcaaacactgagtagagcagattaccctccatcatttgggtggggttcatccaaacagttgaaggccttcatagtacaaagagtggcctctgctgagtgagagaaaatccttccaggtgactgcctttaacttaaactttaactcttccctcagtcacttagcttttgtgtcagtggaagacagggatgttgttcagagcttgtgtcaggcccttatacctgaatcaaagtgcaggcccttaggattttataacaaagccccaccatcctcagcagattactattctccttttgaaaaacagtttttggcctgctactgggcctcagtagaaactaagttcttagacatgggccaccaagattccatgtgacatgagcagcccatcatgaactgctattatctgactccaataagtcataatattgggcatgcatagaagtatgacatcatcaaatggaagtgagaatataaaatctggcccaagcttgtactgaaggcacaagtagttacatgaacaagtggcccaatgctcatgaatcccatttctgctacactggcttctctctcccagcttacacctatggcctcatgaggagttccccatgatctgttgacagatgaagagaagagtcaggcttgaattacagatggttctgtacaatattttagggatcacatgaaagtggacaacagtagtagtgccctttcttagacattcctagacgtcaatggagaaggaaaattctccctgtaggcagaacttcaatcaatgcacctaatgttcattttgcttaaaggaagaaatggtcacatgtgttattatatactgattcatgggctgtaactaatggtttgactagataatcagaggcttggaaagagcatgactgaaaaattggtgacaagaaagtctggagaagaggtatgtaggtagatctctataaatgggcaaaaggcataaagatatttgtgtgctatgtgaatacttaccaagagttacttcaacaaaggaagactttaataatcaaatggataggatgacttgtttttttggatactagtccacctcatccccccaccaccctttgtccaatgggacaataaacaaagtagccatggtagcatggatagaggttatgcatgggctcagcaacacaagcttccactcatcaaggtttacctggttacagccaccgctttgtgcccagtcagctaacaacagagaccagcacggaaccccagtatggctccattcttcaggatgatcagccagctacctagtggcaagttaattacattgaaccactttgatcatgaaaaagggagtgttttgtacttactggaatagacaccctgaatatggatttgccttccctgcatgcaatgtttctgccaaaactaccattagtggactcacagatgccttatccaccatatggtattccactcagcattaattctgaccaaagaacttatttcacagcaaatgggatgtgacaatgggccattctaatggaatttaccatcctgaagcagctggtgatagtacaatgatatgattttctgaagactcagttacagtacctgctaggtactgtatagtacaatgaaatgattttctgaagactcagttacagtacctgctaggtagcaattccttacagaacttgaagaatcttcttgaggaggctgtatatgctctgaatcagtgtctaataaatggtgccatttctcccatagccagaattcatgggcccagaaatcaagagggtggaaatggaagtggcattacttgctatttcccctaatgactcaccagcaacatttctgcttcctgtttatataaacttatgttctgctggtctagaggctttacttccaaagggatgaattcttcataaaggggcacaataatgatttcattgaattagaagttgagactgccaccaggccccatcagggcttctcacacctctaaattaacaggaaagaaagagttgctattcttccaggagtgattgatcctgactaccaatgagaatttggactgctattccacagtgaaggtaaggaagaggatgtctggaaaacaggagattccttacggcatgatttaatatgaccttacctgtgactaaagtcaatggacaactaaaacaactaagtccagtcaggaatactaacaacctagatccttcaggaattaaggtttgggtcatcccaccaggtgaagaaccacaaccaactgaggtgcttgataaacgtgaaggaactaatgcattgtggaataagattgttaggaataccagctagagccttgtgatagctgtattacagaaaagagggctataataattatgagtatttcttccttattttgttataaaaataataaaattttgagattaagtatatttaaagaaatatgtatgagtgccaagttgacaaaaggtggacttgtgacgattaatttttgtgtcaacttggctgcacacgaatgcccagatatttagtcaaacattattctggatatttctgtgaaggtgtttctagatcagattaacatttacatcagtggactttgaagtagactaccctccataatgtggttgggccttatctaatcagctgaaggatttaatagtaaaaagattgatttctgctgatcaagaaggaattctgacactggactgccttttgactcaaactgcaattcttcctggttttccagcttgctagcctatcccatcaggttttggactaaccactcctgcaaaattgtgtgagcaaattcttaaaaaccaaacaaaacatcctgctggttctgtttctctggaaaatactgaataatttatcatcccaacaattaaacatttaaaaatcttcatatttgtaacacatacagtttgatgtctctatccagttactgcataccttctgtaatatgaaacaatgctatgtttttattctcgtttgttgtttctgtcctgaatcttattatgcagtcagtatactaccatcaatctctaagtatatattatgattctacttccatgaattgataaaggaagtttctctaactgaattttgccccttcctactccatcctagcatataatacacaaatctatttttcaaggccaaattaaaaagctgtgtatttcagtttcctagatagtgtcaggttacaaaactgtgtttgaaactgtatttctggtttaaagatagagcacttagccttcttaaggaaacccaaagcaaaacagagatgagttttacaaatatgttcagaacagatctcaaaacaagaaagggtactatgtgtaactcaaaagttggtattggagaagaagcagaccgaaaatcgtagcggttgctcctcctgaaaacctctgctattactgccaactttcccaaactagatgctttgttcctgcaattgccacaatgtaatgaagagaaaatagtttttcaacaaatggtgttggaataattgaatgtccacatgcaaaaaaaaaaaatctagacacagaccttacacccttcataaatatgaactcaaagtggatgaaagacctaaatgtaaaacacaaaaatacaaaatttataaataatagataacatggagaaaatctaggcgaacttgggtttggtaatgactttttagatacaacaccaaaggcatgatccatgagagaaagaattggtaacctggacttcattgaaatagaaaaagtctgcgttgcaaaagggactgtcaagagaatgaaaacaaaacaagccactgactgagagaaaatatttctaaaagacaagtctgataaatataccaagaacacttacaactcaacaataagaaaaaagacagcttgtttaaaatataggccaaagatcttaacaagatacctcacccaagaagatatacagatggtaaataaacatatgaaaagatactccttatcacatgtcatcaggaaaattcaaattaaaacaacaataaggtaaaactacacacctattggaaaggccaaaattaggaacactaacaccaccaaatgctggtgaggatgtgaaggagcaggaactctcattcattgctggtgggaatgcaaattagtacaactactttggaagacaattttgcagattattacgaaactaaacatactcttaccatatgattcaacagttgtggtcctttatatttacccaaaagagttgaaaacttatatctacacacaagtgtttacagcagattttttttttaaatgggcaaagcttggaagcaaccaagatgtcctttggtaggtaaatggataaatatactgcagtacatacaggcaatgagcctttttcagtcctaaaaagaagtgagctattaagccatgaaaatacatggaggaaacttaaatgcataatactaagtgaaataagccaatttgaaaagtcagcatgctttgtgatgctaactgtacgacattctggaaaaggcaaaactatggagatagtaaaaagattagtggtttccaatggttagaggcagacagggataaataggagaagtacagattttcaaggtagtgaaagtgctgtatataatattataatggaagatataggtcattatatatttggccaaacccaagaatattctattccatgagttaaccctattgtaactatggattttacgtgataattatcttcattcattcattcattcaggctgctataacaaaatagtatacattgggcagcttataaacaaccaaaatttatttttacggaggctggatagttcacagccaaggtgatgacagattttatgtctggtgatggtcgccttttggttcataaatgatgccttctcactgtagtcacatggtagtttagaaactagccttttaggatctcttttataacagcattaatcccaatcaagagggctctgccttcatgacctaatcaaatcccaaaggccctacttcccaattccatcaccttgggggattaggatttcagcatatgaatattgggaggacataagccttagtctattgcataataatgtgtggattcatcagttgtacaaaatggaccactctagtggggaagttgatgatatgggaaatgagtgagagcaatcgatgtataaaaaaactctataattatctcctaatatttttgcttaagcaaaacctaaagatgctttaaaaacataacgtctttacagaaaaaaatgtgtgggggtttctgagagataacgaaggaaatttccttggtggaaaataaaaagaaagcaagaagagacagtaacaaatatatattattattgttagaccttagaagagacaaatatcatttccaataaagattacagaaagcaactaacaattgaagaaactggaagatcaatgtaaaaaaaaaataccattcaagagaatattatcacaattaaattatcccacataaaaaagtttagaaaaactttaagaaatatggtaaattataggatgtatttaatatgaaacttcatagaaacaaatagaggtaatgagtaaaaacaatgttggaagtaataacagctcttactttctcagaactgaagaagaagtggaatgctcagattcgtgtttaaaaccatgcttaatgctagggttacagagatagataagctagactacattgagcatttttcctttagctggggaggagtgcatgtggaaggcatcccttcataaatattaattcctcaaattgccatctactgtcagcttccttctccaggctctgatctcgcttttactgtacgtacaatttttactccagatccaacctacttttatttacttgttacaatattatcctcacactaacaaatttatttttggtagagttctcaactgcttgtaaaatgaatgcatgaataaataaataatagaaagagtaaatgtaacatttggtaatcctgttttttttattattatactttaagttctagggtatatgtacacaacatgcaggtttgttacatatgtatacatgtgccatgttggtgtgctgcacctgttaactcgtcattattattatttttctttttttgagacagtgcctcactctgttgcccaggttggagtgcagtggcgcaatctcggctcactgcaagctccacctcctgggttcacaccattctcctgccgcagcctccgaagtagctgggactacaggctccagccaccacgcccggctaatttttttgtattttttagtggagacggggtttcaccatgttagccaggttggtctcgatctcctgacctcgtgatctgcccgcctcagcctcccaaagtgctgggattacaggcgtgagccacggcgcccggccaacttgtcatttacattaggtatatctcctaatgctatccttctccctttcccccaccccatgacatgccccagtgtgtgatgttccccatcctgtgtccaggtgttctcattgttcaattcccacctatgagtgagaaggtgcagtgtttggttttctgtccttgtgatagtttgctcagaatgatggtttccagcttcatccatgtccttacaaaggacatgaactcatccttttttatggctgcatagtattccatggcgtatatgtgccacattttcttaatccagtctatcattgatagacatttgggttggttccaagtctttgctattgtgaatagtgccacaataaacatacatgtgcatgtgtctttataatagcatgatttataatctttgggtatatgtccagtaaagggatggctgggtcaaatggtatttccagttctagatccttgaggaatcgccacactgtcttccacaacagctgaactagtttacagtcccaccaacagtgtaaaagcgttcttatttctccacatcctctccagcacctgttgtttcctgactttttaatgatcaccattctaactggtgtgagatggtatctcattgtggttttgatttgcatttctctgatggccagtgatgataagcattttttgtgtcttttggctacataaatgtcttcttttgagaagtgtccgttcatatccttcacccactttttgatggggttgtttgattttttcttgtaaatttgtttgagttctttgtagattctggatattagccctttgtcagatgggtagattgtaaaaattttctcccattctgtaggtttcctgttcactctgatggtagtttcttttgctgtgaagaaactatttagtttaattagatcccatttgtcaattttggcttttgttgccattgcttttggtgttttagatatgaagtccttgcccatgcctatgtcctgaatcatattgcctaggttttcatctagggtttttatggttttaggtctaacatttaaagtctttaatccgtcttgaattaatttttgtataaggtgtaaggaagggatccagtttcagctttctacatatggctagccagttttcccagcaccatttattaaatagggaatcctttccccattgcttgtttttgtcaagtttgtcaaagtttgtcaaagttttgtcaagtttgtcacagatcagattgttgtagatgtgtggttatttctgagagctctgttctgttccattggcctatgtctctgttttggtaccactaccatgctgttttggttactgtagccttgtagtatagtttgaagtcaggtagcttgatgcctccagctttattctttggcttaggattgtcttggcaatgcaggctcttttttggtgccatatgaactttaaagtagttttttccaattctgtgaagaaagtcattggtagcttgatggggatggcattgaatctataaattaccttggacagtatggccattttcacgatattgattcttcctatccatgagcatagaatgttcttccatttgtttgtctcctcttttatttcattgagcagtggtttgtagttctccttgaagaggtccttcacgtcccttgtaagttggatccctaggtattttattctccttgaagcaattgtgaacgtgagttcactcatgatttggctctctgtttgtctgttattggtgtataggaatgcttgtggtttttgcacattgattttgtatcctgagactttgctgaagttacttatcagcttaaggagattttgggctgagacgatggggttttctagaaatacaatcatgtcgtctgcaaatagggacaatttaacttcctcttttcctaattgaataccctttatttctttctcctgtctgattgccctggccagaacttccaacactatgttgaataggaatggtgagagagggcatccctatcttgtgccagttttcaaagggaatgcttccagtttttgcccattcagtatgatattggctgtgggtttgttataaatagctcttattattttgagatatgtcccatcaatacctagtttattgagagtttttaagaaaataagggatattttagtcatcaaatgcagttttgaactgaaaggaagacaagtattctaagagatggtaaaaacctcactggctcatctcacattctaaaccattgagccaataatagtgtactatacatagatatagcccgattacaattttgtaatttgtcctgaaaactacacccattcaaatgttcatacacgcacacacacagacacgcacacatacacagacacgcacacatacacacacatatggaaattaatgggttaaatagtttgtgtcctaagcatttctctttttattctctctgtatttactctacctttaagcaaagcaaattattgatctatattttattatagaacaatataatactaaggttgaaagagtctttaaaatgattttaatgtctcatctttggcattcatcaggaagtagacttaggtttccctcataactgtgtattgtttatgaaggtaatgtatactttatgaacaagagataatccaacaattgggtaggataagattttctgctgtaatataccttcaaattcttgtacagataaaagttggatgatataaaccagatgcatcatttttctctctcttcttttttctttaagtttctaaagagtgagaaagcagatatagtttaccttttaaaagttatatccagattctctatcagtgagataaatattatatttgacctttcaattatcatgatatgctgttctaagactaaacatgaatatttaaaaactggaagttattgaatgcacttttactctttcatcaattactacacatatattcctataagaatataaagatgaatgaaataactttcctgtctccaagttctccagatctagagtgtgaatcagatttgaacatacatatgtatatgtacattggagtttcaaaggggagtctcatagaaatacaagttaaatgttgtagtaaggatagtttaaaatatcaactagggtatcgtggtggatatacttaacagaaagctcatcaaattgaaaaggaggggctgaggagggattacattccagctagaagaatgagcatataaagtgtgcagaggcaaggattatcataagagttacaaaaattacaaacgtttaagagctctagaaaacaaaatttgcatataactgtgacatgattgggttgtacccaggtcatcataggccttatatgccaggggtttggattttatgttagagagataatggaaactattacacatatttgaacagcaagatcatctagttgatcttttaataaaatcattatggtggtacaatagaggcacagttttcaactattttggatgagtatcttttttatgttaaaatatgttgtgataatgttgcagtgtttcagaattgggaaatgttgcagtattttagagttggttggaaggcctgaagccatttagagcagcttctcaaaatttaatgtgcatatggatgacctaagcatcttgttaaatggctttttgcacatttttcacaagctccagctgaacatattgagtattagtatattgctctttgtacagccaaattaaaaagtccagttactagttataattactgttctccaattctggagagagattttagtaattctcaggctaaatcatcgtatttatctcgtatgataaaaataaaaaaatccaaagcctgaatctgatagattatcctccaacactgctactaccaatttcatgtaaatctcagaattttcaagatacttctgcctgatgtttttcacagttatagactagaattcaagcacattaaatgtgtactactgggagaaattttccatagttttggagttcaaaatgtttaaaatatttttaaaaatctgtatgcattttactttctcacctgtattgcataactttaatgagaatttcagcataatctttccaaatccctagtatctttcttacttttatctctcaagacaagtcaaaagtagcatctagctattgctatttacactgatatgtaaatttggtcatacatattttataaagacatgtaaatggctcagctgaagcatattcacctgtttatcccttggatagatgtgtgtacccctcttaagagcacaacaatggcagacacctgcttagcataagcagcttattaaaatgcagtaaggagaagaatacctttgtgagcaattttcttatagtattaataatcccgatggaaaaacaatggaacacagatatgagtcttttcaccagtgaaccatctagactttttcagctgtgtgagctaatacaaaaggcttaatggtttcagggaggttaatgcccactgaaagagttcacattacaagaaaaaggaaaaaggcaaggagaatgaaagatttctctttgacgtgaaaaaagaaatctgtggaaaacaatatagaattctcatttgagccctacctgaatgttagcaactgataatatcatttttgaaactgatgtaaatgtattttttgtaaaaattatatgatctttttgtatttatctcactggattctgatcagaaacaaatgagaagaactaaattaaaaaaaaaaactgatgcctatgtaaattcagatcttattctctgtagttgctgatagtttaattgtgagttaaattagtgtttccaaaatttaaagatattaaaaatgtgatgacaagagttatgtttttctatatgtcttcaaataatttttcagaaatgtaatatagatgttttacattaaaaattgctagtgctaatcactaaagtcaagaattttgttactttatattttaactataatattaattagtaatatattttccttttggcatgtatatagacagaggtagaagaaggaattttcaaaaaaatttccagtccagcaatctgctctgtttatagcaaatttaatatgagtttgataagagttttatttcaataattgtatgtctatctgaaaattaagcatcaaagataaaactttttttattttcttgtcatcttccatgagtgaatcttcataggctgctacccctagagatcatgtgtgtatcagaaaaaaaaatagtgaaaagctttgaaatgaagacatgattactgggtatctttttcctggaatgctgtgttgctcatggagagttgggggtacctgattttataggggtttgtgaatttcattgtttttagaggcctactatgcaacattgtatggaaagtaatgtagaaggctgatggtgatgccaaccttttcttgttcacagagatgaaaattaattatgtctaatggaaatgtgattgatttctcccataccaacccactgtgctggaacaaacaatttcaaacattacattttactttctttttatattgaatagttttgcatatatttgacaatttatttcagcattcttgattctttatggtaaatacagttatctagacacacaaaaaatgcattctttggaatctcttgaatcagttttatcatcttgctggttcccttatcagttactcagtaaaataaaatctttgactcacttatattttgtactaatatataagtcatgattttaccttttaaaacacatagcttttaacacttgttgatataaaaataaaatctcttatcactagacatggtaaatcttccaaatgtttagaacatgaaggtctagatgagaatatattacgcataataaaacattcaaataggccctgtgcagtggttgatgcctgtaatcccagcactttgggaggctggggtgggcagatcacttgaggccaggagtttgagaccagtctggccagaatggtgaaactctgtctctactaaagatacaaacattagtcaagtatggtggcaggcacctgtagtcttagagacttgggagagcttacagaatggttagaatctgggagaggtggaggttgtagtgaggcgacattgtaccattgcattccagcctgggtgatagaacaaggttctgtctcaaaaaaaaaaaaaaaaaattaaaacagccattcatattttcaagtcgaaatgaggatttcaggcaagtagagaaaattcttttgctatgaataccattgaattattaagtaacatagttcttaaagcaagttatattagaaagtcaatttggcaaattataattttttgcattccccatcaacggctataactaccaaatctatttttttaatgttcagaaaattccatgtcaatatttgcttttgtttatcatgctgcagaattattcatttattttatgtgaatagcctccaattttaaaatatgctatatgcctctttagttttctttgcaacaaagaggagtcattatatgcatcatttatgttaactgaagtatttaggaaatttaatatatgattcaggaagcttagaatcatacactagactagatgcagagctttgcaacttatgtattgtaaatgggttacatttttaatgctaatgtaatgacacagcaaagagggagaaatttatgattcagactagaaagaaaataagacctctttctcaagctttgatgcaaagaccttgaaaaagaataaaggagtaggttctggagcataagggatggtttagatttggataggagcataaacacctaatttattggatgtggttgaaaaaaatataaattaacaaatatgatagtgggcagttcttttctttttttttttctctccttctcctccttctccttcttcttcttctttttttttttttttttttcttttttttgacaagaactcactttgttgctcaggctggaatacagaggcataatgacggctcatggcagcagccttgacctccaagactcaagtaatcatcccatctcagtctcctgagtagctgggactgctggtgaatgccaatatgcttgatcattttataatatttttgtagagacaggagtctcacaatattgcccaggctggactcaaacttcctgtctcaagcaatcctcccacctcggcctcccaaaatgctggaattacaggcgtgaactacctcgtctggccagtgggcagttcttaaacaattatatcaattttctctccaaagtatgaggtaaggtcaccagatgaaattgagacattattattctagctttagaatgaagatggtacttggaataaaagggaatgatatggaggagtggaaatatatacaaaatttttaaggaaattacaagctgtctaatgtagttaaacagctagaaatatgtattagaaatgtgaagagggggaaacaataatcacctgaagccaaatggcaagggtcttaaatactatttattgattaggaacatatttgtaggtggtgaagaaatgttaaactttttaataagttgattaagcttgtgagtgcagttaaaagatttattcaatggctgagtgagagacaattagaaacaaaagacaataaaggccaataaagtggttaagaagcatttgtagttacacatgtttcaggccatcaaaggctgaattaaagtagtataggtagaaaaagaaagatgagaacaggaaaaaaaaattacagaaattgggggaatcttttttaagatcctcaaaagaaacataaaacctctgtatagtagtttatccaaagaaatatttactgtcggtaagctgtcacctacagtatagtaaatgaaaggagtttatattctttgtttatattctttcttactaaaagaagtctaggctagatataatttcactaatgccacttaatctctgtattttatcccattgtttccaataagttttataaacatgtacttaaacaatgaaagtaatttctagaaaaaaatatactttgtgcaggatgagtttaagtatatgataaactaaacgtaaataatacaaaggtaaaatttgctgctctgtatttaacacatatcacagaatcatgtatttcccagcttatccagaagagacagacatcaataatataacagaagtgaaactctctggttagggctagggtcttcacccctgggacctctctggggtcctccaaggaagaggagaactgtcctaaagttaccagttttctagctggtaagaaccttagcaagcatcatctccactttagatacaaggaaaataaaagatattaaaaaccaaagtaaatatagaaaaacaatttgtgcaaggttacttggagttagcaagttttccttagaggcttctgagagtcactgcctaaataaagagatcacttaagtcaagattcctagtctttttcaaggattgatttgctgtattagtatgtaacaaaaaaatcttttctctgtaaatgtgtagccattttgtgggagttattttttcagcacttgtgacatggctgcttacatgagccaattcaagtgttgtgagaccaaatctttggagacaccttgaagtgtctccactttcatatccccgaggtcattcttttattggccttgtgacagccctgcaggagtcaactattgtgaggacaagggagacatatatgcttctgacagctttattcaccataaagaaatttgaagacattttaaaatagagtccataactgtgtcaatagcaaagtttaaattcaggtttacttgaaaatcatgtttagaatttgcctaaatatttaacatttaggcttcaataggtgtgtgatactcacatgataatcttttataaaaatttatttttaggatttttttgatctttcagtatacataagaacaaatgttgaatatggataaaaataataattaagctgcatatttttgtaaggatttaaagtgaattacattgcaaggaatatacatatattcagcaaaatgaaaagccaatagatttattaggttggtgcaaaagtaactgaagttctttccattaaagctattttatcaatctataagaataataccaaaagtgaagttaaggagatgcttcgagcaatttcttaggctactgctggaagattccaaaggaaggcaagggtgaaggtgagtgggtagattgtccctgagaagctgggcacctattgactagctcctgtccaccattccttgagagttgtccatgggggtattcattcctttttgtatgattacatgtttcttcctagtttgttaaataagagcaaggtttttggacccatttattttcttctgcctttatataaacttaaaggataatgtgaataaagcaattagctgctttctcttcaaacatacactgtgttaaatttctacttccccgattattttatatgcttagactttaatatactgtcatcgttaatattattttatacttatttgaaaaaatattttctttccttaattgaaaatcatcattacattttacagcaatttttgaaagtatattatttatcatagcaccattttataaaaatgcttgactatgccatggagaccaaaaacaaacaaaaacaaaaaaggataacagaggagacacttgatggatgaaaaaggaatagtggagatcattaagccacccacctgtctctcatagctggtgcggttgtgaaacaaactgcaacacaggctgattaattttgctgaaaaggcaacacatctacccccttatgacacagaaaactttaatttccttacttttaataactcaccattgtgaaaactaaatatattctttagtattacattaaaaatgatgaagaaaaatgagtagagttttaaaagctttttaaatcaggtttcatgcttattctattactgtgttccagtaagcagatctgagtatctcttcttctatgaccgtttttgttgttgttttaatgcacaggcagaaaaagtagaatttattatagatcaccctctggagaattttccttttgattgagttttctctttttagtgcttttacacaaaaggattatagcaattagagaaatgtgggctaatttaactaaaaatacattttaaaaagattacatgagttttttagtttctactcttgtctacgatagacaatcttagcatattaaccaaagtaacaaggcaatttgactgtttcatttctgagttgtaactatatgtttgtctgaaagcccagttattaaaatatatatgatgaggttagaccataatatccagagatcaaataatctgcttctgaatctcttatcaagttgttgtatgaggttgcatattgttaaggaaaaagaacatacttttgtctagctatatcaattcaaaaaagaaatctgagcctacagataaaactatagaaagaagattgattatgggtataaatacatccactgtcttactggggccagttagatcccaaagtaactactccactaaataagaacctactccattaaataaattatgagggcatcatggttaatacatcaaagaaaatctggtaaatatattcttcattataaaacaaaaaaattacagcaagaaactgagatgaagcaaaactatagttttagtatgtacttttatagaatatcctggggagattggaataaggagacaaagcaagaaagttcattgtggttaacatattttaatcttagaataaaaaattaaacacaaatggttaactgttacctatgtggtctttgtaaatatggattgcaaaatgtgcactttctctaaatgaaggttttgtttacatctcattttgggtcactttaatattctaccagctccaaggtaagtgaaatttaacctcatacataaataaaaattaagggatttgaaatattacacagttgtggtaaaatgaatataatctgaatttgaattaatcttgtatcctgtactacctagtattaattgttattgtcttcatactggcttttagggctgggatattcaattaatttgggctacaaactaggctagttatttaaaatacaatcatatgttcatagacttagaaccaagtagaggagatagctattagcctaataaaaccacactaagaaatgtttacttttaagctcagagaggtaatgcagtctttctaaaattgtcatgtacatgtaaatcaccatgaaacttgctacaatgtaaattctgtgtcagcaggtctagagtggggccaaagagtctgcccttttatcaagctctttggtagtactgatgctgctagaccacagaccaatttgaatagtgcgttagtaagcaatctactaatacattctaccattgtagagaaatggagtcaataggatctctgtctacatgagagagagactgagagaaagacagagattatctctctctctgtatatatatatatatatatatatatatgtgtgtgtgtgtgtgtgtgtgtatatgtatatacaaacatgcaataaatatatatttctctatatataatatatatttctctatatgtatttcagccccctcatacatatgtatataaatctatttatctatctatctatctatctatctatctatcatctctatctatgtatatatcgatctacctatctacaaagagagactttttataagaggttaaacaatatatatatatacatgtatattatatatacatataaataatgagagagagagaatttaagaatttgactcgtgattgtgagggttaacaagtcagaagttcataaagcaggctggatattctagtaagaatcaatgctgcagtcttgagtcaaatagccatctggaggcaaaatttcttcctttttagaagacctcaatcttttctctaaggcctcacactgactggacaaggcccacccacattatggaaggtaatcagtttaactcaaactctgctaatttcaaggttaatcacagcaacattcagattggtgtttaatcatgcaactgggtaccacagccttgcctagttgacatttaacaaaattaaccatcacaagtagcaaaactctaaagcagggatgggcaaactatggcctctgggctaaatgtggtgagccacaagcctgcttctgtatatcctacaagctgagttaagatggttttgtacactttcaaatgattgaaaaagtcaaagaataataatattttatacaaagtgtaagtattatatatgaaattcaaatttcagtgtggctaaataaagttatactggaacacagccacactcattcatttacatgttgtctgtgcttggtttcctagatgcagagttgagcaattgtgacagagagcatatggtccacaaagcacacaatatatattatctcaccctttacagatacattttgtttgaatcctactttaagaaaagaaaatggttttatctgagtataattgaaatgagaatatgaagtaaagtgacaataacggagaaaagtggttctcaaacttcagtgtttatcagaataattcagatcacttgttaaactacagatatctggcttccattctgagtttgcaattctgtacatctgtgacgggaacccagaatttgtacttccaacaagttggaagttgttgctgatgctgctaatcagagaactactttaacatcacgtttaagaaacttcaacattttttagctggccagcagaaaataaacctgtaacgaagtcaagaaaaccgctaagagagaaaaatcaacacagcataaaagatattatttcaagagagagagtgcatatgtccagctgtcaaaagtgctaaacaataaaaaaaaattgatgactgaaaatagtctttggatttgtagaaagaaaatatctgctggtccttcttagtctgctggtccttcttagtgagactgtcctaccgtactctgggtatatcatgggaatacaactactttacatcatattactagaaactgaattcaaaaaagttgaagttaataaatcatacatacgaaattataattatgtcactaggtaaccttgttatatttgagatggacacatgccatctcattaaatgactaaatatatatgtgatattaaaagagttggaacaacttgacagatgttagaattactattagaaataggaaaagctttgcaaaattgggccaaaataactaatgttaaatctgacaatctttttttgtgctctaccattagcatatgatatttgaaaataaacttttgaaaataaataaataacaacagagccctatttaaaaccaaaaataaaacttgtatgtttctgacatcttcgtaaatgaattactcccaaagaaatattttatcaaattgctgtcattttcctaatggtatgtgagagtgaaaaaaaacttccaactgagaaaaaagctgtatttccttttttagatcttgtttgctttgatcatttagtcatgaaaaataaactgaacagccattataaaaaataaataatcttttcttacatttgaatgcattttagatataaaacatgaaaaggtttgcagtccttattgaaaaataaaatctaatcatagttttactaaaatgttttgccagttttttccctttctgcattatctcaaagtgacaaaatttcctaaatcacaaccaaaatgtatgtatctccaagtgcattcaccagaagccatatccagaagaatatcttgtagtttatttcttttcttcttggacattcccccatgagttaatagattaaaggggcaggcatgcatgtgtcctgtaaaggcaagccacagaagtaaaatattagctctctctaaataatatgcatattcttagttattaagtttctcctctttgtggttgcttggacaggcaaatgtgtatatcaataattatttaactcttagagactatgcttggagcctattgtacattatttggttcactgtttaaaaatttgggatataaatcattgcagataggaccacatcaaattttaccttttttaatgtgttttttcgattcaaatttatcaaccttaaaggtattaagttaaggaaaatatttatttcttagacatgaatataattatggcctatgaataataatctcagcttttctatttgaataataatttttcatttttagctagataaccagtacacaatattttgtgaatcatattaccattaagacacaagattgaactgagtgattattctgtcacaccatatagtatctgggaagattttgaataaatatttgattcaatgtaaaatgagtaaaatacacagaatgatttttttaaaaaagaaaaaaaatacaataataaattcaatgaccaaaaagagaaataaatggaagaacagtctcagagatagcagccttaagagtgactcattcctactcctgctctcctttgcgtgatccttcagatcttctgtggaaattgggcaagtaaaggggacatgacaggaaagaaaaataaaaggctctattcagggtaatagagtaagttggacaaaaaaagaataaaaccgagctgaattggacgttagaagaaggggtttaaaggatgagttttggagttggactcactagattcaaatactagctccaccactatgtgttcttgggcaaattatttttcattatgccttttatcttacctacaacagtaactgattccaacagctgttacgaagcccctaatataaatgtttagaagaacacctcacagttaataataatcaaaacttattttattactaaattattatcctttaggtctttaaaaagcagaattagtaatgaaaaataatgattttctataacacacccagtatgagcatctcttaattagtttgtgttgataaccccaaaaatttctgtaaaagtgacattttcttagaaagctttatatttataattataataaaatcaatatttaagtctgtcttgctgaacaccctccaaatactcctattttatactattttctaatgtctccagtaaaagacaacatataagtaaatgtaattacaaactctagtaaccaattgtaatttaaatgttcaaagtcttatgtatttgttcaattttatgcacagaagatgagctttatgtggttcattagtctgttctcatgctattataaagaaatatcggaggctgggtaatttataaaggaaagatgtttaattgacttacagttctgcattgctggggaggcctcagaaaacttgcaatcatggcagaaggcacctcttcacaagcctgcaggggagagagtaagtgctgagcaaagggggaatccttttatggaaccatcagatctcgtcagaacttactatcatgacaacaggatgggggaagccattgtcttgattcagttatctctacctggttcctcccatgacacgtggggattatgggaactacaattcaagaggaaatttgagtggggacactgccaaaccatatcacgtgatatgagtaaaagataactagttgtcactgagtcatgcagataaattttgtactactgtgttctttgccttttttctattctttatttctcatccaagtttaatttctctgacttgaatttcatgtaatgtattacaaaacatttcagtttctttcctgtattacaggcagaaaccaaagctgtctattttgaaaacatagttttaaggaagctctttattatagcatcatttttattccagatttatattctaatgcatattattgtctctgtgtatcagaaagtatatgtaaagacttggcaaaagcatttttttcagattattagattatgacaatatatatgtgactagaatcatattcttataaaaatgtatagtttttttaagtacagataaatcattttaaaacttgtttattttttactatgaatgctattctttccataaatacttcttctttataaaagtacagaattgtgaaaaacactatgttctctacttactgtttaagactgagttgtctgtcaatagtggaatagctctggtctaacaaagtgaagtttaacaaacctaatataaatattttatctttgactttaaaagctggaggatttttttgttattaaaaatcagttttctagagagaatgcatttcgtcatagccaattttccaaaataatataaaaatacagtaactttcaaagaataaagctattttcaaagaaaatgcaataactttcttataatgtattaaccatgctgtagtatcatcacctttaatctactaacaattctgaatgactatagaatgtcactaaatggaaattcaagtaaaatacagtattgtatataaagctcatgagacaactctctatgcttcaaatatgcaagtttcaatgattaaccagttgccatttgtacagtgctttcagttgtttccacttaaaaacaaataccattatttaagccattgtatttttttttttatactttaagttttagggtacatgtgcacattttgcaggttagttacatatgtatacatgtgccatgctggtgtgctgcacccattaactcgtcatttagcattaggtatatatcccaatgctatccctcccccctccccccaccccgccacagtccccagagtgtgatattccccttcctgtgtccatgtgatctcattgttcgattcctacctatgagtgagaatatgtggtgtttggttttttattcttgcgatagtttactgagaatgatggtttccaatttcatccatgtccctacaaaggacatgaactcatcattttttatggctgcatagtattccatggtgtatatgtgccacattttcttaatcctgtctatcattgttggacatttgggttggttccaagtctttgctattgtgaataatgccgcaataaacatacatgtgcatgtgtttttatagcagcatgatttatagtcatttggatatatacccagtaatgggatggctgggtcaaatggtatttctagttctagatccctgaggaatcaccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcacccactttttgatggggttgtttgtttttttcttgtaaatttgtttgagttcattgtagattctggatattagctctttgtcagatgagtaggttgtgaaaattttctcccatgttgtaggttgcctgttcactctgatggtagtttcttttgctgtgcagaagctctttagtttaatgagatcccatttgtcaattttgtctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagcaagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaggtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatc

SEQ ID NO: 561 - DNA, 62599 bp, Homo sapiens
taaatcccagcccaccctcactcctcaccttcaaaaatcttttttttttcttttgagacagagtcttgctctgtcgcccaggctgttggagtacaatggcgcaatctcagctcactgcaacctccaccaccaggtccaaataattcttctgcctcagcctcctgagtatctgggattacaggtgtgctctacaacacctggctaattttggtatttttagtagagatggggtttcaccaggtcagccaggctggtcttgaactcctgaccttaggtgatccacccgcctcagcctcccaaagtgttgggattacaggcatgagccaccgcacctggcccacaaatcattttctgatcctgccaacacagatcaatgtcttcctttgtgaacatctaaagcactgtgctaaataataatttaaaactggttcataggttcatatttattatcatttaggaaaactgacttttgacaatatctactgaatttttcatttcatatggggagcttgatgaagcagcagcttcaagtggtaaatccttggttgacatgtctgagttagtatctttgtaactaccttctaacctttttcttttattcaaaccagatttttcccaaagtatttttctgacctaccttctctgaccagaggtaagtaaaagctctgaatcaacaactggggaaataattatggactcttgcaaatctgaaagtggcctgctgaaagaattttgtagacccctaacgcctctcttcccatctgttctttcccctcccctctctttatccttattctagccactatctggcatgatcctgctacttttatggttttaaccaccaatgatattctgatgatgctctcatattcttctccagcccagacctctttgtggagctctacccccaacctgtctggtacctgagctcacagacccctcaaactctacatgtccaaaatggaacccatcatcttcctaccttccccagtagctcccaccttagggaatgacctcatcatctgcccatctgcccaagctggaaacatggatataactctaacacctctctcacagtcaatcacaaactactgtgggttttaccttctttctatttctcagattcacttctttcattttgaaccctgggcattgcctaattcaagctcttgttactccttgcttaggttaacgcatcacctccagttggtctcttggcttctgtcttcctccacgcgatccatttcccctgcagtttgagtgatatttcccaaatgttaaatgattatatcatttttgtatcagtcaggaaccatccaggaaaaaaatgactctgaaaagcaaatggaactaaatactgaaaatagattacacaggtgatggaagagcttggaagcgaaagagaggatggagaggcagcccagggaatagcaacagcagcagagccactaccagcccaagggtagaggaacaaagggaagtgggattattactgaaggcctgagtctgggatcacccagcagaagtgggaccctatccagagatggggtcccaggagagatatagttgcagctggtattgctgcctgacgtggaaagtcggggtgcggtggtggtgggggaccccttgatttctgctttcccgtcaccatgcaacttcccagttatatccccctttggccaaacccagccagatgccagtagatactagaacctgagaaatgtagccttcagaaaccaaacagagcagtacaggggaagaactacaaaaggatctggggcacaaaggcccagaattaggtgacttctcctctagaaattttacagtgttcccctaaagcctttggcacaaagtccaattgcttgctatggaggacaagactatgcactcttgctgtggctcctgcttgtctgtagggtcaccttttacctggcgtaccgaccctgcactatcctcacactaagctcatgctcccacctggctctctaccagcagttacatgccaactctctctcactgctgtgccttgacacatgctactctctaaactagaatccactccccacctttcctcagtttcacacacacagctcctaccccaacaccagtcaagcagcagtgcactcgtcagctgtggagaagccttctggaacctctcactccatgagctccccggtctgaatgggagcccttctatgggtttccacagcaccctgtgttcatcttccacattgaattatcctcttattactgaaattgtcagctttctgctcttcctcattagaatgtaaactccttaaagataagaagagtatcttattcaccttctcacttacaatgctaagcatagtgcttagtgcatctagtaaacacttgctgagtaaatgcataaatttggttttaaggagagttaaacttcactcaggatggcagggccagttctacttaagacttataactttgttttttaaccacaaacttatttttaaaatttactcgaaatatttttcatgtcagaaaaggtttttgtttgtttgttgttttcctttctggaaaccagggaatccctaccatagatttttgggatatgattttaagactgaaaaccatctaaaaataagaggtgtgaaagctaagaggtaagcagcattttaatgccctccaaactatttaagggtaataactttttaaacaattatttaatttaacaaataataatttttaattctcatgcatgttccaattcataataaagcagtggttttcaaaaagtggtccatggaaacttgggtatcccaaggtcaaaactatttttataataatgctaggacatttttttccttttacactgtcctgacatatacatttatggcacaaaagcaatggtagtgctattatcttaaaatgaactttggtaatgacactaactgtactagtagtcactgtgtcctttaccaccacatacttgtagaaaaaaaagatgaaagttttactttaaaatatcctttatgaagcagtgaaaattactactcttggccgggcacggtggctcatgcctgtaatcccagcactttgggaggctgaggcaggtggatcacaaggtcaggagattgagaccatcctggctaacatggtgaaaccctgtctctactaaaaatacaaaaaaacttagccgggcgtggtggtgggcgcctgtagtcccagctactcaggaggctgaggcaggagaatggtgtgaacccgggaggcagagcttactgtgagccaagatcgcgccactgcactccagcctgggtgacagagtgagactccatctcaaaaaagaaaaaaaaattattactcttattaaatattgactcttgagtaaatatctttttagtatttggtatgatgaaattggaagtatacgtattataaaacaaaacacttctgttgcctactaaagtgtgatggttgcctttaataaagcttctttgtggttcagttgcaagtgaactggccacttattccaaaaaatatcatttttacttgaaagaacaactgacaaacagacttggatattaagcaggtattttcttaaatataaacaaagtaagcctctcactttaaaaagcacctggcaatatttgttgctaattgtgaaatgcacagtttcaagcaaaatttttgaatactcttatttgccatcatgaacttgaccacttcccaatatttaggaacttttctaatgagattggtggtcagaaaaattatttctctgaatgaattaccccatacttcatggcttaaaacaacacaaattatttatctcgtagttgtataagttagaagtatgaaacaggtcccactgggctaaaatcaagttgtcagcagggctgtgtgcctcctggccgagaagaatcagtgctgagagaaactctgtttccttgccttttctagctgctggaggccacctgcattccttggctcatggtcccttcctccatcttcaaagccagcaacatagcatctctcagagctctgcttctgacatcacatcttcctcctctgagcctttctttcaactccttcttccacttttaaagatccttgtaattacattgtgcaaccctggataatgcaggataatctccttaatttaaggtcagctcattagcaaacttaattccatctgcaaccttaactcccctttgccatggaacctaacatagtcacatactctgtggattatcatatggatatccttggggtaaccattattctgcctataacaggtgaggatattaacacatgtgatttttaaaaatgtttcaaaatgaaatgtgtcaacatttggaacatctgcataacttagtaagccagcattttctaaatgaccaatgtttgatgttcaaaatcacaggtgggtagaagattcattcaaaatgcaagacaggtgggtttaatgtaacagagtacaaaaatttcataaatatggtttcagattccaaatttgtaactaaccttttagaaatgaatgcttattgagttttgatgtagcatcaaagaagaatatacacaattatctgaaaaggccatgaaaatattcatacttttccaattacatatctgtgtaaatctagattttcttcatgtgattcaactaaaacaacaatatattgcaacagattgaatgcaaaagcagatatgagaatctgtcttctataaaaccagatgttaaagatatttacaaaaacatcaacaataccactcactgtattttttaaaaccatagttatccttcataaaaatatgctttccttgttaacatgtaataggttttttgctgttactttttaaaaaaatcaatacttttttaaattttaagctctcagttttaatttctagtgtatatactgatagttataactcacataacaaaagttttttggggtcctcaataattgttaagaatgaaaagatatcctgagaccaaaatatttgagagctgctatgctagagtagcaattccttcagagagagagagatgaatatgagctcgttaaattcatattccacttactgcagatcttactcatccctcagcctatattggcccttataatgatcatgacttatttctacaagggtcatactgggctgccaagaggcaagtctaccagctgaaaaaaaaggaaaccctaccatttgattaaggcagcagaggtataaaatagagcagctctgtccacaaaggatagtaagggaatgagaaagagcaaggaggagtttgcgtgacctcccatctgtccacaaggcagtaggtgtaggaacccagaggaggccacacctaatgccctgccttcttccagcttttttggaagcaaaggtagagcattaaatgtgcaattagaccatggctggagctctgctaagggaatgtttccctaaatgaaagcttatggtatatgcaatgtgttgtgctcataaagatcagaagaaggttggtttaagacacctggctttttattgaataccattctgtacaaagaatctgacaggtactttcacatttatcttggtattttagtaatgcattctcacatctaagaacatagatgtcctctattgcaaatgcctttcttattgtctgtggaaccaagtagctacgcagcctgggacagctccttaacctctcccaactccagattcccatctgtcacctgtgaatagtaatgcctacccatgaagattgttatgaggctcaagaaataacaataatgtatatgaaaaggctttttgataaactcaattgttttgtagaaataacagagccaaggaggaacttggtaaggtgactttatttctctctcccattttcatcatttccaccctcaatttagcccagatacaaccaaagtaaaatcatagttcttgctataaaaatgaagacttaatgtggggtttcttactcctcttccaaccaaactgttactaccaagccccttctacatataaaaattctatatgtttctctgttttatgttttatttattactacttagcaatatgatatttatacaagaagaatttgaaatgttcagtgactaagttgtgcaatcaattactcattcaataaagatttacatatccactaagtgtcaggctgtgaactaggcagtggagatacagtaaaaaaaataaaataaaatagaatacaaacaaaaatccctgcctacacagagcttgtattttaatgggtaggggaatagggagtgagatgataaatactatgtcaaaaggtgagatgactatagggaaagaagcaggaaggagatacggggtgctggatattggtgacggcgtgaagggtgcgattttaaatgatgtagtgaaggcaagagtttactattacaatgtcattcaagtgagggcctcatgcaattattgtggagaagatggctcaaggcagagaagacaccaagtgcaaaggtcctgggctctggtgtgttcacaggctagcaaagaagccagggtacctggggagggtaaggaggggcagagaggtaggaaatgagtaggaagggacagtatggagaggtggtgggcaggagtcagggacttcccatctcactagggggaggttttgagcagaggactgagttatgtgagttaagtgttaaaagaaacccacagccaatatcatactgaatgggcaaaaactggaagcattccctttgaaaactggcacaagacagggatgccctctctcaccactcctactcaacatagtgttggaagttctggccagggcaatcaggcaggagaaggaaataaagggcattcaattaggaaaagaggaagtcaaattgtccctgtttgcagatgacatgattgtatatctagaaaacccgatcgtctcaggccaaaatctccttaagctgataggcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaaccaaaaaagagcccgcatcgccaagtcaatcctaagccaaaagaacaaagctggaggcatcatgctacctgacttcaaactatactacaagcctacagtaaccaaaacagcatggtactgataccaaaatagagatatagatcaatggaacagaacagagccctcagaaataatgccgcgtatctacaacgatctgatctttgacaaacctgacaaaaacaagcaatggggaaaggattccttgtttaataaatggtgctgggaaaactggctagccatatgtggaaagctgaaactggatcccttccttacaccttatacaaaaattaattcaagatggattaaagacttacatgtcagacctaaaaccataaaaatcctagaagaaaacctacgcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctactcatctgacaaagggctaatatccagaatctacaatgaactcaaacaagtttacaagaaaaaaacaaacaaccccatcaaaaagtgggcaaaggatataaacagacacttctcaaaagaagacatttatgcagccaaaaaacatgtgaaaaaatgctcatcatcactggccatcagagaaatgcaaatcagaacctcaatgagataccatctcacaccagttggaatggcgatcattaaaaagtcaggaaacaacaggtgctggagaggatgtggagaaataggaacacttttacactgttggtgggactgtaaactagttcaaccattttggaagtcggtgtggcaattcttcagggatctagaactagaaataccatttgacccagccatcccattactgcatatatacccaaaggattataaatcatgctgctataaagacacatgcacacgtatgtttattgtggcactattcacaatagcaaagacttggaaccaacccaaacatccatcaatgatagactggattaagaaaatgtggcacatatacaccatggaatactatgcagccataaaaaatgatgagttcatgtcctttctagggacatggatgaagctggaaaccatcattctcagcaaactatcgcaaggacaaaaaaccaaacaccgcatgttctcactcatagatgggaattgaacaatgagaacacatggacacaggaaggggaacatcacactctggggactgttgtgggttggggggagggtggagggatagcattaggagatatacctaatgctaaatgacgagttaatgggtgcagcacaccaacatggcacatgtatacatatgtaacaaacctgcacgttgtgcacgtgtaccctaaaacttaaagtataataatttaaaaaaaaaaaaaaaaaagaaccactttggctgttgtatggagaatagactgctgagccgcaaagacaaagaaagaccaggctgggcatggtggctcacgcctgtaatcccagcactttgggaggccgaggcgggtggatcacctgagatcaggaattcaagactagtctggccaacatggtgaaaccccgtcttaactaaacatacagaaaaaagattagctgggcatggtggcggatgactgtaatcctggctacttcaggaggctgaggcaagagactcacttgaacctgggaggcagaggttgcagtgggctaagatcacaccattgcattccagcctgggcgacaagagcaaaactctgtctcagaaaaaaaaaaagaaagaaagaaagaaaagaaagatagaaagaccaactgggaggcttttgaaacaatacagtagagaaagcagggtgatcacaatggagacagtgagagatagagtctagatatatttttatggtaaaaacaacaggatttgtgcaaaggtcgaatgtgggttataaaaaggagggaggatgactttaaggatttggcctgaacaacaggaattgtgcagcagccattcacttagatgaggtggactgcagggaggccaacagggtttggggtggttagaaagactaataattcaattttagacatgttaattttgagatgcctttttgacatccaaaaggccacgggggtcgtttcatataagagcctgaaattcacaggaaggggtctgggctgggtataaatttgagaacatctgcttttgtataatatttagagctgggttgagattaaatggtattagcaagatactaagcatagatagggaaaagaaggatttcaaagactggaacctgagccttaaatcaagaatataaggaagaatcagcaaaaaacactagaaagagtttccagtgaaggagaagaaaaaccaggagaataccattatctgagagtaaagtgaaaaagtgtatcagaaagcatggggtgatcagccatgtcaaatgctgcgggtcggtcatgtcagatggatgaattgacactcagattttgcaaaaagaacatcattaacaaccttgacaagaacagggtggtggtggtggtggcaaaagccctcatgaagtcaaagaaagaatatgggaaagaattcaagaaacaatatgaggaaaggaactggagacagccagtatagacaacccttttgaggagttttgccgttaaaaaaaaaaaaaaaaaaaacagaaaaataaagagggaaaaggggaatgtgaagtcaaaaagtatcatttttctggatttttttaatggagacatttttaagacatttacagacatggactatattagtaattctgtatatgcaaataaacaaagagccaaggagggatatagatgtattttgtccttaatttatctattcatgaacgtggttagaaactgtacgataaaagaaaaaaaaggaaaccaagccttacaaagagactgatgccttatcccctgacatgcagctaagaagcagatcttacttggcttcagacttcgagcacaaatgaacccaaatggattcaactttactgaactatgtatcgtttattttgttactgaaataagaatatcaggcaactggaaatcaatgaattgatttaaatattgtgcaaaagatggagctattactatgggcacatttttatgatttaaaaatcacatttcagcattttccctatgtcggggctatgacagggcagcattgattaacacattcagacccaatcatcaagaaaaagacttggaactgcacatttcccttgtaaaagatgccttcttaggtccataccaagttcaaagttattaaataatgacagttgggtttgggagtttttttggtgtgtgatttgtttttaactttttattatgaaaaatttcaaatctatgcaaaagtagaatagaatatgaccttacccccatatatatataggacccagcttcaacaattaccaactcataactaagcttatttcatctctctccccacccacttctctctccctaagcaccagactattttgaaacaaatcacagacattgcataatttcatctataattatttcagtgtgcatgtctaaaaaagaaggactcttttaaaaaatcacattatcattttcacacataaaaattagaatagtccattagttccatcaaatattcttcagggttcacattttcttatttatgttctataaatatgtttttacatgtactgtagttttgtttgaatcagaatactaacaagtcctatgcacaaacacgtcatttctgaaagggacaagtggataaatttaaaagagttttggttttacaagcaaattaccagaagcactttagtgttacaatatatagtataaaaccaattttgattgaaatgggaacagtgcattttaaaatataatttaataggtttaaatgaatgttccaaatactaaagcacactacactttctcaaaaataaaaagggagatgatttggggctgccaattacaaatacattcacaactgacatgaacgttttcagttgaaaatataaaatcttcttaaaatatatatttcttctgttggttgacttggctttgtgttgcaaactatggttcatctgttcttccagttgcactagtaccgccaggctaaacattcttcagctcagtccaatcctaagcaattactcccttaccacctaaaaaaaaaaaagaaccaaaccaaaaaaaaaaaaatcaattacatgcttgttagaaatttttgcatacataaattataactctgattctgggtgctaggaaaactttggctgaagcaaacaaggaacacctaaaagttaagcaaatagctaccttaaaccaatttactgctttttaccatcagcatcacagagtgtcagaactaaaaagaggctttgcactccaaacccctcctaacagaggtgagccaagagaggctgaacgacttgcctggcatcatgcagcaagaagggaggttcccgaacccagactatcctacgaccagactagatgctttcccctgctgttatgtcatacccaaattgctagattacatctgattcaaagctactgcttttctgttaaagctcctgtccttctggtggagcaagatttgggagaacggcagtcatccctccatatacatgggggattgtttctaggacccctgcatataccaaaatcctagcacactcaagtcgcaaaatgggcccagcggaatttgcggaaaaagtcagccctccatgtgtgcaggtttcacatccagcaattactgtatcttgagtctgcacttggttgaaaaaaatctttgtataagtgaacccacacaatttaaacctgtgttattcaaaggtcaactgtgcttttacatttcatttctctttatttcactttctacagtcgcttcagaaaatgttgtcaactattttaaatggctggttcttctttcactatttaatgtgtttaatagactttattcactatatacccctactgattaagttggctcttacaatttttatacaatccttttggccaagacaaaatgagactttagtgcagttttcaaaatttagtaagcatttgttctcaccagattatattaatctttatcttttcaaacagtcagctttcatatttatagtatgcatgaaagtacaccataatacttaccaattttcacttcacagcaaaggtagattatgaataaactatgaagtttgcaaaaaggcagtatattgaaaaggagcaccacataatttgttataatagctccccctagtgagcattctcactattgtttcctgaacaccttttagggttattaattccaatacttggttttgttacctagaaattttctatcatggctgtaaacaaaagttatgtcaccaaatggtcatttcagccccagatatactcacaaaaattaaccctatcagcagaatggttttcaactagaaaagaatggtgttgtttttcatttaacgtaaaatgggaaaaatgaaaaagaacatagaattcggcaaatacaattgataataataactgtgattcattagcagttaatatgtgccatatattttgctaagcacttatatgggttgtttaatgtgatccttgtattactttaggatattaataccattactaatttcatgttacagataaagaaactaagtctggcctaaggacatacagctagcaagtgacagagctgaaatttgaatccaggttgtctgactccagagttcacactccaagccactattctattctgttgatgaagccacaaaattacttaggtcccaaatctgttttttttataatagcaaatctgtttgccagattattgcattatttatccactctgcttatatcacagaaaggcccaaagtcttcctgccctggtgttgcaattcctcttttctgcatactcacctctgtctgtagctgccacccagttcagaagtagtggtaaccaattccagagttgaggcaagagggatacaagatgtgcctaaaacagcttaagtcagaaagtgagaaagtactcaaaaaaaaaaaaaaaaaaaaaaaaaggagcgagtcacaaagacacaggtgcccagattgaagagacttctcctggccaaacctatgacaatttgagcactagcatgattaattataaatcattgaaaaattaagaactcataagttcatactaacattagatagataggtgagagagagagagacataagaagaagggagggctcttgctgacagggagggctcttcctgagggcagactggtaaatgtggagggaatgcagggatttaaaaataatcattttgcaatcatagtgagattggataaggcaagaaacattaatagattccaaatctagagagaaattctgatgaggaatcagatatttgcatgatcttaagatatcttcccacctatcacttcttagttggaagggggaaaaataaaatagtaattatacagtggagaaataagacaaccctttgatctggtggcctcatgtaacatcactaacaagaaacagatgggcatcacgtgcctgcagatgtgaagccttgagatgagcatgtcacacatgtactgttcttatcaagaatgtgtaatctgactgcaaccacaagaaaacagcagaaaaacccaagtgatgaatattctgcttagttaaagggggaagtataatcttgaaaactgtcaaaatcataagacaaagaaaagctatggaaataatccagattaaaggagctaaacaaacgtgacaactaaatgcattatttgtttccaggcttaattacacactggaggggtaaaaatgctagaaagagctgttaggtcaactgacaaaactgaaatatgaacagtagattatacaaaactactacatcattgtaaattcactgaacttgatcactgtgctggggttaagtaagataatatctctattcctataaaatatacactgaaggccaggagtggtgactcacccctgtaatcccagcacttcatgaggccaaggtgggaggatcacttgaggccaggagtttaagatcagcttaggcaaagctgaggctggaggatcacataagcccaggagtttgaggctgcagtgagctatggtcataccactgcactccaggctgggcaacagagcaagaccttgtctgaaaaaatataaaataaaataaaatagaaaatatacactgaagtatctagggggaaatcatcaggtaattaactatcaatggttcgaaaaagatgtgtgtgtgtgtgtttgtgtgtgtgtatggtttaaggctatggagtttcaattttgcaagatgcaaagagttctgtggatagacaatggtggcacaacaatgtgaatgtacttcatactactgaacagtacccttaaaagtagttcagatggtaaccgtattttaccacaatttaagagagagagagagcgagcatgcaaatgataaaattcatggggcatactgctaatagatgaatttgggtaaagaacatttgaatgttttctgtactatttttattttttcaatttttatgcaagtttaaaattgtttccaaataaagttttctatgtaaataaagtagaaattcctcccatggcagagcagctccacccgcctcctggtacagcctcctaggtgagtggcaggagaggggcctggaagcagccacctgctctcaaccctctcactccgcatgacctgttcattcaccctttctttcaaatgcctctagggttagatgaccaaactgatcctcaccagatttatccccacagactacattcttttaatgaattgactggctccctggggcaggataaactcaggaaatgagggtgaggtaaagggcactggaccaggagacagagtctgcatgtctcatcctgattctgcagattagctgtgtggcttgggcaactcattacctctggaggtgaacactctgatctagaatttttctttttgttgttgttgttttattgttgttgttgtgatcatgccactgcactctagtctgggtgcagagtgagtctgggtgtaggatgcagagagaccctgtctcactctgccacccagactagagtgcagtggcatgatcacagctcactgcagccttgaccttctggactcaactgatactcccacctcagcctcccaagtagcagggactacagctgcatgcaacaaaactcagctaatttattttttatagagacagggtctccctgtgttgcccagcctggtctcgaactcttgggctcaagtgatcctcccgctttggcctcctgaagtgctgggattacagacgagagccactgcactgggcctcagaaatttttaaaggtcccttgcagcattataattttatatcttacattcaccactcctgagaacagagtcaccaattaagcactaggtaatatgactctaatgatatggctaaaaatattgaaacattccacatgttaatttttcctcctgctacttagcttttggcaatatgttgttacgttgcgttctaggaatactagaggtaagggtttgtgtgtgtagagaaagacagaaagaagaggaaggaggaagagaaagaagggaaaacagaatggtattctatcggaatgaacaacacttacaactgataacattttaaaatctatagcatcgactcacaacttaaagtaaagcctttcattttctaaattgctttgcagttttaaagtaatttcttacctgttttatcattttatcttccaaagaactctgagacagtcaggacagacaacatttctattttaaagataagaaaactgatttggagaaggcaaatgaccgccagctaatttgtggtggttcaccaattagaatcccagctttttgaccctgtactgatgctcttcccaatttaaaaacctataaaatgtcttttcaacatcatactgaatgggcaagagctggaagcattcctcttgaaaaccagcacaaaacaaagatgtcctctctcaccacctctattcaacatagcattggaagtcctagctggagcatcaggcaagagaatgaaataaaaggcacccaaatagaaagagaggaagtcaaactatccctgtttgcagatgacatgattctatatctagaaaaccccatagtcttggccaaatagctccttaagctgataaacaacttcagcaaagtttcaggatacaaaatcaaaatacaaaaatcactagcattcctatataccaacaacagccaagctgagagccaaatcagaaaggcaatcccattcacaattgccacaaaaagaataaaatacctaggaatacagctaaccaggcaagtgaaagattgctacaacgagaatctcaaaacactgctcaaagaaatcagagaagacacaaacaaatggaaaaaatcccatgctcatggataggaagaatcaatattattaaaatggccaaactgctcaaagtaatttatagattcaatgctattcctattcaactacaaatgacatttttcacagaactagaaaaaactattttaaagttcatatggattcaaaaaagaacctgagtagccagcgcaatcctaagcaaagagagcaaagctggaggcatcatgttacctgatttcaaactatatcacagggctacagtaaccaaaacagcatggtactggtacagaaatagacacatagtcccatgaaacaaaatagtgtccagaaataaggtccacctatgaccatctgattttcaaaaaagctgacaaaaacaagcaatgaggaaaagactcccttttaaataaatggtgctgggataactggctagccttacgcagagtattgaagttgggccccttctttatgccatatgtaaaaatcaactcaagatggattaaagacttaaatgtaaaacctaaaactataaaaaccctggaagatcctggaagggaataccactctggacacaggaacgggcaaagatttcacgacaaagatgccaaaagcaacgacaacaaaagcaaaaattggcaaatgagatctaattaaactaaagagcttctgcacagcaaaagaaactgtcaacagagtaaacagacaacctatagaatggaagaaaatttttgcaaaatatgcatctgacaaaggtctgatacccaacatctacagggaacttaaacaaatttacaaaaagagaaacaagaaatcccatttaaaagggggcaagggacgtgaacagacacttttcgaaagaagacatacattcagcccacaaacatatgaaaaacagaccagtatcactgatcattagagaaatgcaaatcaaaaccacactgagataccatatcattagtcagaatggctattaattaaaagtcaaggccaggcgcagtggctcatgcctgtaatcccatcactttgggaggccaaggcaggtggatcaccaggttaggagttcaagactagactggccaagatggtgaaaccctgtctctactaaaaaaaaaaaaaaaatagccaaaggtggtggtggtgcctgtaatcccagctacttgggagactgaggcaggagaatcgcttgaacctgggaggcgggggttgcagtgagccgagatcgtgccactgcactcctggctgggcgacagagtaagactccgtctcaaaaaaaaaaaaaaaaaaagtcaaaaagtaacaggtgctggtgaggttgcttgtggataaaaggaaacacttattcactgttggtgggagtgtaaattagttcaatcattgtgaaaagcagtatggtgattcctcaaagagctaaaagcagaactaccattcaacccagcaatcccattactgggcatatatccagaggactataaatcattctaccataaagatacatgcacatgtatgttcattgcagcactattcacaataacaaagacatgaaatcaacctaaatgcccatcaatggcagactggataaagaaaatgtggtccatatacactgtggaatactatgcagccattaaaaaaagataagatcatgtcttttgcaggaagatgaatggagctagagtccattatccttagcaaactaatgcaggaacagaaaaccaaataccgcatgttctcacttattagtgggagctaaatgatgagcactcatgaacataaagaagggaacaacaaacactgggatctacctgagagtggaaggtggagggtgggaggagagagaggagaagacaaaataactgttgggtactaggcttaatacccgggtgataaaataatctgtacaacaaacccacacgacatgagtttacctaaagcttcacatgtaccccaaaacctaaaataaaagttaaaaaataaaatgtcttctacaaaacaacaggctgcatgcttcaaaaagtcacagtcatgaaaagcaaagaaaagctgagaaacccttgtaaagaaaactaaagaagcacaaaaagtaaattgagtatgtaattgtagcttggattttggattacaaagaaacacattgcttttgcaaaagacatttctagaacaattgccaaaatttcaatttggactgtattagatagtattgtatccatattcgattttctgaatttgataattgcaacatggttatataagaaattgtccttgttctcaggagacagacactgaagtagttagggataaaatgttataatatctgtaaccttctttcagttggttgagggaaaaaaagtgacaagaagaataaaaaacaagctcagcgcagtggctcacacttgtaatcgcagccctttggaaggatgagatgagaagatcccttgagcccaggagtttgaggccagcctgcacaacatagtgagaccaactacctacaaagaagattaaaattttaaaaattagaaaaatattagccaggtgtgattacaaacacctgtagtcctagttactcaggaatctgaggtgggaggattgcttaagcccagaaggtcaagggtgcagtgagctatgagtgttcaaatgcactccagcctgggcaacacagtgagacccagtttctaaaaacaaacaaacaaaagggtgaaaaacattatgtgtattaatatactagaactatatatgatataaagagagaaagagatgtggcaaatgtggaaaaatctcggtgaaaggtatttacatgttaattgttatattcttgtaatttttctgaggtctggaagtttttcaagattagaagtttaggctctgtgtgatggctcatgcctgtaatcccagcactctgggagtccgaggtgggcagattgcttgagctcaggagttcgagaccagcctgggcaaaatggtgaaatcccatctctaccaaaaatacaaaaaaattattcaggcatggtggcgtgtgcctgtggttctagctactcaggaagcttaggtgggagactctcttgagcctgggaggtggaggttgcagtgagccaagattgcaccactgcactccagatagggtgacagggtgagacctcttcttgaaaaaaagtttaataaaataaatagttaagaaagcatctgaaatgaaaactccctaaggagtgtcatattgtgctttctaatatttttattactataataatagtatgtcatgttgctgtttgcatgatttttatgactactatatactatcatctcatatgtcattactgagaaataggataattcacagaagtgaattttctaaaacacaaacaaaaaagatatgtagacccttcaacactgaaataaattttcagaccaactttatgaatatattaaacatatttctgatatttcaaacaaaatgcaaggaacataatctatttttgaagatcctaggtattttaagggtcaaattctctaaacaacttatgtgatcataattgtttaccttgaggttactgagatgtttgtggctttttatctaatctacaggaccctcctaccattgagtcctcctgtaagagatacacagccattcagattgttgccactatcaattcaaggtcactgctgggctactgactatcctaagactgcatttactccctaattcttctttcacttttacactctcctatcgaaccaccgaaatctggcttctgcctcaaccaatccaccaaaatagcttttgccacagtcacctataacctctctgttgataaatccaatgtatacttttcagtaatatatattacttgatttctcagaaacatttaatagataaccatcctattgtttctgaaaccatctcttcctcatctttcaaaggtctaaattttactgatatttctatttcaactattattctttcttcatctccttggagaaaatggtctttttcccctatgttttggttctgtacttaaaaaaaaaaaaactataatattaaaaaaaactgtttagctattattacaaattctcatggacagagatgtggagaagagaaataaaaaacttgagttaggcacaggctagaagaaactattacaaacattttgtctaaaaaatagtgtattttcacactcacatttcagactggaaggaaatataaggacatgtacaggaccaactgtgaccaactttttcatctcttgttcctagtacctactagtgcgctccaaagactggtgccttgatttgaagcaaaggttggaggaagcctattttggcaggattatatccatactacctagcatctgggggaattgagatatatctatatctatatatatctatatatatgatgatgatatactgatatggggtatatatacataccatatcccttttcagttctaattgggcaaaaggaactggcaggaagtaggacaggaaatgctttagtgggaagttttcagacactactatccccatgtttcttcccggccctggctactttcatccaatactcacggatggcggtgggaagaatagctggctgggaatacaaggtctcctgcccaaggcttagcagtcgtgatgggagtagagatcacagcaatccaaaaaggaaaactgtcattatttaacaaggatttattcaacgatcattgctttgtgagaagctggtgatttcccgacagcatctattctccaggagttcagggttcagttgagaggtaaagacctaaagagatgcagtaatgtaatatatcatgttaggtatgtccatggggcagcgatgggacaaggccctgttcttgcagttgttcagttaggctacatggaggtaaagcctctgtattgagatgaaaattgaaggataaatgacaaattcactgtcaggcctctgagcccaagctaagccatcatatccccagtgacccacacgtatatatccagatggcctgaagcaactgaagatccacaaaagaagtgaaaatagccttaactgatgacattccaccattgtgatttatttctgccccaccctaactgatcaatgtactttgtaatcccccccacccttaagaaggttctttgtaattctccccacccttgagaatgtactttgtgagatccaccccctgcctgcaaaacattgatcctaactccaccgcctatccccaaacctataagaactaatgataatccaccaccctttgctgactcctttttcggacacagcctgcctgcacccaggtgaaataaacagccatgttgctcacacaaagcctgtttggtggactctcttcacacggatgcatgaaacattcaccaagtaggaactgaggagaatgattaactccaccgtctgcacctgagacataagaagcaaaaaataaaataaatacacatgtaactgtgttttatatataccatcaggtgttacttaccaacagggatacattgtgagaaatgcatcattagttgattttgtccttatgcaaacatcacacactgcacttacataaacctagatggtaagcctgcctaccacacacccaggctccatggcatagactatcacttctggctacaaacctgtatagcatgtgactgtactaaatacttaaaggaactgcaatacaatggtaagtatttacgcatttaaacatagaaaaggtaccataaaagtatagtataaaagataaaaaatagtacatctatacaggacacttatcatgaatggaacttgtgggacttcaagttgctctgggtgagccagtgggtaagtggtgagtgtgaagacctaggacattattgtacactactatagattttataagcactgtatgcttaggctacaaaaatttattttaaaaatctttctgcttcaataaaaaattgaccttagcttatgtaacttttttactttataaacttttttttaatacttcaagttctagcgtacatgtgcacaacgtgcaggtttgttatttacgaatacacgtgtcaagttggtgtgctgcacccattaactcgtcatttacattaggtatatctcctaatgctatccctcccccctccccccagcccacaacaggccccagtgtgtggtgttccccatcccgtgtccaagtgttctcattgttcaattcccacctatgagtgagaatgtgcggcctttggttttctgtccttgcgaaagtttgctcaaaatgatggtatccaggttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgcaataaacatacgtgtgcatgtgtctttacagcagcataatttataatcctttgggtatatacccagtaatggaatgggtgggtcaaatggtatttctagttctagatccctgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttttctgatggccagtgatgatgagcattttttcatgtgtctttcggctgcataaatgtcttcttttgagaagtgtctgttcatatcctttgcccactttttgatggggttgattttttcttgtaaatttgtttaagttctttgtagattctggatattagccctttgtcagatgagtagattgcaaaaattttctcccattctgtaggttgcctgttcaccctgatggtagagcttactgtgcagaagctctttagtttaattagatcccatttgtcaattttggcttttgttgccgttgcttttggtgttttagacatgaagtccttgcccatgcctatgtcctgaatggtaattcctaggttttcttctagggtttttatggttttaggtctgacatttaagtctttaatccatcttgaattaacttttgtataaggtgtaaagaagggatctagtttcagctttctacatatggctagccagttttcccagcaccatttattaaatagggaatcttttccctatttctcatttttgtcaggtttgtcaaagatcagatggttgtagatgtgtggtattatttctgagggctctgttctgttccattggtctaaactattccaatcaatagaaaaagaaggaatcctccctaactcattttatgaggccatcatcatcctgataccaaagcctggcacagacacaacaaaaaagaattttagaccaatatccctgatgaccatcaacgcaaaaatcctcaataagatactggtaaaccaaatccagcagcacatcaaaaagcttatccaccacgatgaagtgggcttcatccctgggatgcaaggctggttcaacatatgcaaatcaataaatgtaatccagcatataaacagaaccaaagacaaaaactacatgattatctcaatggatgcagaaaaggccttcgacaaaattcaacagcccttcatgctaaaaactctcaataaattaggtatcgatgggacgtatgtcaaaataataagagctatttacgacaaacccacagccaatatcatactgaatgggcaaaactggaagcattccctttgaaaactggcacaagacagggatgccctctctcaccactcctattcaacatagtgttggaagttctggccagggcaatcaggcaggagaaagaaataaagggtattcagttaggaaaagaggaagtcaaattgtccctctttgcagatgacatgattgtatatttagaaaaccccatcgtctcagcccaaaatctccttaagctgataggcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaattataaaccactgctcaacaaaataaaagaggatacaaacaaatggaagaatattccatgctcatgaataggaagaatcaatatcgtgaaaatggccatactgcccaaggtaattaatagattcaatgccatccccatcaagctaccaatgactttcttcacagaattggaaaaaaactactttaaagttcatacggaatgaaaaaagagcctgcattgccaagtcagtcctaagccaaaagaacaaagctggaggtatcatgctacctgacttcaaactatactacaaggctacagtaaccaaaacagcattgtactagtaccaaaacagagatacaaactttttatttttttaactttttgactcttctgtaatagcacttagcttataacacaaacacattgtacagctgtacaaaaatattttctttcttcatatcactactctataagctttttgttattcaaagatttttttaactttttccaacatttttgttaaaaactgacacacaaacacagacattacctaggcctacacagcatcaggatcatcaatatcactgtcttccatttccatatcttgtcccactggaaggatttcagggataataacatgcatggagctgtcatcttctaggataacaatgcctttgtttggaatacttcctgaaagacctgcctgaatatgttttacagttaacatttttttataagtataaaaagcacactctgaaataacaataagaagtatagtaaatacataagccagtaacactcatttattatccttatcaagtattacatactgtacataattgtatatgctagtctttcatatgactgggagctcagtcggtttatttgcatcagcatcattacaaacatgagtaatgcattgcactatgacattaggaaggctactatatcactagatgacaggaattttccagctccggtataatcttatgggactaccatcattcatgcagttggtctttgaccaaaatggtgtttttttttttcagatggagtctcgctctgttgcccaggctggagtacagtagcgtaatctcagctcactgcaagctccacctcctgggttcacgccattcttctgcctcagcctccggagtagctgggactacaggcacctgccaccacgcccggcaacttttttttttgtatttttagtacagacggggtttcaccatgttagccaggatggtcccgatctcctgacctcgtgatccgcctgcctcggcttcccaaagtgctgggatcaaaggcacgtgagccaccgcgcctggcccaaaatgttgttctgtggtgcatgattttatgtattaacgtatatatagtatatatatgtgtgtgcatatatacatgtgcatgtatgtgtgtgtatgtgtatgtgtgtgtgtgagagagagagagcttgccacatgggaagttggtagcagacctgaagagtatgcccagcaaggaaaaagctgattctgtgttagccatgtgaagcaacagggcattattcttctcaagggctcctttggagtgtgtgggagtgtgccaagaagtcaagaagtcatggataaagtggcacatcttcaaggacattaatgcattttgatattcaaaaatagatatgtaataatagaggctgggcatagtgactcacatctgtaatcctagcactttgggaggctgaggcaggcagatcacctgaggtcagaaatttgagaccagcctggccatcatgacaaaaccttgtctccactaaaaaatacaaaagaggtggcacatgcctgtagtcccagctactggggaggctgaagcatgagaatcacttgaacctgggaagcagaggttgcagtgagccgaaattgcaccactgcactccagcctgggcaacagagcaagactctgccttaaagagataaataaataggccaggtgcggtggctcaaacctgtaatcccagcactgtgggaggccgaggcaggtggatcacgtgaggtcaggagttcgagaccagcctggccaacacagtgaaacaccgtctctactaaaaataaaaaaattagccaggcatggtggcagacaatcccagctactcgggaggctgaggtatgagaatcgctagaactcgggaggtggaggttgcagtgagccaagatcgtgccactgcactccagcctgggagaaagagagagactctgtcataaatacatacatacatacatacatacatacatacatacatacatacatgtaatagaatggcaaatgcatgtgaagtttttaagaaaaaccacacagcttaaacaattctcagtattttaagtatttcactttgtctcctaccatccctgggagtttgcatctcttttcctttgcccttgcaggcaagtccctaatcatttgcaaagagaaaggaagaactgcaattaggtgagcattattggtactttggtaatttgcatttgccttttttctttttcacattttagatcaacacaacattttatttatttttttttttcagtggaaaataacttatattgagaccccacgagctgcacaatgtgttcctggcattaagctcattcttcttttgcagttcgatctttcttgagtggttccatgaacgctttcttctcttctatggtctggaagcagccatggccaaacttggaggtggtgtctatgaacttaaggtcaatcttctccagaacccgccatttggtctgcaccagcaaagacttctagagggtgagcacttgcttcttggttcccaccactcagcctttcagctgtgacctctttattcatggcatatagtttatcatataccaagaccttttatattatatagattctgtctctggcctatttattccattgaaatttgggttataattgcaggagacttaagactaattgagtaagcactgctagatggacgaacagaaacaactctggtttgcagctcccagcaagatcaatgcagaaggcaggtgatttctgcatttccaaccgaggtacctggctcatctctttgggactggttagagagtgggtgcagcctacggagggcgagctgaagcagggtggggtgtcgcctcacccaggaagcacaaggagtgagggaactccctcccctagccaagggaagctgtgagggactgttccatgaggaatggtgcattccggcccagacactaggcttttcccacggtcttcacaacccacagaccaggagattccctcaggtgcctatgccaccagggccctgggtttcaagcacaaaactgggtggccatttgggcagacaccaagctagctgcaggaggtttttttcataccccaaaggcacctggagcaccagcgagagagaaccgttcactcccctggaaacggtgctgaagccagggagccaagtggtctaattcagcagatcccacccccatagagcccagcaagctaagatccactggcttgaaattctccctgccagcacagcagtctgaagtagacctgggacgctagagtttggtgaagggaggggcggctgccatcactgaggcttgagtaggcagctttcccctcacagtgtaaacaaagcctccaagaggttcaaaatgggaggagcctaccacagctcaggaaagccactgtggccagactgcctttccagattcctcctcactgggcagggcatctctgaaagaaaggcagcagacacagtcagaggctcctagataaaactgccatctccctgggacagagcatctgggggaaggggtggctgtgggcacagcctcagtagacttaaacgttgcggcctggccagctctgaagagagcaggggatcttccagcacagcgctcgagctctgctaagggacagactgcctcctcaagtggatccctgacttccatgcctcctgactgggagacacctcctagcaggagtcaacaggtatctcatacaggagagctcgcgctggcatctggcaggtgcccctctgggacgaagcttccagaggaaggaacaggcagcaatatttgctgttctgcagcctccactgttgatacccaggcatacagggtctggactagacctccagcaaactccagcagacatgcagcagaggggcctgttagaagaaaaactaacaaacagaaaggaatagtatcaacatcaacaaaaaagaagtccacacagaaacctcatccgaaggtgaccaacatcaaagaccaaaggaagttaaatccatgaacatgaggaaaaaccagcaccaaaaggctgaaaattccaaaaaccagaacgcctcttctccttcaaaggatcacaactcctcaccagcgagggtacaaaactggatggagaatgagtttgatgaatttacggaagtaggcttcagaaggtgggtaataacaaacttctccaagctaaaggagcatgttctaacccaatgcaaggaagctaagaaccttgaaaaaaggtagaggaattgctaactagaataaccagtttagagaagaacataaatgacctgatggagctgaaacacgcagcatgagaacttcgtgaagcatacacaagtatcaatagccaaatccatcaagtggaagaaaggatatcaaatatggaagatcaacttaatgaaataaagtgtgaagacaagattagagaaaaaagaatgaaaaggaacaaagactccaagaaatatgggactatgcgaaaagaccaaatgtacaattgattggtgtacctgaaagtgacagggagaatggaaccaagttggaaaacactctgcaggatattatccaggagaccttccccaacctagcaagacagaacaacattcaaattcaggaaatacagagaacaccacaaagatactcctcgagaagagcaaccccaagccacataattgtcagattcaccaaggttgaaataaaggaaaaaatgttaagggcagccagagagaaaggtcgggttacccacaaagggaagcccatcagactaacagcggatctctctgcagaaaccctacaagccagaagagagtgggggccaatattcaacattcttaaagaaataattttcaacccataatttcacatccagccaaactaagcttcataagcgaaggagaaataaaattacttacaagagggattatttatagatacctctcaaagcttgcaccaatatattattacattataaatccgaaaaaaagagcagaatttcccaaaaatgttagaccacaggagttttagtacacaaactccagagccatatggcctcctttgtttaaattctgcctctagtaactgtggcatcttggacaagtcacttaatcgtcctgtgccttagtttctgcatctgaaaagttgcaatagtgaaagcacctactttattgggtagttgtgaagcttcaatgggttagcatgagtgaagtatttgcagcagtacctgcctcatagtaaacaccacaaagtttcgctattgttagagcattagttttgtgttgctgttattccttattccagctgtcattattttagaggactacacattaacatctcagtgatctagaacaaatggagcaatgtgagaaactgtgctgtatcttgatcagtagttacccaacccagtgagtctgaaaacaacagattgctatccctcccacgtgagattctgatgcaattggtctgtgacagagaccaggaatttaagacctgtatttcagaactctaggaaactttttcgcctcagcatgtgagaactttagaggtttaatgaaagacaagaggctagaatcccacaatggctagtggacttaatccatggcaccaccaattgaacagtctgttaaactactcatttattgtagtggtttaaggcagttgcaaggaaacatgagtgaggccttccaaaagggttagtagtatctcatggtccagagcagtgtggggaagggcaaaaaaatggataagaggtatgagaagagacaataaaataacttgcaccaaagataaatgcatttcactgttttctagatattgtcagtgtccctgccacacatgttataccattttgcaatcctaacagcaacaagcaatagtgactgtttctccaaagtctcccccacagaatgaactattgcacctttggctttctgcctatcagggtgaaatattgtatgttagtataattttaatttgcatgcccttaatttgcatattctctttatatgtttaggtctatttgtatttatttttttgtaaactatatggctttgaattctctttgtcacaagtgtaagctgttccataacagcttatgctattatgggctatgttcataaaccactcaaagagctacagaaaatagaatgaagtatagtcctttcatgatcacttgcccttcttattgctaaaagaaccaacagagcaccaaagagaccttatagctgttcctcaactggagtagaccaggctattccctagttcaccctggtagcaacagccagctttcttcctcagacaaaccaaaatatcataagtctcttgtttggagaaatgggagacttggtccatatgtttaaagggtctacatcatttgccattttcttaatcttggaaggaaacatagattgacttcaaaatgttatattttttcatgtaacaaagagaaatgtcatgatgaatcaaatgaatcaaaagatcaatttcacacaattgtggtattttgtaaactgaatatggatacttaacatattgtgaaaattaaattgcttgtggtacttaagcattgaattaattaaaactcctctaattcaaaaatgttatctatctgctaagcacaatatatttatataaggtctgaaaaaaatagcccttatttttaattatgttttgttattgtgttaaagttacactggccaacaaaattagaacttagttattacacttgatggaaaagcttatgtcatccataactacaattgaacccaacatgggaaaagccactggtttcagctgatatggaattaatttatactctgaaaagcttactaactggaaggtacttgaaagttattatattgattataatatcttgaatatcaaaaataatggatttttttcctgagcacacacatattttctttctcttttattcctaatgcaggggtaagcagaaaggacactattatctacccactccgcgtgggctctcatccaattaaagggacacagaccctaaagaatgatcatacaaaacactaaatatatcatttcccattagcacagcacacatcttattcctggtagtagaaattaggccatgctaatgtgagagtctaataatgagagcataagaactaatacacatcactaagatgagtttcaagtttccaagaatcaacctaattctctttataatatgcaaactggtagaagatgctaggaggcttttggcgaaagaaaaagaaagagtagagtgatggttaattttacctgtccacttggctgagccacagtacccagatacatggtcaaacattattctaaatgtttctataaagatttcttttagatgagattaacatttacaacagtagactgagcaaagcagactaccctccataatgtgggtgggcctcatccaatcagttgaaggctttaatagacgaagactgaacttggccgtgcactctggctcatgcctgtgatcccagaactttgggaggccaaggcgggcagatcacttgagatcaggagttcgagaccagcctggccaacctggtgaaacctcgtctctactaaaaatacaaaaaaaattagccaggcatggtggtacacacctgtaatcccagctacccaggaggctgaggcatgagaattgcttgaacccaggaggcagaggttgcagtgagctgagatcacaccactgcactccagcctgtgtgacagagtgagaccctgtctcaaaacaagaaaaacaaaacaaaactaaaaaacaagaaagaacaagactgaactcccccagagaaggaattctgccagcagactgcttttgtactcatactgcggcatcacctcttccctgagtctacaaccagcctgcctaccctgcagatttcagacctgcctgtctcctccacaattgtgtcagctaagctaattccttgaaataaatctcttgagtgggggatccaaaatggccaattagaaggcgctgcggtcagcactcatggaaaggaatgaaaaggggtgagtaaattcagcaccttcaactgaaatatccaggttcttacactgggactaactaggcaaacaactcaaaccacaaacaatgaaaaaaagcttttggggttggggaggacaacagcccacccaggagtagcataaagccaaaggaactcccgtccccaccaagggaagcagtgagtgattgtgcaacacggtctgggaaaccatgcttctcccatggatctttgcaatctgtggatcaggagatcacctcatgagcccacaccaccgggccttgggtccaatacacagagctgtgtggagtcttagtagatcagccactcaggcacacacagagttttatatactgcagccccaggattcccagtgaggtgagaaatccattcatacatatctctaggaaggggtctgaatccagggagccaagcagcctcgttctgcacatcccacaaccatgacaccccacaagttaagtcccactggcttagaattccagccagctgatggcaacagactggaatctgcctgagatgggtctgagttcccagggaggatgggcaggcaccatctctgcagtttggttgactcagccattccagcctgccagctctggagaatacaaatcgtccagagaaggaagggcaccccctagaacagcacacctgctataccaaaaagcaaccagactgctttaagctggtcactgatcctgttcctcctgactgggtgagacctcccaagaggggtctccggccacctcctacaggtacgtttgggcagcaacaggtcagtacacccctgggatgatgcttccagaggaaagagcagactgccatctttgctgtttcacagccttcattggtggtacctccaggtatgggaaaaactgaggtaatagggtctggagtggacctccagcaaaccacagcagccttatgatagagtagcctgactgttaaaagaaaaacaaataaacagaaaacaacaacaacaacatcaacaaaagagactccacaaaaaccccattcaaaggtcagcaacctcaaagatcaaaggtagataagcccacaaagatgagacaaaaattaatgctaaagtgatgaaactcagaaagccagagtgcctcttctcctccaaatgaccgcaacccctctccagcaagggcacagaactgggctgaagctgaaatggctgaattgacagaagtaagcttcagaaggtgggtaataacaaacttcagtgagctaaagaagtattttgtaacccaatgcaaataagctaagaatcatgataaaacaatacaggagctgaaagccagaatagccaatttagagagaaaaacaactgatctgatggagctgaaaaacactgtacaagaacttcacaatgcaatcataagtatcaatagcagaacagaccaagcagaggaaagaatctcagagcctgaagactgtctttctgaaataagacagacagacaagaatagagaaaaaagaataaaaaagaatgaacaaaacctctcagaaatatggaattatgtagaaagactaaacctacaagtgagtggggtacctgaaagagatgggaagaatggaaccaagttagaaaacatacgtcaagatatcatccaggagcacatcccaacctagcaagacaggccaacattcaaattcaggaactgcagagaaccccagtgtattagtctgttctcatactgctaataaagacatacctgagactgggtaatttataatgaaagaggtttaattgactcacagttccacgtggctggggaggactcacaatcaaagcagaagatgaatgaggagcaaagtcacatcttacatggcagcaggcaagagagcaagtgtaggggaactcccctttacacaaccatcagatctcagatatcatgaaacttattcattatcatgagaatagcatgagaaagacctgcccccatgattcagttgcctcccaccgcgtccctcccatgacacatgggaatcataagagctgcaatacaagatgatatttgggtgaggacacagccaaatcatatcacccaataaaatactccacaaaaagaccaaccccaagacatataattatcagatttgccaaggtcaaaatgaaagaaaaaatgttaagggcagccaaagagaaggaccaggtcacctacaaagggaatccatcagactaacagcagatctctcagcagaaaccctacaaatcaaaagagagtgggggccaatattcaactttcttaaagaaaagaattttaaacccagaatttcatatctggccaaactaagcttcataagcaaaggagaaataaaatctttttcagacaagcaaatgctgagggaattcatcaccatcaggcctgccttgcaagagctcctgaagaaagcactaaatatccaaaggaaaaactggtaccagccactacaaaaacacactgaagcacacagatcagtgacaccatgaagcaactgtatcaacaagtctgcaaaataaccagccagcatcatgatgacaggatcaaattcacacataaccatactaactttaaatgtaaatgagctaaatgccccaattaaaacacagaatggcaagctagataaagagctaagactcatgggtatgctctcttcaagagacacatctcaagtacaaagacacacataggctcaaaataaacagagggaagaaaatttactaagcaaatggaaaacagaaaaaagcaagggtcacaatcctaatttctgacaaaataaactttaaaccaacaaagataaaaaaaaaaaaagaaaaagaaaggcattacataatggtaaagggatcaattcaacaagaaaagctaaccatcttaaatatatatacacctaatataagagcacccagattcataaagcaagttcttagagatctacaaagagcttagactaccacacaataagagtgggagacattaacaccccactgacaatactggacagatcattgagacagaaaattatcaaagatattcaggacctgaactcagctctggatcaattggacctaatagctatctacagaactctccaccccacaacaacagaatatacattcttctcattgccaacagcacttaaactaaaactgatcacatattcagaagcaaaacactcctcagcaaatgcaaaagaactgaaatcataacaaacagtctcttagaccacagtgcaatcaaattagaactcaaatttaagaaactaactcaaaaccacataactacatggaaattgaacaacttgctcctgaacaacacctaggtaaataataaaattaaggcagaaatcaagttctttgaaactaatgagaacaaagacaatgtgccagagtctctggaatgcagctaaatcagtgttaagaggaaaatttatagcactaaatgcccacatcaaaaagctagaaagatctcaagttaacaacctaacatcataacaaaagaacaaaagaacaaaagaaccaagagaaaacaaaccccaaagctagcagaagacaagaaataaccaagatcagagctgaactgaaggagacagagacacgaaaacccctacaaaaaaatcaatgaatccaggaactgggtttttttttcccaaaaattaataaaatagagcagtaggctacataatgagaaaagagagaagaatcaaataaacacaatcagaaatgataaggaggatattattaccactgaccccacagaaatacaaacaaccatcagagaatactataaacacctctatgcacatgaagtagaaaaatctagaagaaatggataaattcctggacacataaatcctcctaagactgaaccaggaagaaacagaatccttgaatagaccaataattggttctggaaatgaggtagtctacaagccaaaaaaaaaaagaaaaaaacccagaaccagatatattcacagctgaattctaccagatttacaaagaagagttggtaccatttctactgaaactatgccaaacaaaattgaaaagaagggactcctgcctaactgattatgtgaagccagcatcatcctgataccaaaacctggcagagatacaacaaaaaaagaaaacttcaagccaatattcttgatgaacatcaatgtaaaaatcctcagtaaatactggatagttaaatccagcagtacatcaaaaagcttatccaccgttatcaaattggcttcatccttgggattcaagtttggttcaacatacaaaaatcaataaatgtgattcatattcataacataaacagaactaaacacaaaaaccccacgattatctcaacagatgcagaaaaggccttcaataaaattcaacatcccttcatgttaaaaactctcaataaactaagtgttgaaggaacgtacctcaaaatagtaagagcatgacaaacccacaaccaatatcatactaaatggacaaaagctagaagacttccccttgaaaaacacctcaagacagggatgccctctctcaccactcctattcaacagagtattggatgttctggccagggcaatcaggcaagagaaaaaagaaataaagggcattcaaataggaaaagaggaagccaaattatctttgttttcaggcgggtgtggtgactcacgcctgtaatcccagcactttgggaggacgaggtgggtggatcacctgaagtcaggaatttaagaccagcctgcccaacatggcaaaactccatctctactaaaatataaaaattagccaggcatggtggcgcatgcctatactcccagctacttgggatgctgaggcaagagaatcacttgagcctggaagcaaaggttgcagtgagccaagctcatgccactgcactccagcctggacaacagagtgagactctatctgaaaaaaatatatgtatcattgtttgcagatgacatgatcctatatctagaaaaccccatcatctcagctcaaaaagcttcttaaactgataacttgagcaaagtctcaggatataaaatcaatgtgcaaaaatcactagcatttccatacaacaacaactggcaagcagagaaccaaatcaggaatgaactctcattcacaattgctactaacagaataaaatatataggaatacagctaacaaggaacatgaaggacctcttcaaggataactataaacctctgctcaaagaaatcagagatgacacaaacaaatggaaaaacattccatcctcatggataggaagaataaatattgtgaaaatggccacattgcccgaggtaatttataggttttatgctattcacattaaactaccattgacattcttcacagtatcagaaaaaaccattctaaattcatatgaaccaaaaaaagagcccatatagccaaggcaatcctaagcaaaaagaaccaagctggaggcaccacactacctggttttaaactatactacaaggctacaataaccaaaacaacataatactggtacaagagcagacacatagacgaatggaacagaatagaaatcacagaaataagactacacacctacaaccatctgatcttctacaaacctgacaaaaacaagcaacaggaaagggattccctaattaataaatggtactaggagagctggctagccatatgcacaaaactgaaactgaacccctaccttacaccttatataaaaattaactcaagatggattacagacttaaagttaaaacccaaaaccataaaaaccctagaagaaaatctaggcaataccattcaagacataggcacaggcaaagatttcataaagaaaacaccaaaagcaattgcaacaatagcaaaaattgacaaaggggatctaattaaactaaaaagcttctgcacagcaaaagaaactatcatcagagtgaacacgcaacctacggaatgagagaaaaattttccaatctatccatctgacaaaggtctaatatccagaatctataagaaactcaaagaaatttacaagaaaaaaaaaaaaaacccatcaaaaagtgggcaaaggacatgaacagacacttctcaaaagaagacatacatgcagccaacaaatatatgaaaaaaagctcaacttcactggtcattagagaaatgaaaatcaaaactgcaataagatgccatctcacaggctgggtgcagtggctcactcctgtaatcctagcactttgggaggccaaggtgggcagatcacctgggatcaggagttcaagactagcctggccaacatggtgaaacaccatctctactaaaaatacaaaaattagctgggtgtggtggcgcatgcctgtaatccaactacctgggaggctgaggcaggagaatcgctgaaacccaggaggcgaaggctgcagtgagccaaggtcatgccactgcactccagcctgcatgacagagcgagactctgtctaaaaaaaaaagataacatctcacagcggtcagagcggctataaaaaaggcaaaaaagaacagatactggtgaggttacagagaaaaaggaatacttttacactgttagtggtagtgtaaatcagttcaatcattgtgaaagacagtgtggtgattcctcaaagacctaaaaatagaactgccattcgacccagcaatcccattactgggtatatatccaaagacatataaatcattctattataaagaaacattcacacatatgttcattgcagcactattcacaatagcaaagacatggactcaacctaaatgcccatcaatgattgactggataaagaaaatatggtacatatagaccatagaatactatgcagtcacaaaaaggaatgagaacatgtcctttgcagggacatggatggagttggaagccattatcctcagcaaaaccaaatatcacatgttctcacttataagtgggaggtgaatggtggaacacatggaaacagggaggggaacaacacacactggggcctgttggaggggggtgtggggaaagggagagaatcaggaagaatagctaatggatgccaggcttaatacctacatgatgggatgatctgtgcagcaaaccatcatggcacacatttacctatgtaacaaacctgcacatcctgcacatgtaccactgaacctaaaataaaagttgaagaaaaaaaattaaaaatttctgtctcctctctctccctgtctctctctctctctctctcacacacacacacacacacacatgcacacacatacacataccctatttgttctgtttctctggacaactctgactaatacaaacagtaagaggtttgcaggttataacctggaaatagcaatgtggtaagggataagggtaaagaaagagccttcaaatggggaaatgtctggctaagcagctgatatatctgccatggattagacacccgcacagacatcacatcagttcaggcaccctccagctgggacacaggttcttacacccgggctaaaccactcatctgccatacagccagcacacagtaataaggggaacactgggtgacttggccctgctcacatctaaagctcgatctctcccaacttgttcctgctttgtttcttgaatttgtgtgtgtcagcctctgattttatacccatcccttgaagctcctcaacatcaccatcatctctaacctgatgaagatttagtttcttcagtttaacacttggtggtcctccatgaatgtgctttgccatgtgtcctccagctttaccaactcttggcatttcttcaaacaggtctggatctctagccccttccctagaatgtcaacaattcattaaggagagaccaatctcacctcatcttggcaacagggtcttccttcactacaggcttgtgaggtcctctcagttcaaggttctcatcttctctttgataatacctgtagaggcttcataaaggaaacaaaagtattatttgtaaagagcagaacctacaaaaaggcgttaataaaataaaacttactagacagctaactaaagtataaatacatacaaaactaacaacataaaacattaaaatatggctacactcattttactgatgagaaaaacgaggctcagaatgttctccaagagatgcccaaagcaccacagctgggttctatatccatactggttatcagatttcagagcacatagtcttttaaaattttttttctttttcttttattttattgtaagctgtgggacacatgtgcaggatgtgcaggtttgttacataggtaaacatgcaccatggtggtttgctgcacctatcaacccatcgcctaggtattatcctgatgctctccctcccccgcccccataccaataggcccctgtgtgtgttgttcccctccctgtgtccatgtgttctcattattcagctcccgcttataagtgagaacatgcactgttttgttttctgttcctgcattagtttgctgaggataatggctttgaggtccatccatccctgcaaaagacattatctcatgtgcacgttctgcacatgtatcccagaacttaaattataattttaaaaaaaatgggccaaagaccttaacagatacctcccaaagaagagctatagatggcaaataagcatatgaaaagatgttccacatcatatgtaatcattaaattaaatgaaattaaacaacaacgagatagccctatacacttattagaatggtcaaaatccagaacactaacgccggggatgactgattgaataaaagggcagtgagagagaaggagatgtcaaggtaaagagacaaagagctggtcatcttagttggagaacagaatctagcagtctacataaacgtaatgaaaattgagtgccaatcatatgtgaaacattttctgaaatcttttacaaccttggaaagtagatattattatctctattttttaagagagtatgctgaggctcaaaaagattctgcactgtctactatggcagccactggccataagtgacaatttatttttcaattttatttaaattaaataagaccaagaatcaagttcatcattagcactagccccactgcaagggctcagtagccacatatggttagtggctgccatattggacagtgctgttctagaacatttccattatagcaaaagtgctattggacagcctggtgtaaataaattagcctaatcctgtggctggtaagtcatggagctgtggtttaagagaagatttgtttcactgcaaagcccactctttccactagaaggagaatgagcccaaaggtgtagcttgattctgagctgaaggtgttctacatgaggatgtgctaaggatggcctgatctggccagaaccaatctgagaatgcacatgaatgagtttaagcctttaggggtcaagcaggtagctctggttgaaatgggagctgatgttgtaggaaataaacaactactaatttgttgacttggtctacccacagtgagcatatgatttatagtccacttttgagtgtaaaagggagtaccattcataattacacgacaaaacaggcataaaccaggatcgcactaagaacatgtgttcactccccaattaggtaccatgcatgtcgcaaatatacgaaagtcattttaaatttaccgtcattttttccaattcttatgtaattattcttttggaatcaagactaaaaaaattaaaaacccaaattcttcattgctcaatgaacaatgaataactttactaattaaaagtataacaaggacgggcgctgtggctcacgtctgtaatcccagcactttgggaggccgaggtgggcagattacaaggtcaggagttcaagagcagcctggccaatatggtgaaaccctgtctctactaaaaatacaaaaattagccaggcgtggtggtgggtgcctatagtcccagctactcgggaggctgaggcaggagaatctctagaacccaggaggcggaggttgcaatgagccgagattgtgccactgtactccagcctgagggacacagtgagactcggtctcaaaaaaaaaaaataataatgtaacaagcatcttttttatattattaaccccacccccatgaaaaagtcttcaaaaagtgaccaagaaaatgtgccactgataaatgatgttcaaatgaaaagaaaatacattatgatctttgcccagcaatacaacttgttagctgagtgatcttggacaattcactcaactttttcatacctcagttttctcacttgtaaaattaatttcctattgatgcataacaaatgagcatggtggcacatgcttataatcacagcactttgggaagctgaggcaggaggattgctatagctaagagtttgcgaccagccagggcaacataggaagatcttgtctctacaaaatataaaaataaataggctcactcaggaggtgggaggatgacttgagcctgggaggcagaggttacagtgagccaagatcacacactgcactccagcctgggcgacaaagccagacgctgtctcagtaaataaataaataaataagccagaagtggtggcttgtgcctgtgcccccacttacttggaaggctaaggtggaaggatcgcttgagcccaggagggagctatgatcatgctactgcactccagcctggccaacagagtgagacactgtctcaaaaacacaaaaaaaacaaaaacaaaaaaacctccaaattatcccaggatttacgtgcagtttaactaggcagatctggctcagggtctctaatcaggaagtgtttgagtgatggtgtgaatccctcatgaatggcttggtgcatggctcagtagcgagttagctcttgctgtctcgagaatggattagttcccaagaaggtggttattaaaaagagtctggcttctttggttttgttctcttgcctcctttctcgcatgtcacttctttgtatacacctacttcttccactttctgccaggagtggaagcagcctggggctctcacaagatgcagctgcctaatcctggatttccagtcaccagaactataagccaaataaacaatttttctttataaattaccccatcttaggtattctgttatagcaacacaaaatggactcagatagggatgtaagaatgaaagaaaaaaggtaaagagatatactttacactatttgaacacatttcatttagttgaaaatttaactgaaaacaatgccccaaaaagagattcaatgaagcctaggcatgtctccttttgaagtgctcccttttgaatgagcacacctgctttgcggcagaagcaaaaagagagcatggccttctaattcccattccagggttcatgtgcctcgtgccagcagggcaaatgtgaccacttacttaatgcctggctgcctcagtgtccttatctacaaaataccaacaatatgaacgcttaccttgttaaggctgttgtgaagattaaattagacaaggagtttaagttaacattcaaaaaaattttcttctgattatattatccgtcattgcaaacatgaaaagaacaaatggggtcttttcttagctaggaaatgtgtggcctggcttatttctaagcctgatatccgttccactgtagggacagatgagcaaagatcttacctgggtcactcacatggagtggggctttaagaagagggttaaggccaagacaagaaaacaggtccaatgcgagtcttcaatctaaaggaatctaagaaaaccaggaggcatcttcgaagacaaagagaagataagccgattcaaggagacaaaaaggagattgatttgtattcattcctgagatgaaggcaccactctctgagatggtttttttacatatttcccacatatcctttagtggaaaagttttaaattttcaaatttcattatattcgcattctttttgtttggacataaataatggatgtaatgtacaatatactgattttaactttgagttgaaattttaaaaagtgatttgcagttctaactatacaacatcctggaagagacaaaactataggaacagtgaaagattagtgactatcagcggttgtggggagggaggcatgaataggcagaaggattttaagggcagtcaaactgttgcatatgatactaaatggtgaatacttgtcattatacatttgccataatccatataacaaagaactccaagagcgagccccaatttaaactactgagttgcatcgataattatgtacccaatgccggttcatcagttgtgacaaatgtaccaatcgggtgcaggatgttaacagcggaggaggatgtgcatgtgtgggggcagtgggtgtgtgggaattctgtacctcctgctcagttttgcagtgtacctaaaattgctttaaatagtaaaatctatttttaaaagtgacttctcttttcaaacttttattatgaaatgtttcaaaattacaaaagaagaaagaacaaaatgaacccattaagcccatttcaataattatcgacatgtggtcaatcttgtttaatctatacacccactcatttccctccaacccctccactgggttatttggaagcaaatctgtcttatcaaaccatttcatcaaatcaggttcatttcaaggaactgagaaagactagaactaagtgtcagccagggactcactgtaacagctctccaaaggcctctccattttccttattatgcaataatagccaaaaataaatgttgtaataatttcagtccataattagtcacctaaactaatcatgtaaattagttgaacatgaatttttttattatattttgcctttagatttcttcctcttctgagtaaatatttttggataatttttccctaaatccataatatctccatctttcccaaccaccaaatttaattttatccatgccctctaagcaaaatgtctttgtaaaaaatgagaaataccatgacctctgtactgagaaagtcaataacttacaaaagctctagaagacacaaactgaaacaccacaaaagtaatatctatgaccgtttaccaagctttaagaagtaagtaaaacccttgccttcatattttcttcagaaccaggacatcctttatgggcagggttctcactgactactcaagggagctattatgagacacagcttggctaacagtcccggaatgctgaatttctggatctattgagataatcatgtggtttttgtcattgcttctgtttatatgatggattacgtttattgatttgcatatgttgaaccagccttatatcccagggatgaagttgacttgatcatggtggataagcttttggatgtgctgctggattcggtttgccagtattttattgaggatttttgcatcgatgttcatcagggatattggcctgaaattttctttttttcttgtgtctctgccaggttttggtatcgggatgatgctggtctcataaaatgagttaaggaggagtccctctttttctgttgttttggatcgtttcagaggaattctaagaattcttagcatggaaaacaggctgaatgggtgatactcagtcatggtttactaaattatgttaaccttttaacttgtaagtatttatgaaatgtttctgcatagatgtcacattaataagaatagtttcatataaggctcagattgatttgtattttaatgtctttctggatttttatccatatttaacaaatatgcataatcaaacataagcactttagactagaccataattactgaatattttactaatatctgtgatttttaaaatattactcccctataataagatgaaaaactaacgagtgcaaatacatattcgcatgctttgaaagtcagtaggtatatttaccttgtattaatcagtcttgggttttgcacatagcatatcttattaaaggaaatagcacctgagaatattgtaagctacctaagggaaggaccatgcctgttttgttcacctagaagctgtgaattttaagagaatgggctttaacactaaactgcctgtgtcctgctgacgttttctaagaaagtgcccttgggcaagatattcaacctctccttgctttgattcctcatctgtaaaatagataatgattactgaagtacccatgcataagagtgttgtgagggttgaatgactgatatgcaaagctctgggaaaaggatggcacaaattaagactagctgttcttcacggctgtatccaccaggctcagagtaaatatttgttgtctaaataaataaatgacaaagaatcaattccttttatttctcttttggacttgttaatgggtataaactataaggcaattccatggtactgatataataggtactcttaactgtcaaaaagtataaaaacattgtatctatcagagcaaaagaagccacgttaggaaagtcacacaccagcatacatattctatccatcacaattgcaattgtgttttgtttctaatcagatatctttaatagcttttatacataagaaaaggggtctgggctgggcatggtggctcacacctgtaatcccagcactttgggaggccgagtgggggcagattagttgagctcaggagttccagatcagcctggtcaacattgtgaaaccctgtctctactaaaaatagaaaaattagccaggtatgggggcacgtgcctgtaatctcagctactctgaaggctgaagcagtagaatcgcttgaatccaggaggcagaggttgcagtgagccaagatcataccactgcgctccagcctgggtgacagaaccagaccctgtctcaaaaaaaagggggggggaggggatctgaacttagtagagtactgcagaaagtgaaaaagtgagtaacaagagaaaagtaggttatgtgaagaataaccagatatttgaaactaaaaacgagaggccttgggagggactttgaatagctatgtgcctgatttaaataaatacaaaaatcacagaattgaccatcatttttaattagatagatatagccagtgaatactcaaattcactgtgaaaccagatagtcatgagccacccagactcaaattataacattgtcttagtctacttgatctgttataagaaaataccataaactaagtagcttataatagaaattcattgccgtagttctggagactgggaagttcaagatcaaagcagattctacatctggggaggaactgtgttctggctctaggtggcaccttcttgctctgtcctcacatgctggaaagggcaaagaggatcccttgagcctcttttatatgtgcacaaatctcattatcaagtgcttcatccccaaaacgtaatcacctcctaatggtcccatctcctaataccatcacctttcgggtgaggatttcaacatatgagtttggggggacataaacattcggaccatagcaaacataaatataattttgttgagtgttagatatatctgcgtgtcccattctctggaaaatgtgggcatcctgtctcctgctgctcatagtatcagaatattcagaaagtacagtttataaatatctccaggagagttaaaatggaccaaaattccagagacaacattttgtaccatttctcattttgtgccattaattgctagcttgaattaattaaaataccaaatagagaacagctgacggaattcacagtctggtagagttgccagataaaatacaagacgtctagtgaaattttgaaatggctccattgtctggggtaaatagccagggttcattgtctcgcgccaggaaaacttaggacgcggacacacatgaggagcgggtttaggagtggaaagtttaatagacaaagaagaggagaaagaaagtttcctcattgttgagaaagcggtcgcccaaaacagtttccaggttggggtgagatttgactgattttatacagaggcttgaggaggcactgattgatttacataaggcccaggggattggtttgaccaggtgtgccatttacatagcttgcagaagactggccctcccatcatgatcttttattaagcaaatgtggcttctacctgcctgtctggctgtcacctgcctgtctggctgtcaccatgacatctgcatatgtggctttatctggccggtgccatgatacccacacatgtggtgacaaagaaaagggagcagggatcaccatattgaatatacctggcttccaggtacacctgccgacatttacatatgcaagcttctagcttgcatatctatgcttgcaacttgacttttcaggctgctttctgttagaaaagaaatggtttggggctgctttttattaaagggaaatttcactgagaacccttttaccctctgtaactgcctaagataatttcttaataactcctgtattaatttcagtttcaaataaacagtgaatatttatttttaatataagtatgttccaaatactacatgggacatacttatgctaaacaaattatctgtggttttactgaaattcaatttcaactgggcatcctgtatttttatctgctccacctggcaagcctacattctggttataataaacacataaacttccatttttaccactgctcgcctaaccattcataggtggcatttctcacctaagaagcaatgagaaatatttaatatttgtcttgactttcatcagagagaaaagaaatgagaaaggacagaagaaaattttacctacatgattaacatttttgccatattagggcagtcagcgattttccacttataattaaaatctgctcaactgagactactgggcccttcagaaactccaagttcttttctatggttgagaagaaaaagttggggatggcagggggaagatggcaggtaatcatgaaatggatatgattttctcagagactaagactgcaaggtggacacagagcagagagagaaggtataagatatatctaacagaggttaagatagtggctttcagatccagcaattccactactaggtgtatataaaaaggaaatgaaatcagtttgttgaagagacatctgcactatgtttattgcagtactattcacgatagccaaaatatggaatcaatggatgaatggataaaggaaatgtgatatctgtacataatggaatactatttagccttaatacagaaggaaattctagcatttgcaacaacatggatgaaacagggacgttatgttaaatgaactgaaccgcacacaggaagacaaatactgcatgatctcacttatatgtgaatctaaaaaaaaaacaaggtcaggtgcagtagctgatgcctataatcccaacactttgagaggttgaggtgggcagatcacttgagaccaggagtttgagactagcctgggcaacatagcaaaaccccatctctagtaaaaacacacacacacaaaaaaaaattagctggacttggtggtgcatgcctgtaatcccagctattggggagactgaggcacaagaatggcttgaacccaggagacagaggttgcagtgagtcaagattgcaccactgcacttgagcctgggcaacatagagagactctgtctgaaaatcaacaacaacaaaaacaatgaactcataaaagcagagagtagaatgatggttaccagcagctggggtcatggagaagagaggttggggagatgctgatcaaaagatagaaaatttcagttagatacgaggaataagttaaagagatctactgtaggaaacaaaaagactggatgttttttaactgctaaaatggaaagatggctttttctccctcttaaacatttttttttgtataaattctggaataaactgacagggttctaattccaattccattatttcacaaatgtatggtcttgggtgagtcatgtaacacctccttacaccttggtttgggaacagtagatctgaaaattgtgtcagaattcagtaagtataaaaaggcacttaacagagcctgggacacaataaagattatataactatcagccattttatctaaactttggcttctcaaatgcatcctatagagtacttacaggtggtgatcctacagtccagctaatcttgatatgattacttgctgtatgactctagacaaattatctaacctcgataaactatgtccatcagtgaggacaggtgaaataacagtattttgatcatatggtttttgagaattttaactgaaataatgcatgtcactattaaaggcttataaatgttagcagctgttgttgaacatttttcttctttggcttccataatgttataacattcagattctctacttacctctccatcttttttttttttttttttttttttgcttattaccattcctggattcccacacttctccctgccccactcagtcagccctttgcactctcattctttgaataatagtttccagttgctgcttcagcccccacctctatgctggcaattcctaagtcttctatctgcagtcttcgtttctccacttgtaccacagtctcacacaactcccacgacctgaatgtgtttacttcagtgttgcattatcctctccaaacttccatgtccaaaaaaattctcagctcccacagctgctaattcctttgggggttgggaggaatgagcaactcttttcaatttccctgctgttggcaaacacagacattctctagtagtccccgagatcaaagccttggagtcatctttgccacatctatttctatcatccttcatgtcccatcagtcaccaaaatactagaccacctaccacacaccagggaaagagaagtaaaaagaaaatccgtgaaaacaaaaacaaaacaaacatcttttcaaagacacatctgacaggaaaacacaatttgtattatttaaaattattccccttttcccatacaaacaccctatctgcccttctcaagaggatggatgttggttggtaattgaggtatctttgcttgctgagaatagtcaacttcaggataaaggcttttgcatatttgaaatagtaagagtaggaagcacaattgagacagctgggatgcgctaaattgtgccatggaaaaaggaagagaaatggggtcaagtgggtggaggatgggaggtggagatgctgcaaggcaaggctgaggagaacatggcagcaacaggtagctgaagataaactgtgggagaaaacaaaagtacttcccacaaactcttgcagtaagaatgggacctggctgaatcctggctgtaccatttagcacctgcaagacagcaagcaaatccttcgacttaatgcctcagtttccttgtttgtaaaatggggaaaataatagtgtctacgtcaaagagttcttctgatgattatatgagctcaagtaaagaacttggcatggtgcctggtctataataagtgcatatattaatactaaatcatttattattaagaattctttgaggagtagatttgtctgtaggagatgtgacaaagtgctgaagtacagagttttgttctggttgataggggactttttcaaaaaatagaggtttcatttgaataagaatgacgtcaagttacaaacgttttaaaagagaatgactcggttgggtgtggtggctcatgcctgtaatcccagcactttggaatgccaaagtggacagaccacccgaggtccggagttcgagaccagcctgaccaacatggcaaaaccctgtctctattaaaaatgcaaaattagccgagcgtggtggcacatacttgtaatcctagctactcgggaggctgaggcaggagaatcgcttgaacccgggaggcggaaattgcggtgagcagatactaggccattgtactccagcctgggcaacaaaagcgagactctgtctcaaaaaaaaaaaaaaaaaaggatgactcagcaaatttcattcccaggtatatatgcaagaaaaatgagtgcaagtccaccagaagacacatttatgaatgcttacagtagctttatgaataatatccccaaaccagaaacaatgccaatgttcatttacaccaggatgaataagtaaactttggtttatttatacaatttataccatacatcattgaaaaatatgaaatatataaaaggaactattgctacacacattacgtggatgaaactcatagatgattaaaataaatcagatgtaaatgagcacatactgtatgattctgtttatataaagtccaagaaataaagaaatctttggtgacagaagttaggatagtagctacctctgcagaaagaggggaaccagtatagactggcaagggcactgagggagcattcccgggcaatggaaatattttagaccttgatctgggatgctggtttcacgggtgtatgcatatgtaaaaattcaagttttgcccttaagatatgtgacctttactatatgtatataatgccacagttgaaattaaaaagggggaggttcagaatccacacatcccttggaagtttttaacaagtatatgagcacattattctttgtagggcccattgcagctgtgtagatactgaggtgtcccctgcctctccttagcccatgtgaggagcacagagatttcacagccagaccccactttctagatacaaagacttaatttcatagtctatactcttaacaaccacatgctaacaggtagactcacagttaagaccgcacagacttatgtcccactgcccctatagtcttctccatctctctaagagatgtcccatccttccagttgttcaaagcaaaaaccttggtgtctttctgtcacatcctgcctccaagccaaaagaaaattctgttggctctaccttcaaaccataaagaatttgatgctttctcatgacctccttaattaacaagctggcacaagccaccatcatctcagaagcctcccaactggttttctgattctatcttagctcctacagtccgtactccacatggcaccaggacaatcctttcacaacttaggtgatcatgtcatccctcttcttaaaatcttccaataggccagacgcagtggctcacacctgtaatcccagcactttgggaggccaaggtggatcacttgaggcaggagtttgagaccaggctgggcaacagagtgagaccctgtctctacaaaaaataaaagaaaccaaaaccttctgatggcttcctatctctgggtgcttatctcattcagagtgtaagtccttaatcagttctactagggcttacatgatccagcgacacacactccaagtcaggctggcccctgatcatcttcttttcactcattcagctctggctacactgacctccttgtagattccagaagatgtttagcaaactcatgcctcagagcctttgcacttgttctctctaccttgattgttctttacctggattattcacgtgattcactacttcacctccttcagtctggggctcaaattgcacctgacgattagtggttaggtctcctctaaccattctaaataaaatagaatacccctgccctcccagatttcaccctgccaccccatcataatcccctaccctcccatctagcagttttatatttctccataggacttaccagctaacattttatatattcatttgtttattggtctgtctttcctctctccacctttccaagaatataagctccaaggggtaagtgatttttgtctgtcagattaactgtcatagatcaacacctagaatagtatgtggcacagaacagaaattcaatgaatagttgtgaaataaataaatatcccaggttccacattaggatacctggttattcaaatatgatgcatttaaacagtatgcatgaaatagttcctaaaatatgaaagagatgaaactattaaaaattatgaataaaaacaatattcaataataattatgagccttgcaaaaataaatattgaaatacctatctttacatctctgaataagtgaagctactgtgttcagaaaacagttgggaattcacaggtaatcccacatttctagctactttttataaaacactcaatggagccgtctggtaggaaattatctattagctcattgcccaaattcgaattgctacttataactgattaaagtgcttcatagaatgcggaaaacatcctgatgcttctgatatgagataggatatgattgaggcccttacattttggcttattatgaagaaattatcttactttcttattctgaccccttctgtaactgtctttatgctaatggtttgcaagcaaatatctacagctcttaaaactagcaaggccggcttcctgctgccacctgcctgagatgtgtcacaggctccttgaagtatccatgtgtgagcatggacatagagctagccagtgggtggagcagagagggtagggtctgggtggcagatgtaacttctctactgattcttgtttgaacttgggcaagtgattctctgcttgtcctcatctaaatgatcagtagattaaccttacacgtttgtggtagggattaagcatatcatatgtaaaatgaccaatagtgcctaatacttactaggcatctcattttttctcttccatcttccttcaaccctatttctcctcctgtagtcccagtctccaggaatgacaacaccagccacctggccacccaagtcaaaaacgtgcctacgtttcttaattcctcacccttccttttccacatgcagctgctcagcaatatatgttgattcaatttcttgtagcctcttaaatattctgttctgtaatgagaagtaattgtagtcacatgtggtcataagggtaaggccatggtctgataggattagtgtccttataagaaaggtcactggatagctctccttttctctccaccatgtgaggacatagcaagaaggcaaccgtctgcaagccaggaagagggccctcaacagaaaccagtcaggctggtactgtgatcttgactttcagccttcagaattgggagaaaataagtttctgttgtttatgccatcagtctgtggtattttgtgatggcagcccaagctaattaatacagattttggtatacagaatggggtgtgttgcaaactatacttgaaaatgtggaagaggctttaaaactgggtacaaggtagatagaggtcagaagagttttgaggtgcatgctagaaaaaaacctagacagtcatgaagggactgttggcagaaataccaggtgttaaaggccattctgaggagatctcagatggaaagaggaacataaattattggaaactggaggaaacgtgattctggtcataaaatgtcacagaaattgtctgagttgtgtcctagtgttttgtgaaaggcagaacttggaagcgatgaaactagatatttagctatgcagatttctaagccaagtgctacaggagtgtcttggttcctcttgcttagtaaaatgtaagaagtgagaaatgaattgaagaagaaattgttatgcaaaaaggaaccagagcttaaagatttggaaaatcttcagcctgcccatattgcaaaatatgtgaaggcatgtttggaagaggacaccaagagtgtggctagactatcacttgataacaaaggttatagaattatatcagcagaaatactgtcagtttgaactgaagaagatggagacaggacaaaatgaagaaaggctgtcagatttaaattctataggacagttacgatagagcgatttgactgcaaacaggaactattcttcaagaaaaggaaagaatgacttcaaaggtgattcatcagggctgcatccttggtttcaaagggtggggccacaactgtctaccactcttcctccacatcagcaggggtatgtgctgtcagactcatgtctggagagaaaattctaaaacaaagtactatggactgaatgtgtcacctccaaattcacatcttgaaaccctaaaattcccagtgtgatggtatttggagatggggcctttgggaggaaattagtttattagagtggagtcctcatgacaggatgagtgcccttagaagaacagacatgagagtgctctctttctcattctctctctctctctctctttctgcctctctgtttctctgttctctaccctgtaagggtacaacgagaaggcagctatctgcaaaccaggaagagggccctcaccagacactagatctgccagaacattgatctcagatttcccagcctccagaactgtgagaaataagcataagttgtttaagccacccagtttatggtactttcttaccgcaccctgaatggacgaagacacaaagtaaaacccagcctgcctgagatggctcctggtaagtaatggagctgggagaggagaaggatctgatgtaacttggatcttcatgtgatagcagagtaggcgggtgaggggaaatgaaagaaaactgcgaaaactgcaatttcctgcatttggcctcagctttctcaaatggaagttctaaaataagcaattctcgcagttggtgttagaattaaagaaaggataagtccacacaccagttagagaagttagtggcacaacctattctatctattctaacatatttctatctccaccccaacatcatcctcagaggtattataataggaatctgagttaatcaacatatagcaattggtacagccatctgggagggaaatcttgtagaatttatcaaagtattgaatgcacgtattctttgatctattgctccatgtctaggtatctatagaattgcacatgtttcataaatatatgttcaaggatgtttattgcagtgttattttaataactacaaaatcggggaaatccctaaatgtctgctgtacaaatggctaagtaaaatatggtacagtcacaccatgtatatatataatgattttaaagaattagaatgtacttataaacacaaaaagtgctttaaggcataatattaaataaaaaattatgtcacagaacattatgtagaatatatgcatgtgcatatatacttacataagaaacagatctgcaagaaactctggcaaacagttaacaacagtggttatttctagggaaagaagtgtttccagaaagatggaaaatcacctttatgttgttatatgctctagataatactgtattgtttaactttttaactctagtgtgtatttatgtatcatttgtgtatatatacatatatatatctgctatatagtgcctagcactgtgttctgacattgtaggtactcaataaatatttgttacatatgcagatgaatatttatcgaataaaaacaaacatgcattattactatagctgaagtatcatttccaaaagtgcaaaaatcacaaatcttatacaaatataaaatgaacacatatcaaagatttcatgcatttacaaatgagagaactagagatacattaaaattagttcaaatgggtttctgacttaaaatgatttatatcctctatcagacaaaattcacttacattgccatgaacaagaacgtggttatcagttttccacaaagcactttttttattccaacagagttgtaaaacagcctatttgatcaaagacaatcaaaggtgcatccccagctgggcatggtggtgcacacctgtggtccagctactccagaagctgaggtgggaagatcacttgagtccaagaggagttcaaggttgtagtgcactatgattgagcctgtgaatagccactgcaccacagcttgaacaacatagtgagactccatctataaaaaaaaaattgtgcatccccctatgaaatcaaatagtgcctagcaggccccctaggcatgcttaaggtccactgtaagaatagccagaaatttcttttgctcatttccaaatcaatttttcccaacactggtatgttaacaatcaggaggatcacttgagatcaggagttcgagaccagcctgagcaacatagcaagactcttgtctacaaataaataaataaataaataggttagcctggcatggtggtacctgcctgtagtactagctactagggaggcttaagcagaaggatcccttgatcccaggagtttgaggttgcagtgagctatgattgtaccactgcactccagcctgggtgacagagtgagacactgtctctaaaaaaaaagaaaaaaaaataaaaataaataaatatttgtcaaggattccacagttctgaaaaattggtttaatctacatatatacagatcaatactgttcacttattctcttaacaagatcaccaaatttgtctaaatttgctttgcaagtaaggtaatgcaaagctttgccttatgaaatctcaaagtgtccttgaataagatgttctggaaataacttggcaaaacctaatcgaagtaaatcattgtggcatttgttctttaaaagcaatagtacagaacttacactctgcatggtatgttgctgaagcccagtttgttaacaaaaacacaaaacaaaagaacaccactgctgtattaggtctttcttaagcatcttaggttaacaaccagtcctggtccaaccaaagacactctaatagatttcctgttctaggattttcccaactgtctggaggccacagtctttactactcccattcaccaactcctcccagttaaatgcataaaaatgcatcaaatgctaaatggtaaaatgcataaattattattgttaaggggaaattaatctccacaataatttgggatattagtataatttggggggcaaatcaatgacatttctgaaaatacgacaaaaatattttttagtaaatcaaactatgagaaaagagacaattgcaacaaacaataggtatcaccaaaaatatgtaaactttaaaagtcttttttaattttcaggaataaaatacattcaccagtgaaataatttttaaaacatattattgactatatttttcaaacaaaaaatgaggcctcatatagtctaggaaatttttttttgctatgagaatatatagatgtgaaaaagttttcaaaataaaaaaacatatatagttacatatttaataaatactcttcactgaaagaaaaaagtacatataattgggactatctggaaaaatccaagatatgtgatcttcctaacaataatctttagagtgttgtacttcatagactcaattaaatcatttttaaaatgcaccatattttatgtactgtgaagaaaaataaaatggccaataaaactatttcttattgcatcaattgtaagacacactgtgattttagaggagttaaaacataaataagtaggatgtcttagaggagaagtatagtgtttatctcttgtaaaagatataaactaaaacttttatttatctgattagcaaggctcttttcacagaaatcttaggctattattgcattttaccagaatatgattcctcctattaaactattattaataataaagagtttgcgaagaaaaaaacctaagtaagaaaggattagcaattgcaactgtggcaaccagtgactggtgcctacctcagtgacagagcaagctgtcatgtcctgttccagtggatctagcaatggtggcctcaattgaggttttaggaataattttgactgtaatcctgactgttgcttgaaattccttgtttctcccagttttctatgctgtgttcttcagttcttccaagagttctgtgaacttcttaacatcctttcaataagttccttgtctgcccaactcaaccagaatcagtgttttttgccgcatgctttaactgatacctctggatttctgcaatttgttgaagagggataactgacatagtttgaggcaaatcagtgattcggcccttctaaagacagttaccaatctcttccacttctccaaatgatatcctctaaatatatatatatatatatatatatatatatatatatatacacacacacacatatatatagccatattcaacaataacaaaatacttgaaccatacagtataaaaagctcacatatacccatttttaaaagcacaatttataaaattatagaagaaatatgttgcctactttacaaagaaattaaaacaaaatttaatttgcttagagctactaggattcagtgaagaacctagaaatggaaggaattccacagtcgtcatattatatacaaggtagaagagtagtaactgatttcagttaataatggggaatgccaaattcattaattgtactacctcagaaggataaggcacaaattaactaattgggtaggctgatttctttgtacttgtttgcaaagtctctctaccccatttcataatttctacctacctcaccaaagcaatatcagcatatccttatttcttcacagtcctctggggtgttgcagtttagcgaatttagaagtcaaatattgttctcctcaagaaatgtagctttcaataatatgaatgatagtaataagtaacacttgtgtggtgcttcacgatggccagacactattctaagtattttacatatattaaccagtttagtcttcataagaatcctaggaagaaaatattaccttatcctaattttgcacaaggacactgaagctaattgcctaaggccagtaggtggcagagctgggatttgaactcaggctagcttcagaatttatgtgcctgttataacaaactaacccccacccccagctttagaagttgcttgtttctgctgctatatatttgtactacatcatggaccaggcagattttgaagtataaaacttaatataagttttatacttatactaagtataaaaacttagctttcctttctaaccctttacatctaagcctcaggttttcttccttgtaaaacaggagtaatatttgttatgcctagcttgtagattgttgagtagaagaaatgaaataatgcatgcgaaagtgctttgtaaagtgttatgtaaagaattattacttaaattatgaaggaacatgtcatttaggatatagcttcagctgtgtttgatgaaaatgttgctgaaagcaaattaggtcacagctagattcaagctatgattcaagctaggttcaagctatgactcaaacccagggttcttggtatagaaactccatacttctaactacaccatagcactc

SEQ ID NO: 562 - DNA, 20001 bp, Homo sapiens
cagagtccctgaagtccattgtatcattcttatgcctttgcatcctcatagcttagctcccacttatgagtgagaacatacaatgtttgtttttctattcctgagttacttcacttagaataatagtcaccaatttcatccaggtcaccgcgaatgccattatttcaattacagacatttatttctcacagttctggtggctagaagtccaaaatcagggtgtcagcactgtcgggttctggcgagggcccttttcctgggttctggcaagggccgttttctcatgttgtggacttctagctgtattctaacgtggtggaaggagaggataagagagatctccagggtcccttttgtaatctcattcacgaagcctccactcccatgacctaatcacttcctaaaggtcccacctccaaataccatcacattggtggttaggatttcaacataggaattttgggggaacaaacattcagcccctaacaaggaagagagagaaaatggaagattgcgtgggacaatttctggccagatctatctagaagtgcattcatctctcttttttttttttttttttttttttttgagatggagtcttgctctgttgcccaggctggagtgcagtggcacaatctcggctcactgcaaccaccgcctcccgggttaaagcaattctctgcctcagcctccagagtagctgggattacaggtgcctgccaccacacctggctaattttttgtctttttagtagagacagggtttcaccatgttggccaggctggtcttgaactcctgacctcacgatccacctacctcggcctcccaaattgttgggattacaggtgtgagccactgcgcccggcctgtgcattcatctcttttgcctacatttctttgaccagaactcagccccattgttccaccctagttatgtgaatagctgagacatgtgttcccagcaggagaatgcattggcaaaccacagcattacctctaccatgtggactttttctggatcctgataatgttttaagcagtaggagtagaatatgattattattttaggcctctagtctatttcattactttttaccacataaagtgacaacctcaatacctaaatttagtattgctttgtattgttgtgtaacaaattatcacagatgtacaccatcacccaattattatctcatagttctgtacatcagaagactggcatggcatggctgtattctctgcttagagtcttacaagtcagaatcaaggcatgcttttctggaggatctgaggaggaattcacatccaagctcattcagcttattgcaggattctgttccttgctgtgaacctgggactgaggttctgaattatttggctgtggctctttccatcttcaagccagcaatggtgtatcaaacccttctcacctttgaatttctctgactttgtcttctgcttttaagggctcaggtggttaccttgggcccacccaagtactccaggataatcttcctgttttaaggtttaactgagtcataaccttaattacatctgaaacgtctctttcactatgtaaagttacatattcatggcttgtaatgccaggggtcaaatgtcactgggaccaaaattctgcctactacaccaggagtatctcacagagacagccttccttctattttcactcattttccaactctgtcaaagacccaagagaactctagcctctcccaaatgcagccggaagtaccacatgttaccagttttgctcctctgtttgattacaggtgtgtgtggaagagtgggctgctctgtctcaccactggctgggtgggtgaagaggggatgggagcactggggaggggtctggcactgtaggttgtggtggtgagtgacactactgtggttgagtcttccttcttttaaaaatcaaatgtattatactatggggctgacacacgttctttaatgccactctcgctcatattctaacccattggaccaataaattaaataaaaaagatctaaaaagaaaagcactcttttgttaacactagataaaaactgtttcaggaattctctctctttaaaactcactttctacatacattcagatcccaagaagtctctagcaacttgcaaacctcacagtccaaagtattggatatcattggtttttctcctctacccaaatgcagatatctgagagggtgcgctggggacacgtatctgacatattttgaggagagcttattaacaaaattacagtgctcataggcaagagtaatgtgttacatgcttctttgtaactctaaaaagaaacttatcatcagagtgagcaggcaacctacagaatgggagaaaatttttgcaatctatccatctgacaaagggctaatatccagaatctacaagaacttaaacaaatttacaagaaaaaaaaccatcaaaaagtgggcaaaggatatgaatagacacttctcaaaagaagacatttatgcagccaacaaacctgaaaaaatgctcatcatcactggtcatcagagaaatgcaaatcaaaaccacaatgagataccatctcacaccagttataatggtgatcattaaaaagtcaggaaacaacagattctagagagaacgtggagaaataggaatgcttttacactgttggtgggagtgtaaattagttcaactattgtggaagacagtgtggcgattcctcaaggatctagaactagaattaccatttgacccagcaatcccattactgggtatatacccaaaggattataaatcattctactatacagacacatgcacacatatatttattgtggcattattcacaataaaaaagacttggaaccaacccaaattagactggataaggaaaatgtggcacatatacaacatggaatactatgcagccatcaaaaaggatgagttcatgttccttgcaaggacagggatgaagctggaaaccatcattctcagcaaactatcacaagaacagaaaaccaaacactgtatgctctcactcataagtgggagttgaacaaggagaacacatggacacagggaggggaacatcacataccagggcttgtcaggggatggggggctaggggagggatagcattaggagaaatacctaatgtaggtgacgggttgttgggtgcagcaaaccaccatggcatgtgtatagctatgtaacaaacctgcacattctgcacatgtaccccagaacttaaagtatagtaataataataataaaagacctttccaagttgctataaactataggggtgacaaaactctactattttcttagggtctcaactgggcttgagaattaaattgacataagagagattaacaggagaaaaacatacaaatgtatttagtacaaactttttgtggcatttgagccctcataagtaaattaaaacttgaagaagcagagccaaacacttacatactgaattggacaaagagtagtaaattgcaacaaagtggtaaggtaaagggccttgggctaggttagtcagttgggtagagaagtggctgggaaaataaggatttgcgtaacagggtttgttttgtgccgagttccttggcttcaacttcccatccttgaccataagaatgttgctttcttttctagtacagggaggacttttttacatgagaattttgtctcctgtttttaagaaatagcatgaaggttagagtgatctcgcatctgctgttctttttttaagtgcctttaacttcaatatgtcagagcagcatattttggggtggcatatttttaacaccttcagaacatattagcaatttgctaaattcttgctgaatgaaaggatgaatgaatgaataaaacctgaagtgtagttcaactgttgcaacattataagcaaatgaaattgaaaaagacagaccatgtaatgaggtcaatgtgtgtaaggaaagctattcatgtcagaagaaagagcaggttcacatcacatattgcgactgtggtttcaattgttatgtctaaactccagaatgacttgttataaaattctgctttttgtgttctatgcctctagtttatgttttaagatggcatcacactaactgcttcccataaaaagagtattctcatagaaaaacagtgttttcatagatagataattatagttgtttgaattgtctttcaaaactagacacaccatttgactcaaagttagaaatttatgttaagaggtaaatacggaaaactaaatctaaccttctgttactttatgtagcagggagtctgcttctatgccctactgatcaattcagtagaaaaacgtttgctaacatagtgttgagtggcaatgtaactaactacctgagttttttgttttccaccaaatggttttaagattctaacaatacaatgaagatgtttctatttttaaattgtacacaggtattttgaaacaatttgaatttacataacagttgccagaacaggtaaaagaatgctatacaaataaataataaaaacaaatgaatattaaaataataaataaataataataaaaataaataaatagaaaactgctatatctctttcacccagattcctcacatgttaacattttattgcatttgcttcatcatctacactccattaatcatcagtctctttctgaacctttgcagagtaagttgcagaaatgacattccatgacccctgcaaattccagtgtatcacaaaggtaatgacactgtcacataatagagcctataacttgtcaaataaacatgtcagcattgatacaacataactatctaatccgaagatcctgttcaaatctcactaaatagccctacaatgtctctttttcctttttgattcaggattctattcaggaaaaagtgttgcatttagttgtcttctctgttaagacaccaagttggaatagttcccactctttatttgcctttcatatgcctgacagttttaaaaaatagaagccttagattctgtaggatgatcctcagctttggtccatctgatgtgttctcatgatcagcctcaagacacgcattgttggcagggataccatggaaatgatgctgaaccgttctcagtgcatcatgtcaggaggccggtgatgctaacctatcctattgctagtgctggtaacctggatcacttgctcacgttgctctctgccagaattctccatcttaaagtcaccatttttccctttataattgatcagtatttgggagatgtatgggggtagttattctgatactgtacctcatctaatcgccactcaccagctatggcatccattaacagtttctgtcttgatcagccccctctatagtggttgcataatggttgttctctatttttcacatttaatagctgacattctgtaagaaaaaactttgtcttctcctccatttatttacttattccttaatttatttatatcagtatagactcatggatttctgtttcatcatgggtcatacttcattaataccattatttattttgacttaaaaattgttcccatcttggtcagtgagagccctttcaagttggcttttgtaccttctggatgtgtgcccatcatgcccatcattctttttttttttttttgagatggagtctcgctctgtcgcccaggctgaagtgctgtggtgcaatctcggctcactgcaagctccgcctcccaggttcacgccattttcctgcctcagcctcccaagtagctgggactgcaggcgcccgccaccacgcccggctaatttttttttttttttttttttgagacggagtctcactctgtcgcccaggctggagtgcagtggcacgatctgggctcactgcaagctccgcctcccactcctggctaatttttttatttttagtagagacagggtttcaccatgttggccaggatggtcttgatctcttgatccgcttgtgatccacttggcctcccacagtgctgggattacaggcgtgagccaccgtgcccagcctcaagaaactgcctttttttttttttttccagacagagtcttgctctgttgcccaggctggagtgcagttgcgcgatctcggcccacggcaagctccgcctcccgggttcatgcctttctcctgcctcagcctcccgaatagctgggactacaggcacccgccaccacgcccagctaatttttttgtatttttagtagagacggggtttcaccttgttagccaggatggtctcgatctcctgacttcgtgatccgcccgcctcggccttccaaagtgctgggattacaggcgtgagccaccgcgcctggccacccgtcattctttagtatttatgttctttctgatataaaaagatattctagactcatcttgtgttttttatttttgccttcagtcctagaattagccaatcaatgcctttcctgaggaaagaggtgttctccaaggagctctaatttctttcagaggagagtggtatttagcaagacatgtgtgatttggtgtactcaaatccatttgcctgggatcttgactttagtacctacaaatcaggccctaggcaaggcatttaaccttcctgtgcctcagtttcctcgtttgtgaaacagggataaaaatagttatcaccttatgttattgttgtgagacccaagtaagttcatccatgtaaagctcttagtgcttagcacatactaaattctcagtaaattctaactattattttcagttgaggtagggttactttcctcagtttattcaaggataaaacaacccagagccccggaaatgtaacatgctccttggactttctcagtctcatttcctcaaccagacatttagtaggtcatagtcatttctaaattgaggcttctgtccagggttagaagtacagctattgtgtgtaattgattgatgatatattgtttagttaccaaataaaaaggggcaaagatttttttttttttttgagatggagccttgctctgttgcccaggctggagtgcagtggcacgatcactgctcactgcaacctccacctcctgggttcaagtgatgctcgtgcctcagcctcccgagtagtggggattacaggcacacgccaccatgcccagctaacttttttaaatttttttaaagtagaggtggggtttctctgttagccaggctggtctcaaactcctgacctcaagtgatctgcccgcctcggcctcccaaagtgctgggattacaggcttgagccaccacacctggcagggggcaaagatttttaaaaattcttaagaaaattagagatccagacagttttcttgttcatatcagcagacatagcagaaagcctctgtcctcagaagagagcctatggatttggacagatgtctgcacgggaacttgatggagactccagagttccacttcctaatgtgacaaacccacaagagaggatctgaatgataatggcatcaatagtgtgcctagtgcatgaaaggaagaatggctcaaagaagaagagtgcctgaatgaaggccaccttgaattttctgtacaatgtatctcaagtagttgagtgatctactgagtagggtcctttagggtcattcacttttacactgattaatgtctatcaaaattctgttttaatctttccttgacagtgactaatcaagagacctggtcataccttaaaactgttcttatttcattacaggacagagaagtttgttttcttatgtttcatgaggtatttttttaaataaaatctgtaattcacatttaaggtttttaaattatttaaaagaatgttcttttctgctatttttgtgtgtgcctgtttaaaactctcctatatagattttatagtgcaaatcagaatccttttagacatgcaattttatattgtgctgactaagccaaagtttgtacagtcatctgtatccttttactgtttttatcctctgacatgattttagataatgatgaaaaatagacctgccgaaaacaacaccaacatttctgaagagtgaattaatcccttcctgtttgcaatttgggtatcgttggtgacattatcacatatcttcaaacttggaagatgactgtggtatagcttcctgcctcctccaatacagcagccatcaatttagacaaaatacagacataattatgtccctgaaaaaacagaaaggatggtaaatttctcttacaagtgagtgaagacccaggcctcccaaatttagccagctttctcttgcagggactgattcttgcctcatctgtttctcccacagaaaacacatcctttgacaaaagtgagagagtgttttgtgggaaaaaaaaagagatccaagaattagcttactttgtgtgaaataatgccttcctcgactgcatgcatcactgagatattgatttatgttttttactttgacagtttaaattttagatagaaataatttactttccaggatatctttttgggtatagtacagtgtcttttaaacattctccatgtaagcatgtcaatttgcctgaagttcccctgtccctggatcaggtgccggcatgcatttcctctctctctgccagcctgctgctctcaccctcccaccccaccaccagatcagaggagggctgtggtcccaatagaggtgctcaattcactgatcctttggaggaggtaacagaagcagtagtggcaggagatgggggtcgaaggaaggggcatggagccagcagactgaaaaatactaccgtgggcttgcattcagcagtgtctaccttgtgaaccatatcagagctggactccaggacactgatatgtaattacctattctgtagggaaaaggaaagactcagtatcagtaataacaaacatgcctattgttcttttctggttacaaaatatttttacacatataatatttgattctcataataactttgtgaagtaggcataaaaggcattcttattagtcatgcccctttgcaaatgagacaagcgaggttcagaaagtttaaatggcttactaaaatacacaaagctaagaatcatcatcaccatagcagctaacattgatctaatccttattatatgccaggcactgtattatgtgctttatatggatagtttttttatttttatttttattttttgagacggagtctcgctctgtcgcccaggctggagtgcagtggcgcgatctcggctcactgcaagctcccccttccgggttcccgccattcttctgcctcagcctcccgagtagctgggactacaggcgcccgccaccacgcccggctaattttttgtattttttagtagctatggggtttcaccgcgttagccagcatggtctcaatctcctgaccttgtgatctgcccgcctcagccttccaaagtgctgggattacaggcgtgagccactgcgcccggcctatatggatagttttttaaatttaagatagcaaactgcaaaaccaaaacccaaaaataggcaaagctctgtatcatttctactataccaaacagccttcttcaacagtaattctcagacacccaaaagtaagtattaggaagtccaatacaaaatttaaattcccagaaagcaacagatcctataactaatatcttatagttaggcctactttaagaagatttttgagaaaatgatttatttaaattgactatcctttccaaattttttcattcagttttctattacattgacacatcttatgatttcacaaaaagtgggtagaaaagtgtagcaaacagctgccctcctataaggttgcccccatcctttagcataaaacaattcaggcattcaacatgaaaaagttcaattattcaaaggtgcctaaaataattttatagttgattatatgaaggcatattctctctgctgagactgggttatctacctaaatacatattggaactgctcatatagttttctgatagataacttggcacattttctttggattttagtgtgttcaaacgtttataatatattatataaaaagagaaaaaactacacttcactaagcatgagctctaagtgagtaatttaaatctgagagcattttgctttcagagtaaacacattcgtagcaaacatgctccctgctcccaatcatgagccagtggcagacattgctagttgctgaaaacatttgttccttctaaagcaggactcaaagcagcatcaaagcttgtactctaatcggctattactgatcattcacagttggcacctgtgaagaaacctagatctgaataaggttggtggattgtagcaaagtcaatatccctgttgagatattgtactgtattatggttttgtgagatgttaccactgggggaaactgggtaaaggatacacagaatctctctctattatttcttacaactgcatgtgaatctacaattacctgaaaacaaaaagtttaattaaaaaaagaaatctatttgtcacttgagatttgcaatacatttcaatgaaaatctgtttgatgcatttatggaatgaccattttaattaaatgacaatttcagagcaggtaaaccactgggacatttggttcaacccttttatttcaaaatgaggaaataaggctaaggtggccgggcgcagtggctcacgcctgtaatcccagcactttgggaggccgaggcgggcggatcataatgtcaggagatcgagaccatcctggctaacaaggtgaaacaccgtctctactaaaaatacaaaaattagctgggcgtggtggcgggctcctgtagtcccagctactcaggaggctgaggctggagaatggcgtgaacccgggaggcggagcttgcaatgagccgagatcgcgccactgcactccagcctgggcgacagagcgagactccgtctcaaaataaataaataaataaataaataaataaataaataaataaggctgagggaagttaaatggcttttgttgtgatgcctgaatctatttacatgcatgataccttacatggaacagagaaataaactgacatttattaggtgactgttttgtggcagacgctgtgctaaggggacttacataaatgaacctgcttgacttccaaatacttctcgtaggtgttagtctcattttttttttttttgtctcttttttttactttgagacggaggcgtgagccaccgcgtccggccggtgttagtctcatttgtacctctgaggaagtcgaagcttgctgcgccatgacattaactaatgatagagcctgtattcaaactccctgtgctttcagagcagttagctctctcctacaccacttttcaaacttttccactacaattcactctaaaaaatattacattgtgacccaaatacacatgcaaactgaaacaaacccttaaaaatatccttatgatgtgtgatgctctagtctgttctgtcctattctattctattctattctattctattctattctattctattctattctattctattctattctattctatttaaaaataaactaaaattgattttataattcattaatgggttgtgacctgtattttaaaaaacacagcgtgctattttctctttactatgccacttccactagtactttggaagaactcttcatgccatccaatagtccttttttcagctttgctcagatctttcataccaaaattgaaggggatgttgtcttggtcagcctttggttatttaaattcataatagcatatgcaaaacattgtagcagattctttctgagggcttaaggcattttagtcccttcccccctcttttctctctctcttcctgaccacatccctgtgagggggaagatagaccctttaaaattgaacactgtcattttctgaactgatggatggtttgttctttgaggagactccaaggccgtgtctataagaggcaaaagtagacaagttatccactgatttacatttggcttaaaaccttctgtgagtgggtgtgctgggtggtagtagtggtagagttgggctgtgtgtcatttaccctggcaatactccatgggatagggtgagcttgggtggcctgccattcctaactcatttcctggtggataccatgatatacctattttacatttgaggaagttgaagcttgctgcaccgtaacattaactagtgatagagtctgtatttagacctgcatcatccacgcacagtcttccttgggtgatgtatatcatggccttcaatttcttagctctctgtgggattatattgagagcctaggaataccaggggtctgtcagtggttatgttagcttttgacaattgttggcattgatttatccttctgggtgttaggaaaagggttgaacacttcatgtgcattaacttgttgaatcctcacagcagccatgtgatgaggatgctattatatcactttgaattatcataaaggctaggctggcttttgtttagtaggttatttgaagggtagaggagggttgaattagaaaatgtgatgacaaaggaagtggtagaggtgagatttatacacacacacacccacaacacacacacatcaaaaataaaatattgaatggtttgatgtccaagtaaagcatgtcttgcttttttctttttctgtccttgatcatcttggctctgtcatcatctgtgtcagccaacattatgataatttaaatcctagaatgttctatgctggcttttcttatttagaaacgatgattgaaattggctctgagatctgagcttgttttgtaatcactggcaaactcagctttcttgtggaagatattttagtccttgctgagcagtgtttctcaaatattagcacacacaaaagtaatctaggaagcaacttaaaatgcagattcctggccaccaagatatattgtgatttaataggtcagaagtgagtctctgaagtctacctttttaacaaattttgatttaacagttggaaccaaggtgattcaggtataaattatctaggagccacattataaaaatgcttattcaacatattcccaaaacgtatgggggaataacccatatttggggcctgccttttgcctccttcttaatatctatatttaaaatgtcttagaggtcagtcatggtcactcacacctgtaatcccagcacttttgggaggctgagaggggtggatcacttgaggtcaggagtttgagaccaacctggccaacatggagaaaccccgtctctactaaaaatacaaaaattagctgggcgtggtggtgcatgcgtgtaatcccagctacttgggaggctgagacaagagaatcacttaagcccaggagtcggatgttgcagtgagccgagatcgcaccactgtactccagcctgggtgacaaagtgagacttcatctcaaaaagtaaataaaatgaaattgttttagaaaggacttcaaatatggtattaaagacagcagcaataatatttataataaccatggataaagagagttcagcagtgcttcagaactatctaaaagtgtcctcacagatacaccctcccaagactaaaacagaaagaggtagaatccctgaacagaccaataacaagttctaaaattgaggcagtaattaatagcctaccaaccaaaaaaagcccaggaccagatggattcacagcagaattctaccagaggtacaaagaggagctagtatcattccttctgaaacttttccaaacactagaaaaagagagaatccttcctaactcattttatgaggccagcatcaacctgataccaaaacctggcagagacaaaacaaaaaaagaaaatttcaggccaaatccctgatgaacattgatgcgaaaatcctcaataaaatactggcaaaccgaatccagcagcacatcaaaaagcttatccaccatgatcaagtcagcttcatccctgggatgcaaggctggttcaacatatgaaaatcaataaatgtaatccgttacataaacagaaccaatgaaaaaaaccacatgattatctccatagatgcagaaaaggccttcgacaaaattcaacagcacttcatgctaaaaactctcaataaactaagtattgatggaacgtatctcaaaataataagaactatttatgacaaacccatagccaatatcgtactgaatgggcaaaagctggaagcattccctttgaaaaccagaacaagacaaagacaccctctctcactactcctattcaacattgtattggaagttctggccagggcaatcaggcaagagaaagaaataacgggtattcaaataggaagagagaaagtcaaattatctctgtttgcagacaatatgatcgtatatttagaaaaccccattgtctcgccccaaaactccttaagctgataagcaacttcagcaaagtctcaggatacaaaatcaatgtgcaaaaatcacaagcattcctatacaccaataatagacaagcagagagccaaatcatgagtgaactcccattcacaattgctacaaggaaaataaaatacctaggaatccaacttacaaaggatgtgaaggacctcttcaaggagaactacaaaccactgctcaaggaaataagagaggacactaaaaaatggaaaaaattccatgcttatggataggaagaatcaatagtgtgaaaatggccatactgtccaaagtaatttatacattcaatgctattcccatcaagctaccattgactttcttcacagaactagagaaaagaactttaaattccatatggaaccaaaaaagtggccatatagccatgacaatcctaagcaaaaaaaaaaaaaaaaagcaaagctggaggcatcacgctatgctacctgacttcaaactatactatactatactatactatactatactatactgtactgtactgtactgtgctgtgctgtgctgcgctgcgctgcgctgcgctacgctacactacactgcactgcactacactacactacactacactacactacactacactacactacactacaaggccgcagtaaccaaaacagcattgtacgcactaaccaaaacagatatatagaccaatggagtacaacagaggcctcagaaatagcaccacacatctgcaataatctggtctttgacaaacctgacaaaaacaagcaatggggaaaggattccctatttaataaatgatgttgggaaaactggttagccatatacagaaaatagaaactggaccccttccttacaccttacacaaaaattaattcaagatggattaaagatttaaattttaaacctaaaaccataaaaaccctagaagaaaacctaggcaataccattcagcacataggcatgggcaaagacttcaagactaaaacaccaaaagcaatggcaacaaaagccaaaatagacaaatgggatctaattaaactaaagagcttctgcacagcaaaagaaactatcatcagagtgaacatgcaacctacagaatgggagaaaatttttgcaatctatccgtctgacaaagggctaatatccggaatctgcaacgaactgacacaagtttacaagaaaaaaacaaccccatcaaaaagtgggtgaaggatatgaacagacacttctcaaaagaagacatttatgtggccaacaaacatgaaaaaaagctcatcatcaccggtatttagagaaatgcaaatcaaaaccacaatgagataccatctcacgccagttagaatggcgatcattaaaaagtcaggaaacaacagatactggtgaggatttgcggaaatagaaacacttttccactgttagtgggagtgtaaattagttcaaccattgtggaagactgtggcgattcctcaaggatctagaactagaaataacatttgacccagcaatcttattactgggtatataaccaaaggattataaataattctactttaaagacacatgcacacatatgtttactgcagcactaattacaatagcaaagacttggaaccaacccaaatgcccatcaatgaaagactggataaagaaaatgtggaacatatacaccatggaatactatgcagccataaaaaagaatgagttcatatcctttgcagcgacgtagatgaagctggaaaccatcattctcagcaaactaacataggaacagaaaaccaatcaccgcatgttctcactcataagtgggagttgaacaatgagaacacatgaacataggaaggggaacatcacacactggggcctgttggtgggtggggggaaaggagagggagagccctaggacaaatacctaatgcatgtggggcctaaaacccagatgacaggttgataggtgcagcaaaccaccatggcacatgtatacctatgtaacaaacctgcacattcagcacatgtatcccagaaattaaagtaaaataaaaaaataaataaataaaataaaagcgtcctcagccagacctactcaatcaagacactgatcccttgcacaaatgtccctattgatatgtaggcttttctgcctgtgacagagattattagtgctcatccataactgagtgctcctccacatttcccagcttctcttggagttgggttggcctgtgactgggttctgaccatcaaaatatggacaaaagtaaagaaccacttccaggcctgatctctacattatccagcatagtcttttatgcgatgtgtcttctgttctccatctttcatgtatgtgatgccagggtggcctcgaagctgcaggatggtggaccgacaagatggaaacagcctgggccccagagtcactgactaaggagagatacctgggtctctattgaattatgacaagagcaataataagcctttattatactataagccactgaaattttggggcttatttttcttggcttcatagtctatccttacagtgttactaacaactaattaataatcataatagacattcttcctttactatagcagaacagactaattgtaactgaatcccccagtgggccgataacccatcaggatgaagcctgagcaatcctgccgttgccccttcaaaccaatagcccacacaggactattgcagtcaaacatttgctgaaaagcgctaaaagacggtcttgtttcacatgcaaggaataattacccactttttcatctgtgaaaattttctggccttcttgcatcaaactggatcccaaaacaaacttttttccttcatctccagaagattatcaactccgtcaaatgtcagaaagagaaatggtgttcatgaattaaatgattcttatattcaacagctggtacatattcaaaaggaaaatacaaagtaacatggcatctaaaggatcaaaaataataaaaacctaagaacttactgctctcattcttaaaatttcttaagaaggcagtcataaaacttggcccattattttttctataaccttttaacactgattttattttctaacctgagaaaaattttttctttctgtgtgtgttggagtatctcaatgttttccagttgcacatcatgacctattaatgggtcctaaaaccaatttagggagttgaaactgctacaatcagcattaaaaagagaaacataatataaattatcaatgtgtgtcacacagtaatggtattacatttcatgaaaattgttgctgatgcacacacacagacacacacacagagttgattcttgttactaagaaattatggtccgtaaagttgccttgaacactgaattaactaataccgaggaaatacagagttagggtcctacaagcctctagttatgacatttgtgtaagttagaaaccatccttataaactttataaaattaatcagggaagaagagagtgggaaatgaaaataagctaagcttgcagcacattcagcattaaccatgaggtcatcttgctctctgatctatttttcatttgagttattcttccagtcctgcataccaatgaaactactgatgtcagctggtctgaaggactccacagaagctgactcagtaaagaatgtgatttccacatactgatgatttcatcccccttaccccaaccaatcaatgaccccaattttccttccacaatctctttaaaaatcctagcccagaactcctcagggagatgaatttcagggtctcattccatctccacattcagcaccctgtgatcattgaactctttctctgctgcagatgctgctgtctcagtgtaacttgtctgttactcagtgtaattggtctgttgctgtcacagggggcatgtgaacctattggtcttatagtaaattggtcagtatataatcttgttttatgtctgttctttttaaagacaccttatttaatatatatgtgtatatatcatatatatatatatatagttgattcattaacattgaactcactcacatagcactataactcatgcctgaatgaagctcatctaacaagtctatgtttttctgtgaggcacatcacagccttcttgtgcttttaaacactagacagtattttagcactatgttttggggccacttcagacagggaaatcaccaaaaaaaatgaaagaaagaaagaaagaaagaaagaaaaaagccaaaacaaagaaagtggtattaaataaactgcaaaaaggacacttgtttaccataggagaactagaaaccagaaggctgagtgttaccttgcttgaccttagttgggaacatccacgtagggctactcaaattttttgctgctctgcacatgagaatattcctgacttaccacaaaatctttgcaagtattttggattacaagtaaatgttaacaagtaggcagatgagcaaatatggaatctgtgaatagtgaggattgactatatgtatatgtatatatacggctagccttccatatccatggttttagcatccgtggatgcaaccaactgtgatagaaaatgtttggaataaaatttaaaaatacaacaataacaaagaatagaaattaaaaaatacagaataacaacgatttacatagcatttacattgtattaggtgttataagtcatctagagatgatttaaattacactggaggatgtacataggttatatgcatatactatatcatttttgcatacaggacatgagcatccacagattttggtatctttgggtggtcctggaatcaatcctcagaggatagcgagggataaccctacacacacacacacacacacacacacacacacataatattggattgtgacataaaatgtatttcttactgtgtcctatgatttaaaaaaaagttggaaaagcactactgtaatgtttccatttttatcttattttcctaagtccttttctttgtctaaaaatttttatgaattagtgtattgttttgcatgtagggacaataaactcttcctagtcttggaaaaattatgagaaataatgttctaactgcttcaggaagcttgattttatatttctgttctgattgtgtgccatactgatgccagttgaaaatcagtgaaaaccttttcagattaatttattttcttttaatgtctttcctctcaaagctattggatactgagaggttgacttatctaaaagcagaatgactgataaatgaattcagtaaagtttcagcttacaaaatccacatacaaaaatcagtagcatttctatacaccaacaatgaattagctaaaaaggaaatcaagatggcaatcccatttacaatagctacaaagaaataaaataccgaggaataaatttaaccaagaaggtgaaagacctctacagagaaaactataaaacactgatgaaagaaattgcaaaggacacaaacagatggaaagtcatcccatattcatgaattggaagaattaatattgtgaaattacga

SEQ ID NO: 563 - DNA, 52540 bp, Homo sapiens
atttcatgctactacttagaaaataagtgaatataatgaatcttatttgaacaacttataatgtatgaagacatttagagtgcatctaaatttaccaggaatagttttttttttctctccttcctccaattctgtataatgtttaatggtgaataaaagcactgaatttcatttttacttactcacttttgtcatgtattgaaggaaacatttatctatcatactacctgtaggaacaaataaacacatctctagatataaaaatataaataaaattatttcctggaaaaatatttctcattcttattcctgcattaattccacagatgtttattggacaccatgaatcacttagcactcttctagggcctgggacacagcagtaaacaaaacagacaaaaatctctcatagagatcacaatttagggcaaacacatatgtaatgttagatagtgacaaatgctaaggagaaattatacagcaaggaagacatgacttgctgggaagatgaaattgtagatcaggcaattaggaagaggctgaacacatgcaatgttcaagttttcagattacactcatctagggcacaatatttaaatcattgataatgaactggaatatttctcaaattatgttaatagatagcaaaaagagttggctttcttgttattagatgtaagaccatacaggtagcaaaaattacttatataatagtttcctgattggggtttaggtctttccattataatttaactgcagagattcagaagattagagacttttataaaaatgagtctctcaccagcccattgcagcattcccaaaggatgctgtgatgtttaattttaggtgtcagtgtgactggattaagagatacccagataacaggtaaaacattatttctgagtatgctgtgatgatattttcaggagagattggcattggaatcagtaggctgtgtaaggggaagaccaaccctcaccaatatgggtgggcatcatccaatctgttgcaggcccagttagaaccaaaagtcagggagaagatgaaggcaaatctactcactcttttggagctgggacttctatcttctcctgttttcaggtatcagaagtccaggttttcaagcttttggactcagactgaattatatcaccagcatccctggttctccagcttacagatggcagatggtgggactttttactctcaatcattgtggaagccaattcccataacaaatctcctgttacatctatctatctatctatctatctatctatctatctatctatctatcatctatccatcgacctatctaatcacctctctctctatatatatgcatatactatatatatatatatatatatatatatatatacacacactatatatactatatatatgtgtgtgtgtgtgtgtcttattaattccatttctctggagaaccttggctaatccatagttttatggaacactacaattgtgggaatcaagagacgtttattcattaagagtgctatagactgaatatttgttaccctcccttccccgaaaaatcgtatgtcaaaatcctgacctgtggagacttcgggagttgaagtccatgaatgggattaatgcccttataaaaagagtagagagcttgcttcctctctctcttctgttcaccatgtgaggacaaaatgagaagacaagatggttgtaagccagccataaagagggctctaatcaagaaatgaatctcctggcacctttatcttagactttccagctcccaaaattgtaagaaattgttgtttaacttacccagtctatgataatttgtcatagtaggtggaactgagaccaatagtctatgtaatcaatgattttcctttataatttgcatgtatatgttagatgaattattcaattaatctatatgtacatgtgcagatttttttaaaaattgctacatgagatgattaatcataaaagtagctttcatattctacgtggtctatttagtaactagatttaagtgtaatggactttatcttaaaaaatcaatatgctattttaatattattcagcctatgccatatattaaacagcattgtggcatataaattaaattttgatgatatcttgcatcagctttgaagaaatttttctgtctcttttaagccctagctttttgcacctttttttggttatctgaaatgttctgttaatgcaatagaatttaaaaggaaccaaatttcacaaaagcaatagagattagtaacaatgctactgaacatgaacattaaaacttgcttctatccaatttgtccttttatttctgtatttttgattggtgcatatcaagaaaaaaatagaattgtacaggccacctaaaatgatgagggcgtgaaaatcgaaaacttgtagtttgattaaaaggagaggatttaattgttattccaatggtccctgactccattttcttcattaacttctatcaactaattattaactatatatttctattctccagagttttccacattgaaaatattcatacaagtttgtgattagtatgtgggaatcacaaacatagctgattaaataaactacaaggaacaaagttagaagatgcatcaggttttatacctgcatgtggtaaaaaatattagaaatcaaaagacttaggacagatttttctcatgttctctaccaaatttgtctttccagaaaagtcaccttttcctgcagtattacaaagaaagaaactaaactagttcagaaggtaatatagaaaaaaatttctattcctattatattactataaatatataattatgacaatattttcataaaataaatttatataacactttagaatcaaataagtggttttaataataagtgcttttaatcttctaaaatggtttaaaataagtggttttaatcctcataaaatcttttgctgtaataagatagtcttactatgctgacttgatctagattacactgctaataaatgccaaatagagataaattcttttttcatatcaacgtgctggtcatgagtctttcacctatttttccaattagtttgaagcttttcatcctggcacctgaagttctaatcatagtactcatgaacatgatcaaaataaactctatggagttggttattcatatttactcctgagctcttggtacagaaatctccatgattagaaaagtactacttaattagaagtgttggtggcatatcgcatttcatattgtatataataagaataaataaaagttatttaatcagataattgtaaagtctcagggtgtgatggacataaaggtcatcttatccaatcatgcagtaagacttaagacatatatgcaagtaaatccaagttatattaacatacctgccctttatttaaaaaatagcatgcttttatttgacaagaaactctttaacctttaccagaagaagtagatggttttagaaaaatatttttcataaattgaattaatatggcatctagaagaaagattagtatttaaaagtaatatataaaatgaaacatttatcatttatctattatatttgtgaaactgtttgccagttggactctcattatgtgaatgcaaaacgtatctttgcctttcccctgacatttgctctctggtgaggtatgtcacagtaaggtctgagccttctgtgaaacttagacatggcatcaatagactggtgaagtatgtaaaatatactaagtctctcttatccagtttgtttccattttatttcctgataagtacacttcaagttctgcaattttttgaaacttattctgcctcttgatctaactcattctttcttatcatcttccttaagacattaagcaccccaccctgtcttaactttcaaaactggcaccttcctaaattaaaaaactaatctgaagcttcctgttaaatggaagaagattagttacgctttttttttcttcctaattaatttatatacttttaaaggtgagcttctatcttattggtagtgtccattttttaaattcaattttagaagctcagaaatttagctggggattggataatgctcaggtttagcacatctatcttggcttcttcaaaacacatcacataggtaacttccctttctgcctttgttgtcatcattcaaacataggttttatcagaacatatggctctatgaagtaaaggaaaattaggcaaactgtgagaaagagagatgtttaaattcttcttaatcctacttccttttatacttagtcttttgcttgataaaatattcaaaataacatgttcatcaagtctttttttttcaagttattaatgtggtatgaaacttaaacttttagattcattgtggcattcaataactactggacataattttgtaattattttgaaagctttctttgtaatacatcttatccattttaaccatcctgttagaagttctgaaaagtattaggtttttattgtgataacttgattaatttcagaggcttatacacattttggtatgatctaaatttatattaatattttacagataatgtcatttttagtcagtgtatatagtaagtagcctttgccaaaaataatgtcttgggtttgatttattatatttctgattagaaagggaacatatatatcatatgtatgatatatatgacagataaatttgtatgaattagtgggtgatgatttaagttctgaagagacgttattaaatttactatgcatagaccttaattcaatatttgatagagaaagtaatggagatttttgtagttaacatattcatgagagtaaatattcatgagtgaataacggatgtatatatttcagtaataaaaacagcattaaaatagaaaatcatgttcaaagaaaataatcactttatattgtaccttgcattacagatatattttgatatctccacaatgtttgtgacaaaattgtaaagataccaaagacctcatggatttggttcactctggagaatcatattatgttcctcagatatcatttcttaaagagtcacctaagaaaataacttgacagtaacaaaagattttttcagaacaatctctgctggttgtttttcagaacaatctatatttgtcattttttttcattttggtgaataagaattactttaaaaataatagtaaatcttaagtagtaatgcagccaccctcattgttgagctgtctaattatacatactctgatatgctctgatttaaaaattccttcttctctaccatcaattaggtcaaagagtttatatgtattatgtcaatttctaatgaaatttggagactatgctaatcatattacttaagactctgactctagttggaaaaataaagctataagatatttaaaatactcaaaccttttcacttctgggaaaataccagttgaattatgtgttcttggcagcacatctaaatataagaaatgtaaattaaatgggaatatcaacttaataaactaaattaattagggcatgtgagatagccttcggaaattctattttaaatattgccagaatcttgattcttgatttattaaaacattctaaataaaataaagtggtaacatagatatcagaaagaacctccttctctctgggtacacacacacacacacacacacacacacacacatttttacaacaaatgtcattatttattttgatgtttttccagaaatcaaaacactttcagaaacaactaagatataaaatacatcataaaatgagatttgtatttatttctcacataaagtgaaaatattctcagaagttgtttttgccaaaaccaattaataggttacacttttcctattctcctaataaagtcatctcctcctgtctcaggctctagcccactcagggccaggggaaacaagaacaaccactagtattgagacatgctgctgcagaactgatttcgacgcacttggcctcctcggtcaaccccacttttcacaaaccaaccaaccaaccaaccatggccacagagaaactttgacttgtccaagtgtcatttgatatggctgtcatactgcattaacaggaagaggggcatgcaccaagaaacaaccctgccgaggttaaaacaccgagacaaagaagttggaagtctgtagggcaggcccatcaggaagagactgtgcagagcgccgcagaaagaaactctgcaagaatgagccaaagctgctgtccagaggtggaattttcccctctctctaaaagcctcagccttgctttacggaatttccaatcatttaagtctggcctactaaagataatacccctatgtaaaagcaattaattggggactttaataaatctgcaaaatcccttcacagcagctcctagattagcatctgactgaacacctaggggtgccagcctagccaagtctatacatcatgaagccatcacagtgcccatcaaagagcctattatactttattttatctctaaatttttaacctgtgaaaatgtgaaagactatttgttaattttgctcagggggttaagggcttgttccattgtatcctgcccacattttcatgtattctttctcttttggatatttagatcaaacacagattcagacatttttagagtgatgtggcaatatactgattcaaattatcaagtcatagatttttttttcttcttggtcactattttcatttgtagttcaaccatcattacactaaagcacaaggttgataaatagatggtcttaatgactagatcatttagaatacaaaggaactttagtaactgatgtatgagacactcacactaagttaatttagagtaaactataccttagcagcgtcaagtaaagatagggaaagaaaatgatgaaaggctcttaaatctagctacaaacagaacagaaatgcggaatatctattagcaaataggattttcgttgggattttgctgaatccatttgggaagaattgacattttactaatattgagactcatgagcaatgaataagatatatttcttcatttatatagttattatttaattccttttccataagtatttttattttttgtgctattaatgctatttttaaataattattttaattactggttgttcattgctaggaaatggaaataaaattgacaaccatgcatttatcttatatcttgtaaatatgctaaactcattaattagttccattcttttttttaagatccttcagattttctgcaaaaattattataaataaaaagagttttattcattgaagtctcagtaatttttatttttttatcacctgattgcaatggctagaactttagtacaatgttgaataaaaattataaaagtagacattgttgtcttgttctgatcttatgtaaaaataattcattttttccttaaataggatattagctatagggttttttttggatgtttttggccagggttaagaatttctcttctatttctattttgattaaatttttgttcttttttaaaattagaaacagatgttggaatttgttaattacttttaacaaataagatgctcatataaatattctatcttagtttgttaatatgtttaattacatttttgattttcaaataccaagttccatttttgggaaaaataccacttagtagtatcttatgttgtctcctaggaaacctgtaggagaaaatataaaacagtatctttaagagcttgggttgggcaagaaaaagcatcacatgtaaaagtttgataacttgaactacattaaaattaaagatttctgttcaccaaaatataccaataatattgtgaagcaagtaatgaaataaaaaatctgtacttctatccaagcaagaattcatactctataaaaataaaactaccaagcaaaaagtaaaagaaaaaaaatcaatttaaaaatgggccaaaacttagaataggcacattaatgaagaagacaccagatagctcaccatatttactcaatagttaattgcaaactaaacctagaaaattaaaaatactaataataccaagggttggcaataattcgaagcatctgtaaaactcatatgcttttggtgggcatgaaagtgaataaaacatctggactagttggctcacgcctgtaatctaaatttgggaggcaaaggagggtggatcacaaggtcaggagttcgagaccagtctggccagcatagtgaaaccctgtctctactacaaatacaaaaaatttagccaggtgtggtggtgtgcacctgtaatcccagctacttgggaggctgaggcaggagaatcacatgaacccaggaggcagaagttgcagtgagccaagatagcaccattgcactctagcccaggcaacagtgtgagactccatctcaaaaaaaaaaaaaaagtgactaaaactactttggcaactttttaattaatatccactgaagtaaaacatttgctttttttcttcactcagaaattctacatatattttacataacatatatgaatatttatctgttcatctatctatctctctaaggaaatgagtgcaaacatttatcaaaacacattcccaagaccattcatagcagatatattcaaaatatttccagaaacaagtgaattacctttcaaaagaagaaacaataaaagaaccaaggaccaaggtgtactatacaattaaatacaatacagcaataaaaatgtgactgcttcagaaaacaatatgaatgaatgacataggcacaatgataagaaaaataagccatacacaaaagagcacatattgtatgattttgtttcatgaagttcaagacgcaaacctaatataggtgataggtgcagaagagtggctgtgaaagtatttaagtatcaaagacatatatatgttttcaaaccacagatttatattattgcaaaattttgcagaatgaggactatattattttttgtaaaaatgaaaagctccaaagaggtaaaaacagtatgaacaattgtgtgtggacattacatttaatatatggaaaaatacaagtgaaagaagcatttaggtatgaactattaaattacaactttatgtaattaagtttaagttaggcaaaaatgtaattcatttggtgattattaccaaatgaatttcaccaaatgattatcaccaaatgagtttcaggtggatgatagtttgaaggtacagacttggagaaagtgtagaaattaaggatgccccaaaggctgagcatcaggaaccatatcaatgaccaagcactggaacatttgctcatagcctataacatccatactcctttctttgctgagtcattgcatagtggctaggtgtgtgggggacagtgattctgagaaacatcagatagattgagcaaggtaaaatatctggtcctaggcagtggaagtagggctgtggggtgaatctggtcgcttacacttttaattgaagacacagtctctcaccaagattacacacaaacaaaaaattagagtatttgtagggaatggagttagatgatgacatccttaaaatatcaaatgttcacaacaactgggaaacaatataaaatttaaaagagtaataaaatgacattaaattcaccttctgtttgaaatttgctttaactcttaaaatgcacagaggttaagaagggaatgcatgtttctgggttgagctaaacgaaactatttaataattttactttagaagatcacaattgccttttcaaaatgaaaaattgccctccagctttaaactattgacatgattataaaccattgaaagataaatgataatttagtggattaatatgtgcctaattaattggccttgataaatataaactatttagttttaacaatatagaaatacttttcctgaaaagcatattaaaaaaaaaaaacagaagcttccagtttatttattttagttttactctcttcacataccaacagctacaactttcctccctttgtggggtccccaaactaagtctctttccaggagaacagacacatgcctccatcagctctgaggactctgagggactccagactgtgagctgggttatggtctcccatattaaaagaggttgatagctctcacaggtctttgcctcatttatgtacaaaggctcagaaaatttcttcagcatttgggaccctggtgttctgtagctccaccgccactgcttgacttagtcaagtcctgctagccaagtcaacgattatctagagtccaaatgtccactgttctcttactttgctcttttgggccaacccagtgggcaagctgggcccagcagactctccaactgagggtcagtccagagtcagcttccaggtcactgaccaatcctgcagactacaggctttgttgttcttccctgacatttctcttgctcagaatccacagacataaacaccacctggaacagggacagccagagaatctattttccctcacagctttatgtgcctgctcccaacaccctttccacagaactgaacgctgcttgatgaataactggacactctaggactcctgtcggccacttgtactgaaagtcaaatctcagggacagttgtaagtcaagcttgattatcccacactgtgggacactgtgaaggttcatgtcaatctggggaccatagaaagcaccaactccaaagttcaggtctcaagagttctccaaattcctccagggtccattgaaggacctgtttagcctattcccaaaggcaatgctccctgaggaagccagatggcaaggtggacagtgccaagcagaagaagcagcaaaggacaacatagacatagtggaggaaatcaagacagcttcagatctctgcttcccactgatctggtgctgatcttccatcatcctattggaagcaccatggctgggtaagtctcccaggactgctggaggcctcagtcagttgtagggcctagaagtcaaccagttgcagtggtagcttcctccaggatctgagggggtgggtgaacatcaggcagcatgtagggcagtttatgggctgtagggtgtgtcttggggatgcctagagctgtcaggcctgtcagagtctggggctacaggggcaaacatgtctgccctttaattttcccagtgccctgaatgttccagagttttgtagagaacactgtggtgggcctactcagccttgataaataccagtaatgcagtatacacccttgtccctcgtggcaagaagcagcagcttccagggctcagttcatggaagcagaagagctcctgttccttcccaacatggcagtggtctgcaaatcagtttcctctctccatacctccaaggttttcacaaactctgctgtggagaactctttgcagtgtctctagagcttcagaagacctccataaagatgaaaagtttcttagcaacttcaatctttcaatctgtctagtatgccaaaggtggggactcagcaaaggtcaaccaatacgccatgcccatatactgttactgtcagacttgtgactttctcctggctcaggtgaagtttaaagtggttgtcttgaacagctggcaaagctgatataggaaacctctatcctacagaagaattaagcagagctgtaagttccctggaaatctgtggcaaagcaggcactctgagacgcaggttgtctgctcctttcttgggaagagattatggtaaaaaaacagccttggacggagaatagcacctaggaattgttcagctgctgcccacaggacatgggcactggagtgccagagcagtctttcccttctgaggaatggaatgtcagaaatttgaggtcagaattgtcttcaagagtggctccaaatcataaagttcttaattcacatgagcagcttctacagtgtctgccagtgtggaactgaactgcagggctaattggtaagggtttgtttcccatgcaacagcatccactttctggtttccaagaagtgatatattaatatgctggggtttcttctgtgctatgcttgctaacctctttacctaagaagcccatagctcctcaaaaggctaagccactctgccaatcagtatggaggaacagttacaactgccgtgatgtgtatgtagcccacatgcctgtaacttttggagtcagagtggacatcacctctgatacagcctcatgttccctgaaagatataatttcaccaacgttcagatatttataatgcaaaggaaacgtatattcatatctcatgaataaaaaataaacattaaatatttaacaactattaagaggtataaatctaagcaagtacttttgataggtggatgattaaaaacttatctcacttaaatttaaatacttaaaaattttattaacataaattaactacattttgtgtcaagatatcttgttttcatattttagcatatttagcatttagaaatgccagatgtaaaatttctaaaaaaattaacttgctaactcatagaagttgctaatttattttattacaaaaggatatggtgctaatttacaaaaattctaacaaattatattaatattattaagaagaagctacaatagaattatgataaccaagatggcttctgtcttagtccatttcatttaccaaaacaataccaaatattaggtaatttataaagaatagaagtttatttggctcatagttctggaggctgggaaatgcaagagcatagcatcagcatctggttagggccttatagctccatcataatataatgtagggcatcacgtggtgagggacaagagcaagagagccaaggaacgcttagttttataaaaaagccactcccatgataatgaatctactcccacaataataacattaatatattcatgaaggcagaactctcgtgaatctactaactcattaatgagagcataggtcacattaatccattcatgaaggcagagagattaggattctaacacatgaagaggacacattcaaaccatagcagtttttaactgttttatctcatttatctaattctaattcctttgtttaaatactgtggctagctcaagtgtttgtaaatgttcaattatttcatatttgtcttactctatttgagttgttaaaacacaataccataaaataggtggcttataaataaaaaacatctatttctcatagttctggaggctggggagtacaagatcaatgtgctggtaaaattagtgtctggtgaagttcaactttccagtttataaaatggcaccttcttactgtcgcctcacatgttagacagagaaggagtactatggtgtctctttgtaaagggcaataattccattcctgaaggtttaactctcataactaatcacttcccaaaagcccacctctttgtgccatcacattggtaattagagttcaacatataaattttagagaaaaagaaacattcagaccaaagcaatatttaagacaacaacttaaaatctcacctatatgtcttctacaatatgcaatttagatataaaatttagcttaatatatgagctgaaatactggtatgaatctctacctttgaacacgactatactagaaaacaaaatattccctgtattataaaaataaataaaataagaaagttattattaaaaaagaaggttattaagttttattattcttctttggttaagttcagtttagaaattcgaaagaaagaataagaaaaaataactattattgtcccttgcctattattaactaaaaattagaaaataggtgtgatttctacaatattttagatagagcttaacagttctcaaaaatttataaattaccgaataaatgaaaatattccaaaatttatcataacctgctattaaagcatacttaaaatagatggtatcctgctggttctcatgggcaccatcatatctccagtaatttagggtaagagatttagtttaattgctaattgcataaatgaaactgggtcatataatttactatttaattaactatataaatacaaatgattatgctacattttatatttttgcaagttactatgttggttatgatacttcatacttgaaaagaatattttatttttacctgaaaggaaattttgtcaaaaacttttttttaaaacaaaatttcaaatgatattttttcacatgcaccaactatccctctcttttccttttaaaatgtaaaataaatagagacttgaaggttaaagttaactattatttcatatgcatgtgtatataaatataaaatatgtgtatatattacataatacacacacacacgttttctgaaacagggtcttgctcttttactcaggctggagtgcagtggcaccgtcatagcttactgcagccttaccctcctaagctcaagtgattctctcaccttagtctcccaagtagctgggcctacaggcacaggcctccatgtcaggcaaatttatttatttatttatttatttatttatttttatttttgtagagataagatctgactctattgcccaggttgatcttgaactcccaacataaagtaatcctcttgcctcagcttcccaaagtgttaggattataagtgtgagccattgtgcctggccctgatgttaacttttagtcagtaaggaaaagtagcctcttcaaaattacttaaagccaaaagaaatatcattataacatgctaattttcatctttaatttgagaaacaaatgcaacgtatatataatagaagatacatccaccaaaataaaaaaatatattcagaagcttagaagttccatactatgtgctccttaagtcacatttgataagtttattatttccacagaggtatagtttgttcagctctatcttgacaaagaaatatcctgctttggaattactgtcttaatgaataattgcacagaatataaaaatagaatattatcataatgacagactaggaagtaactgattcatattcccctgtagcaacaagaattctgaacccatccacagaaaaaaatacttgggattcaggtagaagtttataaaactccgtggggcccaagacatagttgggtcatttcaagtgtgcaggttggcacccaagtggctgatctgctgattctacttttggttcaagcctaggaactgcctcacccctaagagctttgagcctgtagccaaaatcatctttcaagggttttaggagaaatcacacacattagtacattggtgaagaggctcatctgtctgctgacatttatcttgacagtaaacctgaaagttgccctgtggctaggttcctgctcccctcagctgaaatcctggctcagaactctaaacaaaaagacacaaaaggagactaactcatttctttcagtccaagtgtctaagcctgcatgatgggctcaccaactgccattccaaagcagatcctgagatggctcagtctcagctttggtcttttttgctgaagctggtgaacattctgcctgtacagggacctgctgagaaacatgcccatctgagtaactggaacagtcttctaggctaaagtcccggccaactttcccatacagttccaatattctcgcaatgtcaaactcagagtctttgtgagactcatgacaagcctagatttagagaatcctgtatcaatgaggtggctgcagtgaccacagaatcaggaaatacaataatagtcagtcggcttagaatctctggaagactctctgaagaaggacgggcacaaacaaagccaggcatcaaagattagaataaataccttattcctcaatgggcagacatcattgtacattcacaagtttcagaaacattcagggaaatatgacctcaccaaacaaaggtgatagagatgcacacaaaagtaatgacaatgtgtgaatttctcaaagtacttaaaataccctttttaagaaaactcaagaaaccacaagaaaacatatatagggttaattcagaaatttatctgagaaatttaacagaaaaaaattgaaataattaaaaagaaataaaactcaaattctggagctgaaaaatacaaagaaccaaatgaaatatgcaatataaaacatcaacagtagaaatgatcaatcagaagaatcagtacacctgaaggtaggctacttgaaaatacattattagtagagaaaaggctaaaaataatgaagaattctaatgagatatatggaacaaaatcaaaagatcaaatatttgggttattgaaattaaaggaagaatagggaaagacaaaaggttagaagcttattcaaagagataataatagaaaactttccaaagcagaaaaaagatataaatattcaggcataataaggttaaatgtcatcaagcaggttcaactcaaataacagtaccccaggacatacaataatcaaactgtcaaatgtcagaaacaaagagcctcttgagataagtgagagaaaagaagcaaatatgaggaatttctaatacacctcagcggaaactttataggccaggagggagtaggatgatgtatttggagtgctgaagggaaaaatataaaagtctgtcaaatgagaatactgtgtccagcaaaattatctttcagaaatgaaagatggataaaaacttttaaaaacaaaagcttagaaaatttattgctaccagatatttcctacatgtaatgataaagaatgttcttcaaactgaaagaaaaagatgctaaaatgattgttattttaatactgaaatcatggtgcaagcattctaatactgaaaaactacaaatattatcagtatgaagacaaaaagttcaaactaataaaaaataaaaataactatggtaatttgttaagaaataggctatgtaaaattacaaattgtgatattaaaatttcctaacgtagggggagaataaacaaagtgtacagctttttgcttgtttattttctttcctttgagattaaagttaagttgttatcagtttatacaagtatcaatttatacaaggaaaagtctgtacaaatacaaaagcttgttataattgtagaacacattttgtaagtctcactgtaaccacaaagcaaaacctagagtgtatgcagtaaacataaaaagcaaagaataaaaacatactactagagaaaaattagttaaccacaaatgaagactaagaaaaaaagaaaaagaggatctgtaaagcaacaagaaaacaagtaacaaaatggcagtagtaagcccttaactatcaataattaccataactgtaaattgattaagatcttcaattaaaagattgaatggaaaaaaaaaacaagacctaactataagctacctgcaaaaaattcactcattctgtaaacagactgaaagtgaaaagcaagatatacaaaaatccttgaaaattgaaataaaaaagaactgtggtctctatatgtatatcaaataatataaacattaagccaaaaaatgtaaaaaagagaagcggccattatttaaaaattaaggggtaataaaaagagtttaacaattataaataaatgtgtgagagataagagtacctgaatgtataaagcaaacacaacaataccccagagatattgcaggttcacttccaaatcaccacggtaaaagaaatatcacaataaagtgagaaacacaattttttattacccgctacatttaaaagttatatttgcactgtactctattaattgtgaaataatactatgtttacaaaaataatgtacatgttttaattaaaaatactttattgctaaaaagttgtattgatcattttaccattgaattaattgtaattttattttgctggtgaaaagatcttgtcttgatgctgatggctaaatatttctttgatcacatttgtttttgcagaagattggagtggctgtggaaacttcttaaaataatacaataataaagtttgccacatcaatcaaatctttcattatgaaagtttcctctgtagaaagcaatgttgtttgatagtagtttatccacagtagaacattttttaaaaattgatgttaacctcaaaaccttctgcttttttattaaccaagtttatgtaatatttaacatcctttgttttagccatgttcagagcattttctccaggagtagattgcatctcatgaaaccgcattctttcctcatccatagttacaactcctcatccattaaagttttatcaccagattgcagcaattcactcacacctttaggcaccacttctcattctagctttcttgcttattcccatcatatttgcagttagtttctccactgaagtcttgaatccctctaagtcacccatgagggttggaataaacatcttacaagcttatattaattttgatattttgacaccctcccataagtccaaagtattctgaaggacatctataatggtaaatgctttccagcaggtattcagtttactttcaccagatctgtcagagaaatcactctttgtggcagccatagcattaggaaaaaatgtatttcttaaataataagacttcaaagtctaaattgccccttgatccatgtagtagcagaataaatgctgtgttatcagacatgaaaaaccacattcatcttgtaatactccataatagctattggattaccaagtgcattatcaatgataagtcatatttagaaagaaaccttttctgagcagtaggtttttaacagtgggcttaaaatattaagtaaagcatgctgtaaacagatgtgctggcatctggactttgttgtaccatttataaagcacaggaagagtagatttatcagagttcttaagggccctaggatttttagaatggtaaatgatcattggcttcaactcaaaattaccagctgcattagtccgttacaagaaaatcaacctgtcctttgaagctttgaagccatgcattgacttctctttagctcagaaagtcctagatgacatctcctttgagtataagactgttttgtctacattacaactatattgtttgatttaccatgtggaacactatgaatttatatcagcacccaggctgttttggtttcttagcattcaggtgttcactggaaagcacttttaatttcattcaagaaaagttgggagatagcaaagtttggttcatgcggtttaaggaaaaaagccatctacataacacgaaagtgcaaggcaaagcagcaagtgctgatggagaagctgcagcaagttatcaagacatttttcttgacatttacaacttggctaaccgcttggtacaagggacctagcatttggtatatcttggcttttgacgtgccttcctcacaaagcttaattgaatttaggttttgatttaaagtgagtgacatgtgactttgtctttttttttttttttttttttttttttgacggagtctggctctgtcagccaggttggagggcagtggcgtgatctcggctcactgcaagctctgcctcccgggttcacgccattctcctgcctcagcctcccaagtagctgggactacaggtgcccgccaccacgcccagctaattttttgtatttttggtagagatggggtttcaccatattagccaagatggtctcgatctcctgacctcgtgatctgcccgcctcagcaacccatgtgactctttacttgaacacttagaagccattgtaggttatgaattgtcctaattttaatattgttgtgtttgagcaaataggaagggtctataagagggagacagatggaagaatgactggtcagtggagcagaacacaaacaacatttactgattaagtttgctattttctgtgggtaaaatttgtgatgcattaaaacaataacaatagtaaaatccaagattactgaatacagatcactataacaaatataataataatgaaaaaatttgaaatactatgagaattagcaaaatataacagacatgaagtgagtacatgatgttagaaaaaatgggccaacagacatgcttgatgctgagttgccacaaactttccatttgactgtttcagtagttgaaaagtttttgcagtgcacaataaagtaaagcacaataatacaagatatgcctgtgttaaaagtcctaatggaagaagtagagtgcaaatcagtaagagtagggcacatcaacattccactttcagcaatggacagatcatccaggcagaaaataaagaaaggtcagatcagagttcaagtgcactcttgaccaaatggacaacaggcatttacagaacgttagatctaacagctgcagattacacatacttctcatcagtacatggaacattctctaggatagatcatttgttaggccacaaaacaaatcttaacaaattttaaaataacaaaattattacaatgtaataaaactagaaatcaataaaaggagaactttggacaccttgaaaatacattgaagttaaacaatatgctcttgtacaacaaatggaacaattactatttaaaaaaaaaccttaaaacttaaaaatttattgaaataagcaaaagcaaaagctcaacataccaaagtcttgggatatataaaagaaattccatgaggaaagtttataacaatgaataccacatcaaaagattaaaactacttccaataaatgacttaatgctgcactcaagaacctagataaacaacagatcaaacccaaaattagtagaaggaaagacatgctaaggatcagagcagaaataaaatagactaaaaaaataaaaagatcaacaaagcgaagggttattttgaaaaaaatgcacaagataaacaaacctcgactaacaaaaaggagagaagtaaaacaatagataaaactagaaatgaaaaaaagacaccactttgctgctacagaaatacaaagaatcctttgagattattatgagcgactgtacaacaatgaattggaaaacagaataaataaatttctgaatcatacaacaaatgctgaagaggatataaacaaagtggaactcatacactgttggtaagaatataaattagtagagccattataaactacattattgaggttcctcaaaaattataaatagaactatcatatgatccaacaattccactactgggtatctatccaaaataaatgaaatcagcatgttgaaaagatttctgcaatttaacatctactgcagcattcttcacagtagccaagatacagaatcaagctcagcgtctatcaacaaatgaatgcctaaagaaaatgtggtatatttacactatggaatactattcaggcataaaatgaaaacttacagagatggctctgatttgtgacataatgagtttaaataagattagaaagcatacactgctattcgatttctactattaatttgccatacagtcctggaaaattcaactaatctctatgagtcttagttttctgtcttataaatagctgcagcattacttttttgaacctaatggaataaatgcaataaataatgtaaaagtaccttttaaaacagcctattttctaattttaataacaataattgtataattgctcataactatgaataatattatttgatcttttgcactgggtttcctttttcttccccctctttctcagttatgtacctagcacttaatcatcaaaaaagcaagtaagctccaagtggagctttggagtttctcagaatgcttctgtgtagtttttatgtgaagatatttgcttttccacagtaggcctcaaagcgctccaaatcttcacttggagctccaaagctccaagggtgtggtggctcacacctgtaatcccagaactttgggaggctgaggtgggtggatcacttgaggtccagagttcaagaccatcctggccaacatggtgaaaccccatctctacccaaaatacaaaaaaataagctgggcatggtagcaggtgcctgtaatcccagatactggggagtctgaggcaggagaattgcttgaacctgggacgtggaggttgcagtgagccaagatcataccactgcactccagcctgggtgacagagtgagactccatctaaaaaaaaaaaaaaaaaaaaaaagggaagtaagcaagataactctagtagtactatttgttttttttgtataaaaattcttatgaaaaatatttggaaaaatcttcccctgagtaaataactctgatttaacttaaaattgctctatgctattttgagaattctgccagattctggtagttacttttttttgagaacttcattaatttacttggataaaacaatatttatttttcaaaatctggtgccgacagaaacctcatgatccagatttaagtgaatgataacactgttgatgataatagaaataactacaattggccaggcatggttgctcatgcctataatctcagtgctttagaaggccaaggatgaaggactgcttgagcccaggagtttgagacctgtctgggcaacatagcaacatcctggctctacaaaaaataaaaagaaaccagttgggcatggtgacatacacctgtgatctcaactactcaggaaacagaggtaggagaattgcattagcctgggagtttgaggctgcaatgagctatgattgtggcaccacattccagtgtgggcaacagagtgagaccctctttctaaaaaaatcaaaataaaaaatgacaacaattttctgaacagttaggatgagaccgtctttatattgtgatctttcaattttcagcccgttaaaagacaaaatactgaggctcagaaagattagtaaatgtagaaaaaagcacagcctgcaagtgacagacactatttaaatgacagttatcttaactccaaaatttatactatttccactccatcatacatcatacttccttaacctccattcttgtgaatgaatagaattaaaaaacataaaaatgatgttatacaatataagatttatagttggtattaatgcaatcacttttaatctgtggaaaaatcattgtatcttataaagataaaataaaatttgtcaatcttgagtacacaactatgatagataataaattatacacacaaatattgtttcattaccaaaagcaaatttacgacttgcaccttccaattttcttaagacgttcaaatctgcatgtgatcagtagggaccctcctaatctaaattgtcatttttctctcttgggtggcttcatgggtctcctattgatctcaatgtttcctttcctgctacctcattcctttttccacatattcagtttcagagaatacaataaattaatggaagagcagcagagttatattttatatactaaatcaactcacatcaactcctcatggaaaacattcataccttgatctacagtcagtgtagcagtttggcctggtatgcctaggacagttttggtttacactatttcacattgcatgcctgtatcaaaacatctcatgtattccataaatatatacagctactatgtacccacaaatatttaaaacagaaaaaatacttgtttgttgatttacgtagacaacccatccccaagcccacatgtgaactgaccctgccttgctcccatcttaatgtttaccattttctcctgtgctgtcatatctgccacactgttgatgtctctggaacacatcgggctaaatttgctctcatcattacatttctaggatagttcttccttatattttataatgactttcttcttccaatcatcatgtctctgttaaaataaaacctccaaagcagactcttcttggcaatcatttttaaaattgctctcatcctgaacatttgttggtttcctattttcctttatttcttctggcatttattaaaaaatgagttttatttttattcttactagctgtttttcagcttccctcattataacatacgcaaatttatgagggaaagtattttctttcttactcattaatgtgtctcaagaactgatatatatagaaggagccagtcaaactagttttaaacatgtgtataataaaggatttagcaaaaaacagtaaattctagatttattctgctggctaaataatcaaaaagcatttcagatttacattgctaaaattacttctgagtctttaattttctttaacaatagaaagtcttttataacaccttccagtttttcattttcattttgttttatagaatcatttcttaatgccatagttattaacaaatatcatttaaatattatttttcttggcttataaaggtctttatcttacaaggcttagtaaatctaaaaatatactattattcctatatggttaggtcactcacaataccataatgtgataattatgcaatattcttgtaagattttaaaaggtaaatagtaaaatttttcccaaatatctataaaatatttattcttaatttaatgtgtaaaatatttcaagttggtctttataacaaatttatacatctttggaattacatggtgtttctttgtttggcaatagtgaaaattaaatgcttttgagtaaaccccccacagtaaaatacctaaaattgctgcataaagtataacaaacatcattttcattgattggttagaagtaaaactcacaaagccttagaagaacaacacataaaaactagaatggatgattaagacaggcacctgaagctgccctgatgatactggctgatagcaagacacagagccttaaaatttaaagctgcttggagacacgagcctttgtgttagcttacaagttgaggagggggaaatggaacttaaatacttgcatgttgcaggattccttgaagaaacacccttagcaacgagtaggctggaagatatctgtttgcaaggaaatggcgaaaataagctaagtgtaaatttcataattgtttctagattggaaagaaaagtccctactgagaacttggaatcagggtatggtcattatattcatggatttatggtttcaaattgcaatacttgcagaggccaggaaaccacaaactcagaaatgaatagcaagaggttcagttattttagcatcctgggacacctggaaaatgcaaagtaaaatcaactgtccaactacaggcccttaaacaggactacaaaagattatgcatcagacatatgaaaatttctcaaaatttaatattttggaaacatgacataaaaatttacgtagcagaattagaatttccaggacatttaatgttagaattttcagtacaaaatacaaaataaagcaagcatagatatgataataataataatttggcaaaagtaaatgaagaaaaaccatcattgtattagcaccaaagtgaacaaaaatgcagtagtgtatataagatttgaactgtagaattaagcagccttatgtacagacataatgtagaactctcatatacaaattacctaaaatacactcttcccagtgttgtatggaacaatataaaaaccatatattcatccataaagaaactctcagtaattttcaatgtcagcattatacttactgtaggttcttaatatcgctaaaaaaataattcacaaccttatagtcaatataaagcaaattattaggacaaagtaatttgctaacttttatagaacaaatatatttttaatatttctatatgtaattatgtgtatgtatttgactcagtaaaagtataaatatagtaatcttattaccatgatcatatttgattaagttctgtaagatctacctaacatataccagacccagagatttttatataatttccaacagatattcataaacagataattctactaataacatactatctcacggaacatcataagaggaaaaactagaaagactccacttcccaatggtacttatggaataatataccttgttatgaaaaatcaattaagggtattaaataaagttaatcaccaaccaacctttcttatgaacataagtgcaacaaatggtgtttgttttatagatggttgtgtgtcatttaatgatagagatacattctgagaaatacatccttagccaattttatcattgtgtgaatatcatagactgtatttgcacacacctggattgtatagcctactacacacttaggatgtatggtgcaacctattgctcctaggctataaacctgtagagcttgttattatactgaatactgtaagcaattgtaacaagtatttgtgcatctaaacttatctaaacatagaaaaggatacagtgaaaatattatttaaaattaggaatacactcttaaatgaaaaaagttataaatgtttattgaaagacatcaatgcaaacctaaatgtttacagcttttcagcaatagtatgttcatgtgtgaaactaatctattttaaatactgcaaacacttctattcgacccaaattataaaataatttataaacctaggcaattctaatcaaaataataatgatttatttaacatttgagaagttaatttatgtatttataagagcaactgacaaggatagacaaactgcaagaaaacaaacaatgatgcttgtggaaaaaaagagaaaaagatactttaagagctacagtaataaaaggtatgtgctgttggttgtgctaataaacagatcaacacaatagaaaagagggctcacataccaattcctaaacacagacttaagattcaattgaaattaccttgcactataatgggtaagggataactagtcactacatcagttagaaatgtttagttgtctactaaaattatacaaattcctacctcctaccatgcacaagtagcagtttccaataaatatatgcttaatgtataaagcacaattaaaaaatacaaataacttacaagggagcatcttaataaaatgtattaccagtaaagaaaaagaacttttacaaataaactggtaaaacatgatagaaaaactggctataacaaagctatatacagaaaaagtaaaccgaatcatcaattagtatatgaaatgaatcagctcatgtaaggaaagtggaaactgaaatacagagataaaagctcacactcaaaatatgggcaacactttgaaaatctgaaatttgaagatctaaaatgtggtgctgcttgtactgtaatgggaaagcctctaaactgctgatgcaaatataatttagtataaccccctatgaatactgttggacaagatctactggatgtgaaaatgccttttacttaattaccagaaattttttactcttaagtgttacactagtgaaattttcacagctgtacaacacaggaatggatataacacaatagtaaagattaaatggaacagagccagacatatccacatgggtataactaacaaaccaattttgagagaggaaaaaatgtaatttccagaaaaattcagagatcattgtaccagctaaagttttaaacatgcagaagaataatctattctttagggatatattttacaaaaatatacagaaacgtgttgaaagtataactttaaatatggtgattttcctttgatggaagaagcaataagaattctgaattgggaagaggaaatagacatctgaatatttaggtttagtagtgcatatgtgaatatttgacatatataggatgcaaaataataaatttactaaataatgacaaatacaattgtgagctgacatcttaattttctttcttagtaaaaataactccaccatcaaaccacctgattttcactcggggaagcaaccttcctctattctttttccaaggtgtgtcactgcctggacctggacttattacatcatcttaaagcaggttgtaccttgacctttgctcaagcaaagataatcattaagaactgacatcatagcatttcaaatacttggcacttagcatagcacacaaaatattagatacgcttattattaattttaatgttttaataactggtagagcaaataatccttaaaaccaatttccctttctttttcataattttcttaccttttcttgaatatttttcttataagcttctcacaaactttagaatctgcttttatagttctaaaagaccatgtcctgtattgtaatctgttgaaattcatttgattaataatggaagaatgaatggaataacgaaatgtttatgatattacaaagtgacatggcatgcttgtgtgtttctgttctatctctctccccttactgtgatccaaaaggtgctcatgagaaacttctgcttccaccctacgtgctgaaaacctgctgtttgaaacaagtatttgaagacaagactctcttccatttctctgatagctgagcaatcagatatctctttagatatcttttttacaactctgcttattcttccttgcacttggcagcttgtccttgtgaactgagaagaaaaagaatagagacctctcttcattctgttattttaaacttaaaattatcttactacttcttgcaacctcacacactgtaatattatttaataattacagagaagtaatagacagaatgtattccaaagtggggaaataataaataccaaatcacaaatagtttcttctggacctaacggagaaagtttaatgctactagagtatgtatggatatagtggtgatagtgggatccaatgaaataccatcttgctcttcttcatctccagcataatcaatgatgttattccaaagattagtgagcactattcaatcagaatgaatccaagctggcctaatcctagagcatgagaataaagtgattgtattgggcagaaatatgtgaaagttggagcatcctttgagagggtttggggtatgaagggcactcttgggtggtaggatttgaggacttattcagggactatttctcctctactaaagtatttcaataatgtatcaaccaccatagctataccaatgcctactggataaatataaatcagactgtgaaatgactaagattctctgtttccagatttctaaggtctttaattattttattaacatttcataaatttacagttaattttgggaaaagaaaatgcacattcatagatttctgcatggaaaaggacactttaaattagcattctaaattacatttagttatgcactgatatggttaggctttgtgtcccaacccaaatctcatctcaaattataacccccatcatttccacatgtcaagggagagacgcggtggagataagtgaatcatgggggtggtttcccgcatgctgttctcatgataatgagtgacttctaagaaggtctgatggtttaaggggctcttccccttttgcttggcacttctcccttctgccactttgagaagaaggtgtcttgcttcccctttgcctgctgtgataattgtacattttctgaggcctccccagccatgctcaactgtgagtcaattaaacctttttcctctctaaattacccaggtatcaggcagttatttatagcagtatgcaaacaaactaatacagtaaattagtatgacagatactaatctttatagggtgcttctatcaagatacccaaaaatgtggaggtaactttgaaactgggtaacaagcagagattggaacagtttggagggctcagaacaagacaagaaaatgtgtgaaagtttggaacttcctggagacttcttaactggctttgaccaaaatgctgatagtgatatggacaataaagtccaggctgaggtggtctcagatggagatgaggaatctgttgggaactggagcaacactgactcttgctgtgtatttgcaaaaatactggtggctttctgcccctgccctagagttctgtgaaactttgaatgtgagagaaatgattagggtatctggtggaagaaatttctaagcagcaaagcattcaagaggtgacttgggtactcttaaaagcaatcagttttatgcattcaccaagatacagttttgcaatcggaacttaagtttcaaagggaaacagagcattaaagtttggaaaatttggtctgacaatgtgacagcaaagaaaaacccatttcctgaggagaaattcaagcctgctgcagaaatttgcagacgtaacaaggagccaaatgttaattatcaagacaatgtgaaaaatgtctccagggactgtcgaaagtcttcacagcagctcctcccatcacaggcccagaggcctaggagttaaaaatggttttgtggatgacagctggggccttggagctttgggcagtcccgggacttggagccctgcatcccagccatttcttaaatgggccaaggtacagctcggtccattggttcagagggtgcaagccccaagccttagcagcttacatatggtgttgggcctgtgagtgtgcaaaagtcaagaactgagttttgagaaccttcatctccatttcagaggatgtgtgaaaatgcctggatgtccaggcagtagtttgctgcagaggtggagccctcatggagaacctttactaaggcagtgcagaagggaaatgtggtataggagcccccacatagagtttccactaatgcactgcctaaaggaactgtgagaaaagatccaccatcctccacaccccagaatggtagagccactgacagcttgaactgtgcacctggaaaagctgcagacactcaaagccagcatgtgaaagcagccaggtggggagctgtaccctgcaaagccacaggggtggagcttcccaagagcatggcatcccacctttgcatcagtgtgacctggatgtgagatatgaattcaaagaagatcattttggagctttgagacttgactgtcccactggttttcagacttgcctggggcctgtagctccttcttttggccaaattctcccatttggaacaggtgtatttacccaatgcctgtacctccattatatataggaactaaataacttgcttatgacttttcaggctcataggtgtaagggacttgccttgtctcagatgagactttggacttagacttttgagttaatgctggaatgaattaagattttggggaacctttgggaagacatgattgtgttttgaaatgtgaggacatgagatttgggaggggccatgtgtggaatgatatggttaggccttgtgtccccacccaaatctcatcctagattataatcaccataacccctacatctcaagggagagaccaggtgggggtaattgcatgatggggcgggtttcctccatgcttttctcatgatagtgagtgagttctctcaagatttgatggtgttataaggggctcttctccattctctcagcatttctccttccttttttcttgtgaagaaggtaccttgtttctataatatgtaataggcatgtaagtagtttcaaaagaagacttgcaagtctcaagtactatgaattaaaaatatgcaccatactcattaaaatctaatttattgccaggcacagtagctcatgcctgtaatcctggcactttggcaggtggatcacgaggtcaggagatggagaccatcctgcctaacaggatgaaaacctgtctctaataaaaatacaaaaaaaaaaaaaaattagccaggcatggtggtgggcacctgtagtcccagctacacaggagactgaggcaggaaaatggcgtgaactcagaaggtggagcttgcagtgagccgagatcgagccactgcactccagcctgggtgacagagtgagactccgtctaaaaaaaaaaaaaatctaattcatatgatactggaataaagagagccagctacccattaaaacaagataaacatattttgaggcactgggaaaaaatacaactgagcattgttgttagcatttgtggagattattctgtattattttaaaactacaattcaagctccattaaaacacattaagttataaaatgtgttttatataccaaacaactgcataagtcttatactttgaggaagaaaatgaaccatgaagacatggtttatattaaatcaaaaggagcacaaaactgccacttccaacctgacttttctatttcctacttgaaaaaaaaaatctatatgttttgatatgaaatggtctttctgtcttggcagtggctttccacatgtgatgtggaaatatgtgtattttaaatccctcagcaatcattttattattcatttccacaactcagatattctggtttcctctacaattgttaaatgattatgcaaaaaaatgattcaaatatccaatatatacttactgaaaaatatatatgagcttattacatagacacaggagagacaaagtggatacagaggtgacatgtaatgagatgacttagaaagaaaacaggtgttgattggctattataattacttttctttcttcatagtcacattatgaatcctatataaatgtacagttgagtaacaatatgaaagattgtcccagaaaaagagaggatcataagcttagggtaggaggtagagctgttgtatttgaaagtatgggacgttttcttctactctagaaggagacagggtcttgacaagtttttgtgagttttactctcatagtaagccctaaaaatgcttctacatcaaatccaagttttacattctttattactataaactgcccaaaagaggacatgcttaggaattttaccaacaatctccaaagaggttatcttcttcattcacacccctccttttttttcatttaaaattgtaagaccatatttttcaggtgaggactacttatcacacaattctcactatccgatttatgtttctattcccttggtcatccccaaatattttatctatgcattttgtatttcatagtctgtcatcaatagaatcaccttttacttttcttaatgtctcctttacttttgcattctaagtgaagttggttctcttctcagtattcctttgaccctgaattcccgttttgaattaacatttctaattttcttaaagataaattaacataaaacctggaattgatatagatattctcatttcttataattgatttcatgttttcctgcctctcccattaaaaagtctagctctactgagtgacaagctgaatgactgtgatttaccaaaacgtatttgttatctacctatcaccaggtcattcactcatattgattgaagttttctgttcttgttctttgtcattctctctaacactacctattaacatttgaccacatcctttctaacgataatagtaacctaaacatccagacaaaacaacattcaacacactagattccactcccttgacacttaaattccaaatgccttttcttctgtccttctttagcaactctaggtattttatactctagatactgccagtaataatagatccacaatcattgtcttttctatatttcttttttcttttctttccttctttttattattattatttttcctgggacagtgtctcactctgtcacccaagctagtgtgcagtggtgcaatcgtggctcactgcaacctccgcctcctgggctcaagcgattctcatgtctcagcctcctgagtagctgggactacagacacacaccaccacacccagcttatttttccatttttcgtaaagacagggtttgacatgttgcctaagctggtgtcaaactcccgagcttaaagccattctcctgcctttgcctcccaaagtgctgtattacaggtgtgagcaaccacgtccagctgactctactatatttcattttttttgtttccctatattttcatttccatcagtacatagccaaagcacaattgctcactgctgtaattacccacttcaagcattcttgactcacttgtccctgtctctattactcaatgtttttgatatatttaaacaatgctcagattcaattttcttcatgttttagcttttccctagtataagtaaatgtgtgtgaaacaaaactgttaaactaagaatcacaatgcaaaatgggtcgtcaacactgcataggttttcttgtgaatttattgtcccatttttcagtgtaacatttcataccttttcttctttcttgaacttgctatcaccaacttcctacattgtagcttgttacactatttaaaattttattaaaaataaatattatctgaaatatattaccaccccttccacagcattttataacccatttataaatttattcatatattttttatttcctcctattgtactgcatgaattttatctgttagggttatcaccccctctaattatgtactagataatactattccctctcacataattaaatttgtttttttttactgcaattatcccattgatattttaaataatcaatttttatttccctattgactgttcctgtccccataaaaacatgtttagaattttcctgtaaaaaataataataataaaatctgtacttcatatccctttttcaactactgccctatttctccccaggtttaaaattacacatttaaataatactgctattaataaaaatacctaattttttgagtgtttacagtagactctaggcatggtgataagtgctttgcatggctacctcatttgtctgtattcactttttcacttatttacttcttattttcccttgagcctacaataattaggctttgtttcgaagaagtctattaaactactctttatcaaggtccttaatgacttctatcttgccatatgaaatgtttaattgtggcattctcttcattttatatccaggcaacatttattaatattactattttctctcctttgagactctgtattcacttggtttttgggctatcccagacccctagttttccttcacctggttttcaacagctggttttctgtgtaattgacaacttaacttttcttttctcaattgaaaaaaacagagtatctgaaaatgaatcttggcttcttttatctacttacattcactatctagaaggtcatctaatatcagctttaaataatatttacacgttgttatatctcacttttatatctgtagctctaaccacgcccctgctttatatttctgtattcaactgcctaatatatagttctatttgaatgtttatagacatctgcactagaagctgctactgaattttaattattcttctcctgagaacatgaaagactacattacctagcccctaacatttgggaagtcccctatgaccacttcaagacaaaaatctgagaaaaaaaaatgcgtgtgacttttacacttaaacacagaagaatgaatgtgagatctccttgtattatgttctcctgcattaaagaatgagaaagctttctcaagatgctatggctactaaaaggtagtatctgctttcaccaaggccctacgttattgaaaaatttctgtgagagaaacttatcattgtacaaaaaactgttaagatttgggggtaaattaatcactgcagcataacttagaacacttctatgaatataatatctaaaaattaatgtctgaaataactttttttcttaaaaatatttattcttcaaactatctataattgtaaatgacatcatctttatccagttaacagatcaaacatgtaggaatcattcttcatatcaacatacagtctctcaggaaatcctattagttctaacttcaaaatattccctgaatcccaccagttttcatcactgccaccacagccacagccacactcatcaaagccataatcacccatgcctggaggtttgcaaaaacctcccaagtaatcacccttttcagtttgatctctcaaactacatttcctataaaacctctcccaatcaaaatataactgctcccacatacaatccctcatctattatcttctctacctaccaggatgatgtaatttcctttggatttcactcttgatcagcgtgctttaatcatattgattttcttgatctcaaacatgtaaaggttgtctctgtttgggggcttttgaagttgctgttcacacttctccaaagtctttgctggttcgcaccctcaaatgacatacctttacaaacacagacccacaacattcattactcccttattttgctttattttttctcgtagcatgtatcacttcatacaaatataaaagtatatatgcacatgtctgtggatgtgagtgtgaccgagtgtgtgtatgtacttctttgttgtcaagatctaaccttggattagaaactccataagagaattttttttcctccgttgtttataattttgttcctagaaatagaatagtgcctagaatacaagtgagtgcttagtaaacatttgttaagtaaaaaaataaattccattattattattctatatccaattccaaataatgagatatggttacagaataatctaaaccaatattattcagctaaacctttgaagttattactttctctatttgatatgataaaaagcagctatttattcctatgaatttaaattagaatcttaaaatgctgtgatttcacaatttgttaaataatagattgtttattctttctgttttctacctaaccacataaagcgttctatgcaagcagagagaaaatggttcagttcagctaagatatttacactgcatcatttatttatgcatgtatcattaaaatcaagttgtgatttgaaatcaccatcttcatgctttacaaaatcagaattgataatctgtgtgaaacaaattcagaaacagttgaaagctagaaatagaagaggaatcataccttttcaaatttctctgataaaagacttaaaataatatattatgcatatatactgctttaaatacttaaaagatgacatgattatatgttatccttacctcctggcatatccttaatccactgaaattgcagatgatttttttttttttggctaaactaatggaaacacccagtattttagttaccttacctctcattatttgatgctgctatttgcttattaaaatattctctctatggcttttctggcatcataactgtctcttactttccctccaaatgttctcatgactgctagtaaattgcttttactgagcaatgattgtgttcctcagagttctttcctgtgtttctttttgtgttctatgcttcacattcatcatagtcattctaggcaatcccttagctaccataagtttagtatatctatacagagtccacatatcaataacaattaaatgtccaatttttctattttgttcaaatgtaatattcacagcagtcaatctagataatttcttcaactaccacaagtttagttatacatcagcccgtgtatcaataataatttcaatcttatccaaatgtgatcttctgtcttctcttggatgtcctaaaaaatatagtatgattaatatccctaaattaattagcttccctctaaaccaatcttatcttccctttgttaacattctatgtgaattccataaataggcatcgacttcagctctgtttttccttcccatataaaattttgagcagttaattctataaacatgttactaattcaaactgtggtgaagaattccaacaggtaatatcagttctgtttttcttccagacatttaagttaaactttactgccccccatttgaagataggtcaaggagaccttataatatatttggttgtgttaaatacatttgggaaaatattctttctcagtttgtagtttatctgtttactttatgtaggtttcttttggtaaacagaattccttattcttcaaacattgtttattcttcatacatttatctactttttttttctttcatggttaattcttgtgtgttttatttattaactatatcagtatgtcaaagtaagaaactatgcacctataattgacaaataattttatcaagaaaaccggaaagatttctactgtttggttggctaatggaacactgcaaaatcatgaaatgatactgcgtaaaggaaaagacagataaaagcactgtacatatgaagatgtgctctaccacaccaataaccaaagaatgaaaatttaatgtatctaccacaatataatattttacacatattcaatttgaagaaattaagtaagctggaaatgttccatatcagaaagaatgtggatcaataaaatcttttttacaaccattttggaaaacagagtgtcattgtcattgtaacactgaaatatttctcacttcttgactcaaagtttctacttctaggtagatacctaaagacataattatgcatatgttgattggaaattatatatgaataggttcaaaacaaaatttgtaatagataatcaacaaagggtctttgataggagaattaataaatatgtggtatattaccaaagtacatatagtagctaaaatgcctaggctaaagctacgtataaaatatatgaacagaacttcataataattttgttgaatacagaaagcaaaccccaatgactatatataatataaaattattgtaataaaatccaattgttagcaagagtaaataatttatttaaatattttaaatccagaaagtataattaagacaaaatttaggatacaagttaaatcttgagggtaggtgggaagtagtgagaaaagaccctatacagaatccttttagctgtgtacacaggttaatataggctactggtgatgttgtagtcactggttgaatcttgcattcagaggtattcattatgttatttaaaatgaatgaataatttaattagtcaggtataaatgataaaataaattatggctacacatagactgatactgataatatgtcattaatgaaagtttaactttctttttatatatctgggtaatttttgttaaatggtatgttcggtgatacaaagacctgggctgtgataaaacattagatattaatattttcttcatcaattccattagtatttattttcttatataatcctgaattatcttccatatgttattcagtccagaaacacaaaaattatttacagctacttttaaacatgtttttttagtacaattttagattcacagcaaaattgagtctaaagtacacagagttctcatatgccacctgccccaacacatgaatagtgtttctcattatgaacatctcccaccaggatgagacatttagtacaatcaaactcctgttgacacatcatcacccaaagaccataatttacattagggttcacttttggtgttgtatattttataagtttggacaaatgcatagtgacataaattcaccatttaactatcatacacagtattatcactgccctaaaatttttctgtgctgcatctattcatcagtccctcccccaagcccctgacaaccactcatccttttactgtcttcacagttttgtgttttccacagtgtcatttagttggaatcatatagtatgtagccttttcaaactggcttctttcacttagtaatatgcatccaatgttcctccatgtcttttcatcgcttgacagctcatttctttgaagtgctgaataatattccactgtctggatgcatcatagtttatttattcattcatctactgacagacatcttagttacttccaagttttagcttttataaataaatctactataaaaatctatgtgcaggttttcttgtggacataagtttcaattcctttggataaattaccaggaagtgtgaatggtggatcatatggttaagagtatatttagatttgtaagaaactgacaaactgtcttccaaaatggctatgccatttcacactcccacaggaaatggatgagggtttgtgttactccatatatttgccagcatttggtgttgtcagtgttctggcttttggcacttttaatgggtgtatatgatatagaagttaagaagaaattatttaggaagatagtaagggcataggagtcctcagtaaggcttttccttttaatgaaaagcagcccaaaatcgttttctaacaaagagcagcctgtaaagttgagctgcagacatagacaagcaagctgggagcttttacgggtgaatgctcacagatactaaaaatcagacatgttaagatggtggctccatcttcctttccctgccagccatgtgtactatcaaaagcagacaagatagcactgatcaactacaaaacccatttgcataagaagattagggtggggcagacagctttccctacatgctatgtaaacatcaggccttatcaaaggaactgtgagccgtatggaaatcagatactgcctccccaaactagactataaaatttggaaaatttgccaccacctgatcttttttccacttggagaccccttcctatatagaggaagctgtttatctttctcttctcttctacctattaaaactctgttgctaaactcctcatgtgtgtatgtttccttagttttcctggcaagcaacaatgaacactagggtatataccccagacaatatagccacttcataatggggaacttgtccgggataccaaggtataacattcattaaaacagtgagtagagaagtggacgccaactctgtctttttcattttgaagcttttggcctccattttagaactgaattaaaccaattactggcccccgcttcagccatttaaaaacaattagcatggctgccagccttacaagacttgagggaaaggcttgctgaggagaacatggagaatcccctggtaaccacgggttgctgggcatattggccatgctttaacaagcttcttttcacagaggacttagccattgaatgggactggaagaagtcctgaggcaactgaggatttctggcccgggatacccccaagggttatccaaaggcctctggactgaccccagcctctaactgccttgatggggtgtcggcaacaggcaatacaatttcctattgtaatttccttctttcctgctcatgaccataatattccttactttctctgtgtatgcagtgttcaggaacttctacagttcagggaaataatcttgtttggtaagatcagggaatgtcgtagtaactggggatataactcaagggaagatatctttttttaattctagaaacagagggttctcccccacccaacacacacagtgagcatctctttttctctcagctcttggtctggagagcacatggcatttccaggtctttctctgtccttggtctggagagcactcaatgtttctaggtctctctctgtccttgttctggagcacatggcatgtgaatgtcactctgcccttggtctagagtactggtctacctactggaatagggatcctgtccatgaggcacattgttggtccttcactgaaacaccctagcctccaaatctctcccctttttgtgcctctctactggaaaccaggcttcaagctgcttctgtaaacgggaaaattctgacttcaacaattaggggtaaagtctcaatactgtcccatcagcaggaaaatggccatttggtccctacattcttttgaggcacatattctgcctccaattagagtggtacttaattggtaaggggatttttaacttcagaagttaatcagaaccatgctttaagggtaaacccttcaacatgggccataatatcaggacataggcttcaatctgcacaccacctccattaaaggggccttgctcaactattacatagtttttcttgagatccatttttcaagcagtcagggggtcaaacaagtctaggaattcaaagggaaatcacaggcagagaactagagctacttgggcaagcatgactaacctagttcctctggttgcatggctggggttcatgcctgcaaccatcagtggcaggttcagcaaggtactgggacccaggaaccatggagagaaaacagcagaggggacacctccattgtcttccactccaccctgggtcataccaaaaggaaggagactataggaacacctttttctcacttctctttctagatgggtgctatcttcagcctgcactcccctggagttcattctgaagcactgggactcctttcaccctgagactttaaagaaaaagtgtctcattttcttttacacaagttcatgacctttttaccagacctttgcaaacattgcaacatcaactcagcttttttcacagtcctatcaggcagcctaaagagaataattccccaaagttagagaagcaacttccagaggtaccatctgaggatcgccatatatgggggcccttcaagttcccttatcattacaggaccataagcaagtaaaaagagacttaggctgacgttctaatgaccttgatatttataaagaagctttccaaaatttaactcaggtatttgacctctcatggagggatgttatgctgttcctaaaccaaaatcctaaccacagctgagaagcaggtggctctgtaagcagcagaaaaattcagagatgcgcaatatgtctcctatagtaggcctaaaagaaaagagaaaataggaaaggcaaagaaataggggaaacaccatactcaataggaaaaatggcagtacctcttgaaaaccttaattggaacccgcaggcttttctatggtgtttttccttcttttacagtttcaactggcttttttataatgttctttcaacatggaaagagttaatttcaccaaaccttaaaatgtttggcttagagttaatctcaggtgaagggaacctagtagcctgacatgctggcaagaaggtaaaagtttgttttttttttttttttaaccagtcgagcttttggtttctctctccccatgcaaaccggcaaaagggataataaggattgttgtttatattctctgtacagttttaattagtgaaaaaggatttgtgaggttggtcttaagctatagccaatctggtatactttgtgtgtctttctgtatggttctgtcaaaagaaaggataccttaggttaggatggagacccaggactccataagcctactgttcaagccagcccagcagaatggtcagtaataaacgtggctataagcctccatcctgtttcatgtccttgggaacatgacccaatacttcgttttagtctttgccattttacagtgctggctgttttcttgttctgagtcagttcctgggtgagggccaccaaattagataagccagtttatcaatctgtgtcaggccagctaatccatcaagggtagggtatacaaaatatcttaagcactgatcttgagagcagtaaacagagggtcaaaatcttggagcctccagctgtgtgattcctaggccatggtttctttttctaaacttgtggctagattcttggtctggttcccaggcaagaggaaaatattcttaagaagagctattatcatatttgttttagacaataaactgtagatcagtcttctcccaaagttggttttgcctatgcccagggaagggcaaggacagcttaggggctggaaacaaaatggagttgattgggtcgtatccctttcactatctcagtcacaattttgcagtctttctcaagctgcctattgcccctttgaaaataccttgcacactcgtggtttagtcatgacctaattttggcttgtgcatttcacttgtgaggttactttttgtaaaattcaaagctgaaaatcttaactgcttggcatggctaaagtcatttaacaagggacttaaagaaattttcttaaagagtatttaggttaattaaaaatggatattcaagttataggtatatttaaaggcctctatgtttttctcttcttggatcttgtttttctggaataagttttcttcttcttggttgattgaattatttttctcaatttttttgacttgccactcttaatactcttaatgagaggccctaagataacttctggtatgatgggactctttgggaaaaacaaaggaggtgcaacagactccattttggggaaaaaaccctctgttttcctcctaaaacccaaggaattaaaggcagatacttctctctcaaaatcaaaggcttggttctgttttgcattttgttatctgttttgagtttttggggtatccaattacttcacattaggagagagctttgttgtgtaataactaggtaggaaatacactttaagggatggcaaatagtagttataaatcagagaggcatgctcttggccacccaaaagatatggaaacgtccccacccccgtcagagagataagactcccatggaggatgggctaattacaaaataagccaactggctttgggttgtcctgcagtgaaattcatggtagaagcactacacagacttcttctatagtagctcctgctttttggagatccaaaattcggtataaaatggcacctttaattttagggatctgtttttaccttctgctatgcctgcttattaggccctagaaatgcatgctacctggctctcttcctctaaagtttccaccctgatgccagtaatccaattaagaaaccggcaaataaaaaatcttacaagtgttgaatcttgtgtttgtgtcactatatatgtgttgtgtgtaatgtctataaaaagaacactaattgatgggcttgaagaaaaataagcacttaaatactttttagttcatgtgatttttgtctttaagaaataaagatactcttcaggattactggtaaaatgcaagagctatcaaaatgcaaataggtggtctaaatcattcaacttagatactaggtttgttaaatgttcccagattgtattctgcctgcttttcagataggtaaggcctgggacttgtggaactagaggctgaaaagagtcagaccttatcttcacttctttctgagtcctaggctccacacttcataaataattaaaaccacttattcacaaggtttttcaccaaaagtaaaagttgctaagagttaacagtgcaacatttatttgagatcactaaacagtcttatatacaaggtgtatgaaaacagtaaaatgtgttttctagtaaaagattataagaaagcatggaaatgtaaattttgcccagtgatgaaggatgatgttaaatttgatatgataaaactaaagatttaagcaaattgtggaaatattgtaaaaattaatcttgcaaaaatgtgtaaacattaaattcaaaagggtattatatggtcttttcataaattgagcactgaaataaaaacacagcaaggttgtcttaagaggctaatctgcccttttgcaaaagggtttataaaaggtttataaatattttacctcatggtcaaatttgttaagcttagatggaattttctatgaggttttatcaaaaggtggttaaacataataaactaatgcaagggtaaaatttggctttgaacaggattttcacgtaatagtaaagggtaatagaaggtttttgccttctgagtcataattttggcaaaataaataatttatggcaatctggaattctatttcataacatcaagtgttttaaacctctaacatttaacaggcatcccaaaatcaaacttcaagtttcaaaattgtctttcctgatgcctggctttctggatggttcagagggcccctgaaacattcagagaagaggtaaaaatgattatttgacatgtttagtcacatgagattgccaaaatgatgtccagtttttttttagctttttttctgagtatatgctatcaatcatagttgaggttaaagttattgtaaaccatggtgataactaaacttctttgtaagtcatatttttaactataagtactctggaaattttgtcgttcacagataattgttgtcttgcttcgttccttctcaaaagatggtttaaaatcaaggtgtaggactttatattttaaatagctttgaagattgtaacatgggaatagagaaagaatgtatgggactcataaagaactgacatgttcacgaatatcaaacaaaatagtagttaactaaatggactgcactcagaaagttaaagcaacctttttgactttttcttggaatatttctgatccttgttttgtttttcagagtcaaggaaacttattttgagctatttaggcctctaataattaagtgagttatattccagtggacaacatttggagcatgtttgtttctctctgcctggttcctctgaaatttggaaattatctgtgagtaatcttaacttatagcaacatagttgtttgcaacagggcaagaggaatccatttttctttttcaactggacacaattggaaaaaactggttatttcatcaaagctttgactggaagggtatgcttccctttaaggaatcaatcttgacttgtagagctgataaaagccccatggagataactggcctcataccttttctacacaatccctgcacagggttcctaacctgtggtcagtaaagaatgtcgctttctaacaggtccagcaactccaagtttatcttgggaccataagagaataggattacccaattcatatgtatttgaggatacaaatccatggcttgactcagctttaaaatatcttatctgagattctttgaggaacagactttcatcaaagccaatccaaaaggactatgtagaaataaacatttttgctgcactttatacaaataatcagaccaattatgagactaaagtttattctatgaaaaacacagttctgtcataatttgtttttgccaaaaatgagaactggacgtagaaattatgctccaaacttgatcacacatttgtcattaaatcctagtctcattgtttttaagtcttttgtctatattttagactaacactgcttattttgtgaatcaagtggtgatctcctgcagcttgtaggaaacaaaaagggatgggtaatgtaaatatctagatcaattattctgcaaattttgccaggtaataaaagtgagtagggtgcccataacacagaggttcttttcgtttgggaaaataaaacaaaggaactttatagacccccaaagggaaattctcatcttgcaagtaaaatttcagatggagttaatctactacattacccttgcagaaattgctatactcactctactatttgcagtagagctatacgcagtagcaccttctaactgaaatactggaaagaaagtttccattgctgtagtattttgcttaattattatctttatagcagggataatagttaccaaaaaaaagaggcttgaaagttttactatcagctctgctaggactttttattgggtttggtgatacatcacatcttttagctcctgcaatatcagcattggccttttgtacaacaaaactaattgctgggtctgtcctgagtggtttgctcagttcgatcacactaaggaacctctcaaatgactcagaacttactgtcttaggattccctttgttagtctcacctttaacacttaaggacttatcaggcataaatgtgacatggtatgggagcactttcaactgggtaactaactcctctcaggaaacgcatgtttccagtgccaaagaacactctcgccaaaggtgagtttcacaccctcaggcttggaaaagttgaccaggtaataacagatgccttcctctgctttaaaagcagcgggaaaggaccatatttgggagatctcaaataatgtaacatgacactcgtaattgctgatagttcaaagatttggtgaggaaagcacaataagggtgatctttggagatcacccgtattgaggggcattcagaatctaggctctccttctggttggaagtcccagtgggactggcatgatctaagtaaccaccttgactataatgtaaagaataacacacaggcctttccaaacaagccacctcatggaattccagacccttgtatgatgtttgctaatagtagtgtcctacaaatctgtgagaaacttggagacatctggaccaatatcccttgccacaaggatcatctgagatattggacagtgcatattatatccccaattttttgaaactccatttgtcaggtggaactttctcatttagcatgtaagattctaaacggcattgtgaatgactatcctgagtatgggtaaccctgtcccaaagatgcttctattatatgtaagaggagaaagcttctaagagatgagaaagatctgcctgtgtccctcacaagtcacaacttagaaccatcacttcaaggacaggtttatatttcctttgtggctcctggctacacttaatcctccctaggcattgaaaggaacctgcattgtagtaggagtgattcctcgcctattatttttatttattattattattatttatttatttatttatttttgagactgtgtcttgctgtgtcgcccaggccggagtgcagtggcacaatcttggctcactgcaagctctgcctcctgggttcatgccattctcctgcctcagcctcccaagtagctgggactgccacaacatccagctaatgttttgtattttttagtagagacaggatttcaccatgttagccaggatggtctcaatctcctgacattgtaatccacctgcttcgacctcccaaagtgcttggattacaggcgtgagccactgtgcctggcctattatttttacatttcactggcatggctgcatcatctgggtacatccctaacctaggttcctttttagaatgtgcaccatactgaataggccaaacaaagcaatctgttatttccatgtcctcgtatggagatttaaccaaaagagaagattggggagtgcatgcacatgacaatcccatcttagaaagaccacgaatggggaattctataaccagagtcctcttctggcttgctggtattcctttcctcgtaaggtcggtaattaacatgcatttcttctgaggacccttagttcaaccccaggaggagtgctagctgctgttccccacatggcacctattttcagcaggaattatccagaaagagtcattgcctgacaccccctaacagcagtaagtgttaccactccagatgggagaatggtataggagttaagaagaaattatttaggcatatagtgagggcatgggagtcctcaataaggcttttctttttaacgaaaagcagccccaagtcattttctaacaaagaatggcctgtaaagtcaagctgcagacatagacaagcaagctgagagcttgcacaggtgaatgctggcaggaacaaagaactagacatgttctagatggtgactccatcttcccttctctgacagccacatggactgtaaaaagcagaaaagatggcgccaatcaaccagaaagcccatttttataagaaaatgagggtggggtgaacagccttcccccatgtgctacctaaacagcatacttgatcgaaccaatctgtgagccctaaggaaatcagacaccacctcctcaaactggactataaaatttggtgcatttgccaccagctggtccttttactgctcagagaccccttcccatagagaaaactgtttctttttcttctattctacctattaaacctctgctcctaaattccttgcctgtgtccgtgtcttatattttcctggcatgcaacaatgaaccccagggcatatactccagacaaggtagtcacttcatatagtggtagatacttttttaacaaataaaatgacatagtctagctctacaaatatgctttctgacatcatcttccttcaaagaatttttttttagtgcttgattttccttaaatgtataaccttattttgacacaatgtttgcctcaatactttataaaaagttgaaaagattgttactgtaaaggagagtctcaatccagacctcaggagagggttcttggatattgtgcaagaaagaattcagggcgagtccatagagtaaagttaaaacaagtttattaaaaaattaaaggaataaaagaatggctactccatagagagagtagttgagagcttgagctgctcaactaaggatacttattgttactacttgattgtatgctaaacaaggggtggattattcatgaattttccaggaaaggagtgggcaattcccacaacagatggttcctcccttttttagaccatatagggtaacttcctgaagttgctatggcatttgtcaactgttggggcactggtagttgtggcttttatcatgcaaataaattataattagcatataatgagcagtgaggacgaccagaggtctctttctttgccatcttcattttggtgggttttggctgactcctttactgcagtctgttttatgagcaaggtctttgtgacctgtatcttatgtcaacctcctatctcatcctgtaactaagaatactgaacctcctgggaatgcagctcagtagttctcagccttattttatccagctgctactcaaggtggagtctctctggttcaaatgcctctgacaatatgaatataattttatttaatcaataattttataatatttaaaaatatctatcattttaactgagatgttttatcaaaaatacttttaagaaaaacaaaattagcaaatattcagaaaataaaaaatttgaatcttacatggaatgcttatcttataagaaatcattctgtagacaacaataacaaattgagaagttatctttgtatagatatatgcttagaaaattaaatgtttgccatttaatataattcatgatatattaatgccttttagtatgtttacaatgtttctggtaaaattatatgcctatataattatatgcctatataattatatgcctatataattatatgcctatataatttttcaaccatttactaaaagtgataagtgaaaatagctttttgtcatttgtgaaaaagtccaaccattagttttacaaacttcataatatcaaacagataaatcacgaacttaaacagtacagatttttttcttattttaaacttagtctaagtgtggctcttccatttatatcaagtagaataatccagaagaaatctctttataagctaaaattatacactgagtaaaggaaatggcaataattttcatttaaaaatcttttgttatcatagtgaaagccaaattagttgaaaatgacacaagagtagtaaaatcttgactccttttatacgtataaaagattcattttctttagtgtgaactactgtggaagactaacaatgtaattaacaccatatattactgtaagggattcatattaaaatacccagtattccagtgcgtttagtttttaaaggccaatagtcaaagggagtttatcagagcaaaactaagaacagagggagagcttctgaatagctgaaagattaatgttttcaaagacttgttttataatattttgtcttggatttcactacattcagaaatttaactatgaaattggcatcttcctaaaataaataatttatagaaatactaactagcccagcaataattaaaacctaacaatagatacaatttaatggatttttaaatagcagtgtgtagcactgccttttctcctgcacagttccctgtgacttacattctgattgactttccaccagtctccaattcaaatttctgctatatcacatgggaatatgattgttacaatctatataattgctatgattttgagtagtgctttttaaaatattttcttacatatataatttacattacaggataaatttaagccccattttttatatgtcccagtagaaaatcctacacagaagttgactatttgtgtaaggtggaatatgatgatgttctctgattaccctgataagataaaatgatgctatatttagctcaggataaacagaagaggaaaacaagcagtctttggaagaaaacataaatcaaagtagctctcgggaatttcaagtcgaagagaactttcatttgattgctaagtctaataccttttgggtccctttttttctccacagaagactgaaattccaaggaaaagtggcatgatagctttggctttactcaggtgcttctactgtgtttgggacgaaaagtaaggcaaaggcagatccccaaagaaagaagtgatgggcagtcctgaagaacatatctaccaaaataaggcaaaaatcaagatatttaccaataacattttcatgtgattatgcttgattttatatctaccatgagctaaaactgatgtgaaacaataatattttgaaaatggcagatgttctttcttgtctgctggctgaaagactgcactgaggattctggagatcttttcttttgcatttcattgtcttgtatatggaattaaccttaagtaaataa

SEQ ID NO: 564 - DNA, 20001 bp, Homo sapiens
acacaggatatatattagtcagggttctcttagagggacagaactatatataaagaacctattagttccctcattttctctctctctctatatatatatgtgtgtgtgtgtatatatatatgtatgtatatatatgtgtatgtgtatatatatatgtatgtgtatatatgtatgtttatatatgtatgtgtatatatgtaagtatacatatatgtatactttatatatgtatatatgtaagtatacatataggtatactttatatatgtatatatgtatactatatatacacatatgtatactatatatacacatatgtatactatatatacatatatatgtatactatatatatatgtatactatatatatgtaagtatacctatgtgtatgtatatatatgtatgtgtgtatacatatatgtatgtgtgtgtatatatatatgtatgtgtatatatataaagaggagtttattaagtattaacttacatgatcacaaggtcccacaataggccgtctgcaggctgaggagaaatgagagccagtctgagtcccaggaccgaagaacttggagtccgatgttcgaaggaaggaagcatccagcatgggagaaagatgtaggctgggaggctaggcctgtcttgttcattcatgttttttctgcctgcttcatatttactggcagctgattaggttgtgcccaccagattaagggtgggtctgccttccccagcccactgactcaaatgttaatctcctttgtctacaccctcacagacacacccaggggatcgatactttgtatccttcaatccaatcaagttgacactcaatattaatcatcacaggatgtaaatagactcaattcttcaattaaaaggcatagagtggctgaatagataaaaaaagtaagacccaactacatactactttcaagaattccacttcacctatatagacacacacagactaaaagtgaaaaggtgaaaaaagatatttcatgcaactgaaaatcaaaaaagagcaggagtagctatacttagataagagaatacaaatcaaagactgtaaaaagagaaaagacagtgactgtaaaatgataaaggcgtcaacttagcaagagagtatataataattacaaatctctatgcacacaacaccagggctcccaagtatataaaacaaacattaaaaatttgaaggtagagatagactacaaaacaataatagtaggggactttaacaccctactctcggtaatgaacagttcattcaagcaaaaataatcaacaaagaaacatcagagttaaaactacacactagatctaatatgcctaactgaaattgatagaacattgcacccaattgctgcagaatacacattctttacatcagcacatagtatattctccagaatagaccatatgctaggcaacaaaacaagtctgaacaaaataaaaaaaaacagaaattatacccagtatttttttcttacgacaatggaataaaactagaaatcaataacaagaaaaactttggaaacttcatgaatacatattaaataatatgcttttgaatgaccattgagttaaataaattaagaaggaaattaacaattttcttgaagcatataaaaatggaaataaaacataccaaaatctatgtgatacagcaaaagcagtactaagagaaaaatttacagcaataaacacctacatctaaaaagtagaaagacttcaaataaacattctaacagtgcacctccaggaactagaaaagcaaaaacaaatcaagcccaaaattagtagaaggaaagaaatgataaagattagagcagaaataaaagacagaaagaccaaaataacaatacaaaagatcaacaaaatgaaaatttgggtttttgaaaagacaaatagcattgataaacctttggttagactaacaagagaagacaaaactacataaacatcagaaacaaaatatgagacataacaactgaaacaatagaaatataacaaatcattatgatcaattccattttaatcataatatagattatgaacacttatatgccaatgaattggaaaacctagaaggaatggataaattcctggacacatgcaacctaccaagaatgaaccatgaagaaatagaaaacctcaataaaccaaaaatgaataacaagattaatagctataataaaaagtctgccttcaaagaaaagcccagaatcagatggctttgctgaattttaccaaacatttaaagaactaataccaattctactcaaagtcttcaaaaaaatttaagagaagagaattctccctcacctgttctacaaggccagcattacccttctaccaaaaccagacaaagatacaacaacaagaaaaaaggaaaactacaggccagtataactgataaagatgcaaaaatccgcaacaaagaaaccagcaaactgaattcaacaacacattaaaaagagcacacaatatgatcaaatgggattaatcccagaaatgcaaaatgtttcaacatatgcaaatcaatcaatttgatacatcatataaacagaatgaaggaaaaacaacatacgattatttcgatagatgccaaaaaccttcaataaaatttaacatcccttaacaataaaaccttcctcaaactgggtacagaagaaacatacttcaacataatgaaggccatatatgacaaaaccacaactagcattgtactggatgaggagaattgaaggcctttcttctaagatctggaaaaaggcaagcatgctcagtttcaccacttttatttaatatagtactggaagtactggccagagcatttagtcaagagaaagaaataagaaccatccaaattggaaagagaaaatcaaattaacgttgttcacagatgatatagtcttatacttagaaaaacctaaagaacccacacaaaaaatctcttagatcttcataatgaattcagtgaagttgcatgatccaaaatcaatgtacataaatcagtataatgtatataagccaacagtgaacaacctaaaaaaaatcaagaaagcaatcccatttataatatctacaaagaacaaaaaatacctaggaatccatttaaccaaagaaatgaaagatctatataaggaaaactatagaaacactgatgaaagaaattgaaaaagacaccaaaaatgaaaagatattccacgttcattgattagaagaatattgttaaaatgacaacactatccaaaacaatttacagattcaatgtgatacctatcaatattccaatgacattcttcacagaaatataaaatgcatggaataacaaaagacaccaaatagtcaaagcaatcctgagcaaaaagaacaaaggaaaggcatcacactacctgacttcaaattttactacaaagccagagtaaccagatcgtcatggtactggcataaaaacagacatatagaccaatggaacagaatagagaacccagatatatattcacaaatttacagccaacttatcttcaacaaaagtaccaagaacctacagtggggaaaggacaatctttttaatcagtgatgtggcaaaaaatggatagctatattatatgcagaagaatgaaactagaacccctcaccttaccaaaaatttaaatcacaatggattaacaacttaaatgtaagacctgaagctatgaaactattagaagaaaacattggagaaacaattcagggtattggtctgggtattttttttgtgtgtaagacctcaaaagcacagcaaccacagcaaaaatagataaatgagattatgtcaagctaaaaaccttctgcacagtaaaggaaacaatcatcaaagtaaaaacccacagaatgggagaaaatatttggaaactaaccatctgacaagggaatagtagcgagaatatatacatatacatgtacatatatatatatctctctcaaaacaactcaatagcaaaaaaaaatttaatctgattttttaaatgggcaaaagatctgaatagacatttctcaaaagaagacatacaacttgcctaaaatgtgtacgtacaaatgctcaatatcactaatcattagaaaaatgcaaataaaacccacaataagatgtcatctaactctaattaaagtggttttatcaaaaaggcaataatgaacgctggcaagggtggagagaaaggggaacccttgtacactgttggagtgtaatgtcgtggtagtcactgtgaagcacaatttggaggttcttcaaaaaactaaaaatgaaactaccatatgatccagcaattccactactgggtatatatacccaaaagaaaggaaatccatatatcaaaaagacatctgcactcccatgtttcttgcagcactattcacaatagccaaaatatggaattaacccaagtgcttatcagtcaatgaaaggataaagaaaatggaatatatatatataaaataaaatattattcagccataaaaaaatgaaatcctctcatttgcagcaacatggatagaactggaagtcattaccttaagtgaaataagccaggcacggaaagacaaatatcacttgttctcattcatatgtgagagctgaaaggtgtatctcatggaagtagggagtattttggtggttaccagaggccaggaagggtagcagggaagaggggatgaagagaagttgattaatgggtacaaatatacactttgatagaagaaataagacctagtgttagatagatcagcagggagactatcatttacaacaatctattgtacatttcaaagtagctagaattcaaatgtttctagcataaagaaaagacatatttaaggtgattgatattccaagtacactgatttgatctttgccaattatatgggcatattaacttatcacacatatctcagaactacatacatttgttatgcatcagtgaaaaaaagaatcagtcagtcattcagtgtcaggtgttttaagttgagctccttgggaaggagactctcagaaggagatttgtatggggaaggtttactgagcagtgctagtaagaacatctataaaagagtaagggaaacattaaactgagatacagttgcaaatgatcccatgggaagctctggggctgagattactcttcagaaatgtcctgaattgaggcaaggggatcaggcctttacactcccacaatgagcagttatttggtgtgagccatggttgggataaggtatcatctttgaggagcagtttcatcaactgaagactccaggaaaaactcagctgtgagccacagtagtcaatactttcagcagctgtgagactaagtcctttagtccttaaggggtaggtctgtgtaatgcatcacaacactcactacaaagaaatagtcagtggcaccttttgggagcagggaggaagaataggtgaatagagtgaagtctggggttttcttaaacagctttattgagattcacataccacacaattcaccattttaaagtgtacaattcaatggtttttaatatattaacagagttgtgtatctatcaccacaatctattttaaaacattttattatcccctccctgccaaaaaaaaaaaaaacccatactccttagctatcactctcccaatcccttcatctcccctagctctaggcaaacactactttctgtctttgtagacctgcctgttgtagacatttcatataaatggaatcataaaataggtggttctttgtgactggcttctttcacttagcataatattttcaaagctatgttgtagcatgaatcagtacttcaattcttttcattgccaaataatattccattatatagatataccagattttatttatctattgatcagttggtgtacaaatgtgttatttctactttttggctatgatgaataatgctgctatgaacattcacgtacaagtgcttggacggacatattctcatgggtgtattgctaggattagaattgctggatcataactgttagaaattgtcaaattgtttttcaaagcagtcatacattttacattcccactagcagtatatcagggttcctgtttctccacatttttgtgaacacttgttattgtctctttattaaaaccatttgagtgagtgagtgagtgagtgaatagatatggcgtggtatttaattatggttttcatttgcatttccctggtggctaataatattgggcatcttttcatgtacttattggctatttatatatcttctttggaaaaaatgttcagtcagatcctttgcccatttaaaaaactgtgttatttgtctttttctttttgagatctaagagttttttatacgttctaaatccaagtcctttatcagatatgtgatttgcaaaaattttctcattttatgggctttcttttcaccttatgatgtcctctgaagcataaaagtttttatttttatttttttatttcactattgtttattttcttttttttcttcttcttttttctttttttgattattattatactttaagttttagggtacatgtgcacaatgtgcaggttaagtacatatgtatacatgtgccatgctggtgtgctgcacccattaactcatcatttagcattaggtatatctcctagtgctatccctaccccctccccccaccccacaacagtccccagaatgtgatgttcccctttctgtgtccatgtgttctcattgttcaattcccatctatgagtgagaacatgcggtgtttggtttttcatccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgttgtgaatagtgccgcaataaacatacgtgtgcatgtgtctttatagcagtgtgatttatagtcctctgggtatatacccagtaatgggatggctgggtcaaatggtatttctagttctaaatccctgaggaatcgccacactgactaaatattgttaatgtgcaagtgatctattttatttatttttcttgcttgtgtaataaaccattgtctaagccaaggtcacagttatttcaacagtaaacagaaaaaaaaaagctagtagagagaaagtataggtagtgggtgagatgcagttttggatagcgaaaatcccaaattccactagggaaggtttaccttaactcagattaatttaaacacacattttattttatgcctacaaggcattattgagtagcacagatatatgttatatatatatatgttatgttatatatatatatgttatgttatatatatttatatatatgttatgttatatatacttatatatatgttatgttatatatatatttatatatatgttatatatatatttttatatatgttatgttatatatatttttatatatgttatatatgtgttatatatgtgttatatatgtgatatatatgtgttatatatgtgttatatatgtgatatatatgtgatatatatatatatatgtctgcaatacagagccaaagagcaaaacaaacaagtatggttctatcctcctaatccataggacaaacatatatatatacatatatgttaatatatgtatatataaacatatataacatatatgttatatatgtcgtatgtgtcatatacaacatatatgtgtcgtatgtgtcatatacaacatatatgtgtcgtatgtgtcatatacaacatatatgtgtcgtatgtgtcatatacaacatatatgtgtcgtatgtgtcatatacaacatatgtgtcgtgtgtgttatatataacatatatgtgtcgtgtgtgttatatataacatatatgtgtcgtgtgtgttgtatataacatatatgtgtcgtgtgtgttatatataacacatatgtttatatacgtttatgtttatatatgtatatatacatatatgtttatattatatgtttatatatgataatatataaatatatataatatatgtttatatattataatataatatatgtttatatattatatgttatatataacatagttatatgagaaaatattaaaaacttttatataaaacatgtattgttatatatgttatatataacatgtattgttatatgttacatttatgttatatataacatttatatgttacatttatatgttatatataacatatatataacatgttatatagcatatatatatgctatatatataacatatataacatatgttatatgacatatataacatgttatatatgacatatataacatataaactatatatagttatgttacatataaactatatatagttatatgttacatataaactaatatatgttatatatataaactatatataactgtatatgttatatatagttatatatgttatatatataacatatatagttatatataataacatatatatatgttaggttttgtaaaactgggatttgtgctggactctttcaggtatgtaggatctagagtgtaaggggaaaaaaagccctttccagattagtaaatagcaggaaaaaaaatcacacaggagagaatgggcatattaaggaacagtgagctcaggcaggttggaacagcaacaataaaccaggatgtgggagaagaaagatgttacaaagcctgaaaaagggtctgcaatgcagagccacagagcaaaacaaacttaagtatggctctgtcctcctaatccataggaaaaaacatagtaacagtagtctctgcatagttatataggagtcagtgggcatttgcatatggttctaggagacctgttcatttacaacagagaaaaagaaaacctgtagctaagactgaagcaatcacaatacacctctccaaggtaacaagagtagagagatatatgcagattggaaattagagcgtcatccccaatcctcacagaaaacaacagtattgtgcaaaatagctggtagtgtatgaagtgtggttgaggtagaagcccagaccaaggtgtagtgctgtgactgaggagttctcaaggtggtccagatggcatctcagggtgctccagaccatggagtctagtggacaatgtactgaattctgatccccatgtgatcatggtgctgaagctcgtgatgagtcgcctcctggccacatcatatctgtacaacatctagggaccactgataccaacatgtacatggaccggggaacagagaggcagaagaaacaacccacagaaactaattgcgctgacataatatggttggatggagccatatcctgaagaattttgaaaagcaggccaagaaggtggaacttaactcaggattaagaggccattgtatcttaacaatcctaaaggcaccatgctaggttagtaacattatggaagcagtgtccaacagtattaactcgaagtttcattctgctatttcaaattttaattattcactcttaaatcctctttaaagtgacaataccctttcctgtagctcatgcatattccccaccctattcatattggttctatttcttcagtggcctatctatttcagagaaaatcactctactcgcaagcccaagagcatatttcttacttaaaaagcctggttacaccaaaactataatgatatgagagaattccattgattcaaggtctccagagtgtaaaagacagactcttttgctacagctggctgctgctttttatgggataacatacttggaagcttgaaaatttcaaccattatgtccatcaacccgtcttccctctgtacatctgccacaacatatctgatagtcagccaaaagcacttctacctctgacattagcaatgttgacatctctgcctataagagagaattccagatttttttctcccaagtcaactcctcccaagtttcatgatcttaggaaatgatatcattttcacccatagagcaagaaaaatacttggaaattatccttggctactcactaccttgtcatctcacattaaacccattaccaagcgcatgttgatcctttttaaaaaaaaaaaaatcataagtctgaccaccgtttactacaactacctctatcttcctagtccacgcaccatcatctctcaccatagttcctgaagtagccttcaaacatgacccgtttccattctcgccccgagtggagaacaccgctagctgtctatccaatacccatgctgctcttctttcttactaaagtggaacccttattttgctcaagaatacaaggtgaacagctcaatacttaccttctgagctgtgcttgtaactaagggtagccattcccagttctgaccaaacagaaatgatcaaagtaatcctgaataggacttccaaaggagcttttcaaaggaacagatttaatcaccatacactttcagtccttttctctccttcttttgtctgcctgtaacatggtcatgatatccaaaagtgaaacagccacatggcaaccaagagataagacaacatactcgacatagtgcataggaaaatgggaaaagactggatccttaacatcactgagccattgcatcaggcttggactggcagcctgctctcagttttcttattgtgtgagacaaataaagccctggttgttttaggcaatgcttgtatggttttgtttggggttttttcactcaaatgcattcttactaaagccctttgctcaagtttccagcaaacaaccaatgtaagcttggcaaagagcgtcttaccatcaaatttagaaaaaatccaaactctttatgtggccctgtatggtctggtccctgcctatctttctgaactcatcttctatcactttccactttgatacactagcattagtgacaataaaacaatgtatgtgattatgaagtaaaagagactatcataagaacagaatctatacttttcttctttatccctcctccactcatctcctaaaggaccaacctattcctggatcccctattcacattccaacagtcttagtaccaatctttgctctcattactcatgttgaatgagatacaggcatgacacaggaggagttcaacaggacctttatgtcaatacctaaccttctttcccttggctccctccacttccataacttcccactcccccaagaacctatccaccttgagtgcgaagtgcctataacttgtcttttagtttcactaatagatcagttgcttattcagtttttcagcttcctatctttggattcatccaaaaaattcctaaaatgacagtcagatgatacaactccttataagtagttgaagaattgtcctcaccaggctgctaaggctacttgtgaaacatatttctgcattaggatgagtgctctgatgagactgaaacttcaatcatcatattagtttatcaaatattgtagggaatgtttaaataaaattgagagattattatataatatggtgagcctcggctagatgtgattttgggaggccgaggcgggaggatcacttgaagccaggagatcaacaccagcctgggtgacaaagcaaaaccctgtctctgtctctctctctctctctctctctctctctctctctctctttctctctctcatatatatatgtgtgtgtgtgtacctgtgtgtatatatgtatatacatgtatgtgtatatgtgtatctatgtacatgtgtgtatatatgtgtgtgtgtgtgtgtgtatatatatatatataccaccaccttccgagtttgcatgtgcccctctgtagtcaattccctactcttgccctctgggccttactaaccactaatttgcttttcatcactattggtttgccttttctggaattttatatacacgggattatacagtatgtagtattctgtatcttacttctttcacttagcaaaatgttgttgatcacacatattgttgcatatgtcagtagttcattcattttaaagctgagtaatatttcattgtctggctatatcactgttggtttatccattttcagctattgtgaatagaacatcttcaagtatttgacctaatggacatgttttcattttccttgggcaataaagtgctttttctaaatatacagtcctatgcacgcctatacttgtaaaaaattttgtgcaagtgccctgcaataatatgggtgcatctactctcataaatgtatgatatacaattttacaataacaagtgaatgggttaagatgaagcacagtattaggattgcattaaaaatcattttagaactaatgcattttgactgtttcttatctgatgcttatgcttatattacagaatgtgaatatttgttagatttagcctcaaaatattcacaagtattcctttttaaaaacatcttatttagcttaattgccttacaataaacttcacatatttaaagtataaaatttgataaattttgacatatgcatacactcataaaaccagcaccacaagcaggataacgaacatacccatcactcccaaaattgtgtttgtgtccctgtataatcttcctgcttttcctccccacagtgcccaggtaaccactggtttgcttttggtcagtagagattaatttgcatttcctagagttttatgtaaattgaatcatacatatgtgtttttttcttgcaattctctcacactgtataattattttgaaattcattcatgtggttgcacatatcaatatttcattccttttaattgctgaaatatattccattgtatgcatttaccacaccattaatttgctaataaagttttggtcatttccagtttggggctatcataactaaagcagttatgaacacttatgtgcaaatctttgagtggacatatgctttcatttaataaatacctatgggtggaatgactgggtcacatagtacttttacacttaaccttttatgaaagtgccaaaatttccaaaatcgttttaaccattttccgtttctaccagcagtgaataagagttctaattgtttcatatccccaccaacatttaaagtggtaaggtttttataaattatagccattctagtgggtatgtagtatgggcttaatttgcatttccctaacaacaaattatgttaatcatctcttcctgtgtttgtatgacacccatgtgtctaaatactttcctatttttcctatttttcctattagtattgcactgatgccttactaatgagttataagaattctttatatagtctagaaatgaggaagtattaattcactttgtatttctataaaggaattcctgaggctggataacttataaaggaaagagatttattctggcccatggttctacagactgtacaagaagcaagaagcagagtgtcaacacctgcttttggtgtcgcctcaggaagcttacaattaggttgaatgaaaaagtgggagtaggcatgtcacatagagaaagagagagagagagaggaagagagagaggggaggatgtaccaggctctttcaacaaccacctctcctgttaactcattactgtgaggagagcaccaaaccattcatgagggatccacccccatgatccaaacatttcccactctgccccatctaaaaccattagggatcacatttcatcatgagatgtggaggggacaaatactcaagctttagcaagaggctttgtcaggtatattgtttacaaatactttatccttattgctggcttttatttccatttttatcaatgttttctgaggagtaaggtttttacttttattgaagtctaatttattgatttggttcctttaaaaaatttttaccaaactcaaagccactgtgatttttctcaacattttttttagaggttttagagtttaccacttacatttagatctgtgatccatctggagttaactttttaatacggcaagctaaagctaatttttaaattgtatttattattttgcgtatagctatccattgttccagaaccacttattgaaaggattgcaattttcccccccttaaattgccttgaaaactttgtggaaatcaattgaccatgagtgggggagtctggatgctccattctattccaaagctctatgcctatctctctgccattaattatcacacagttttgattactatagatttattataagtctgtcctgcaaccttgaactttttcaaaattgttttggctttttcacgtaaaattttcatgtatattttagggttttttaaaatcaatttatacaaaaaaaagacttgagattttgagtgaaattgcattgcatatgtaaatttggggagaattggtatcttaataattttgagtctttcaatgcataaatacagaatatttcttcatttatttaatttttccttaatttccctcaggaatatcttacagatttctgtgtgcatgtcttacacatttttgtcagatttttcacatttttgtgatattaatttaaaaatgatatttttttcttttcaatttccatttgttctttgtcagtacagagaaatacaactgatttttatttattgctcctgagacctgcatctttgctaaactgacttattagttctaatagttcaatagcactggccagaaaatattgaatgcaagcgatgagagtgggtattcttttggatccctgagaagacagaaagcattcaatttttttcaataactataatattagctgtggtttttcataaatgccatttatcaagttgaagacattccattatattcctagttttctaaaagttgtcattacaaatgaatgttggattttataaaatgttttcttcttcatctattgaaattatcattttttttctttttggttctgttaatatggtcaatttatattgatcagtttttttaatgttaaacagaagtcgctgtcctgcactgcttgatgtccaatatttgaaaaccattgtttcatatgttttgtctggttactctatcttggctacaagttaaagtctctggtatttctctttcaagtctctggttcttagttgcattcctcagtcccacaccccagttggtcacaaaatataatcctttttattgcattataattttatattattagatttcaattaatctgttttttatctttgttgagggtgggctctttggggggaggacttagacttttttctctgtcattttgggtagattcaattgctgtgtcttcaagatcactaatcttttcttctacagattctaatctgttgttgttcctgtacaatgtattttttaatcaccgatattttatatttcatgtctaaaaatttaatgagccttttttatatctttcatatctctaccttataagctcaatctttatgtaacttttaaaatatgtgcaatatagttatataactattttaatgtctttgtctgctaattctgtaatctaggtcatttctgagtcagttttgattaattgatttttctcctcattaagattgtatttcttgccaggaaactgtttgatcctttgaggcttgcttttaagttctattagacaggaccagtatggttgtttctttccctggccttgactagttttctcacacacatgtgtttctcaatgttgtttcagggataatactcagctgaagactcaaggagaacccactgtctgtttctgaagccatctccctgtattgctgtgttcagataccctgttttatgaagtctagcctcattggccctacctaattcccagtgacaccttttcaattcagagagactactggactccttttgtattcctccttgcagtattgctgcctggaaattttttctagacagtaagatgggttaactgtgggctccccatgcacatttcctgtctctcagggatcactgtcctgcactgcttgatgtccaatatttgaaaaccgttactgtatatgttttgtctgattattccatcttggctacaagttaaagtctcttgttatttctctttcaaatctctggttttccttagttgaaagttatttagaaattgaaaggcaagtgcttaagggggataaaatagttactattttattatttgtagctacctatctgtataccattattttctcattactatgcaatcagaaaacagaaattggttgctgataaactttcatctataatgcccagttttaaattttgtttgtcaaaataatttcatcattctcagtgaattcttttataagtaaacatcaaaatttgaacttaaaaaaaactcattgtagaaaaatgcaatttttatagattggtgttgtgtgaaaaattttaagtgaaaagaaggttctgatgcaaaaaaaaaaagtttgaaacaaatatttttgtttaggcaaaaatattcatagctgtgtgttaatacctacaaagatttccaaagacacaaaggaacaaagcccaggtcagagttcaagtgactatatgggtgagaaaccctaaatgtcaacaacaaaagagaaaattactgcagctcattatctttcagttataaatattcttatctcaagaactatggggttggagaatccttgatattaacagttcagactctcccatatcttcacatatttaattctataaaatgcagggcatgcttgccagggtttagaaaaatgtcagaatattcttgatcttctgcaggatttcactcacttgggctactatcccaatctttctgccattgttttcaagataatcctatattactaaagacttacttaatttttggcgaattaacatttgccccatactctgcatgacctctatatctaccaacaatgaaatgaacagcatgaaattatatacagaattttatttacagtgtcaataaatctgctatctccaggaaattcctaactacaaaattattatctaattaaaaagggaaattgcaaaagccttcctaattcaggtcataataaacccagaaatgaagagaacaatggcagtccattaaatatgtcgccagaaaaaaataaaaattcttaggttcttggctccttggattaaatggccctaaagcctttattgtattgttgtgggcttatttcttcttctttactataaaaaaaatttataaaacaacccatcaatatatgaataattaaatttccatatgaaagattaatttaaaaataggttcattgcttatgaccatagaagagcattttctcagatatggaaattgtgaaagccatatttttaagatgttaatttagaaatatgaaatctaactcttcaactatttacatcaatttatatacattgtaaactcttagtatgaaatatttacaaaaagctttcttcatgacttaatataagatcttacaaagacatgatatgttattctaataaaaattataaacaattttcataagaaaatctataaaagttgaatcatgtattcacaatggagaaacaaaatataaagtaagctaatgcatttaaagaatgaaattaaaactataagtaatttaaaacctaacacacagaatgaatcaattttttaaggaatttttatcttaaaacttttctactacctcctgataaagcagtaatgcaaagccaaggagactataataccactatgaatgtaagatttttaacacacgctaatacaagctaagaaaaaaaattaaaatatataccaggatgattaacagattatttgctgaaaggtgctaaacaaactcccatggtgtttagttctcaaaaatgtctaaagccatcagtaaagaaattgttggaaattaaacaaaacacatagctcagaatcccttatgtggtgtcattgacggcccataaaaataaaaaagaagtgtgtgagagaataaaatgaatttgccagatgtgttaaaataacctggcaaaataattcctcgtagggattataaccaatagttacctggaacatctatattttcagaagagaatttttggaaagcattcatgaatagaactacatttctggggtcaaatagcttctagtgactacttttgtataacaggtttaacatctctatgtttgtttctgatttgaaaagcacatacaccaattccaagtggaatgaagaatttttaagtgctttaggaaggatttgcatagcaataacttttaatatcttggaaaaataaattactgatttttcccaggatcatccatcataatcataactcattcacaagaagtacctagaccagtgctcagcacaaaggagacactcaataaatatgattcccttcccctacctacctctactcctctatcaaacgctatgcagtgattcccctctggtgcctcaggaaccccagccattgatgaggtgagatgaggaggaggtcaaacaggctaagcttttatatgagcagcttcatttgtatatctgccttatatattggcatccaggtaagagtttctttgaatcaagggttctaactgcagtagagggaagaaagaagatgatctctgttctttagaagtgaaattctatcctcagctttctctttccagggtgattacattcctcctatagcttcaactaccccctatacaatgatatccagctctttatctcaagtccttcatctccattttccccagaacccaatcagtcacaaagtcctgcaaataataaatatctcttacaccactccattctctgctttggttcactgatttggttcagacccatatatcttttgggcgaactggtgcaatggaatcctattggtctccagcctccagtttatcagtcacctttcatcctccaaactggagccagagtaatattcctaaattacaaacaaggttgtgtcattctctatgtcaatacttccctgcctctccttcatctaccacagaattagagaatacaagttctatcatctgcacaactgcctaccttttctttctcatctccctttatctccagtttttcttatatctagtaatttccgaattttgccataatgtctcataattgcagtttgtttcctctgactggaatgatctttcctcttgtttgtctgaaaaaaaattggtttcaacattcagctgatgggtcatattctcagtaggactctttctgacactaccaatcagtgttggttactacctctgcatttctaaaagctctttgaacagaacttggttatgtcatttatcctagtaacatgattttttcacttgttagtaccacttactagtctagaacctggagggggtgtaactgatttatagttgtttttctgtcttcaggacctacacaatgacttgcccatggtaagagcttcattcatggttgtggaacaagtcagtgagtggtaaaaagaggaaaggggaaaacaatgaccaaaaaaaaaacaaacaaataagaaggagaagggagaagtgggtatgggaatgaagagaacatccatggcatgtttggttgaagcacagcattcacataagggagcaatgggaagtaatataagtagatataactgcaaagctcaaaatttcacctattagtaaaaacatggcttttgacaaggaagacagcatgcacataaattattttggagagttcattcttgcgatgtgggctgcactaggaggggcaaagggaggcggcagtccagacaggaggtaatgaagacagattagaccagtggcaatgagggggaaaaggtgagggggaaatgcactacacaagaagacccaaaagatttgttaactaattatgaggggaaaaagagagagagaacaagaagtcaaagtgactcaaaaatttcccagctaagtaaattggaaaatgcctcagattaaca

SEQ ID NO: 565 - DNA, 63055 bp, Homo sapiens
aaggctaacttttaaattgtatttataaggaaaacagagttatccagtttgggttgagctcagagtgtctgaaaatttgcttttttgctttccaaattataggtaaagtatcatcagaataactttctttgagtatagatttttaactcacaaagctcctaataagcacataacttagatacgcaccccagaggaaccacactttggctagtgatctacagaatatgttatacttcttgcacttttccaggttagccaggggaaggaaaggaagggagttagaatgttcagcacctcttggcaatgttgcccagtgacctggcagccaaagcattactgcagcccactagaggaaacactgggcacagaataataaacttacctgtgagaatattcaaaaagatccaagttggccttaacctatatcttaaaattattctattattaagtttatacagcaggatatgaattcaattcttatcctgacacatattttcctgtaagtcgtctttggttgcattaagaatacaaagaaactctgaaatatttttaaaatatctaccaagcttgaaaagtatgtatgcttctgtctactgcatacatccctgttccttcttttattttgaagaaaatgaatagagaataataattttctaaccacttagaaaattcttttgagaaaatgtactgatatcttcattcaagaagtagttattgcttatttctgttctgacaggcacttttttagcactgaaaatgcagcagtgagtcaaacagacaaaatgtgttgtcttcgtagggcttacattttggcagagggagacaaacagtaaacaaaatcaatatgtaagttatgtagttattagaaggtgggaagtgctatggaaaaaaattgagaggaaaggggagtgggaatgctggggacagaggacggtgggggtgaagggagtagcaactgcatatagaagatcagggaagtcttcacagagaaagcgacattagaacaaaaagatttggaagcattaagaaagttagtcacatgattatcaggggaaaagcattccaggcatagggaacagccactgtaaaagtcctgaggtgggaacaggtctggcatcatcaaggaagaacaaggaggtcactctgatgggtgctgccatgggaatttgaggcaatagaaagagatgctcatggtataatataggaagttaccccagacatgagaatatgtagcttagatacatggagtcagcttcataaagaaggaaagatgttacctaaaatgaaactttaatgttcctgctggaaaagccatggtaatttaggagtaaggcaacaaccttgggggatggtggcccagcagtgggcgaatggaggcgctatatatatatatatacacacacacacacacacacacacacacacacacacacacatatatacacacgcacatatatatacatatatatacacatatatacatatataaatatatatatacacacatatatatacatatatatacacatatatacatatatatactcacacactttaagttatagggtacatgtgcacaacgtgcaggtttgttacatatgtatacatgtgccatgttggtgtgccgcacccattaactcgtcatttacattaggccaacatcatcctgataccaaagcctcgcagagacacaacaaaaaaagagaattttagaccaatatccctgatgaacatcggtgcaaaaatcctcaataaaatactgaccaaccgaatccagcagcacatcaaaaagcttatccaccatgatcaagttggcttcatccctgggatgcaaggctggttcaacatacacaaatcaataaacgtaatccatcctataaacagaaccaaagacaaaaaaccacatgattatctcaatagatgcagaaaaggccttcaacaaaattcaacagcccttcatgctaaaaactctcaataaactaggtattgatgggacatatctcaaaacaataagagctatttatgacaaacccacagccaatatcatactgaatgggcaaaaactggaagcattccctttgaaaactggcacaagacagggatgccctctctcaccactcctattcaacatagtgttggaagttctagccagggcaatcaggcaggagaaataaataaagggtattcaactaagaatggaggctttgactcctacaactggagaggcctcccactctcccacactggtttctgcctccaccctgtgggctgcatgcaaatgacacaaacccagacaaaaaggagttttggaagagtgttagcattaacatgtgatctcatgcttcatctttggcatagctgattctgttttttctgatagtttaatctttccccaaaattttgcagagggacagaaagacaatttggcgtggatgtgtatctgcttcctatagtatatattcccagaaatgcagaggggagagggatattgcagtaaaaaatggttgttatggtctaaatgtgtgtgtctccccaaaattcatatgctgaaatcctaacccccaaagtgatgatattaggaggcggggcctctgggtggtgatgaggtcatgagggcagagccttacacaagaggcccaagggagctccctcactcctaatgatgtgtgagggacaggtgaggacacggcaagaaggtgttgtctatgagccagaaagtaggctctcaccagacactgaagctgctggcactttgatcttggactccagaacagagagaaataaatttctgttgtttataacctacttgatttatcatacactgttatggtagtccaaatggactaagacagtggtatctagttaatgtagaaatttgggggattttaggggagtactgtacctgactcaaccaaaatctactaacagattttcttcattctaaatgaaatcttaatttaacaattgtccctacaatcgattgccttattaaatggtattctagtatgttatgctaaacaaacaataaatcataaatttaaatatcatatcttaaccccactataagcactgaactcagatatttctaagacaaagaacaaagattgaattattgaataccattactatgtgttaaagatgagctctctaaagcccattaaaacgtgtgtgcttgaatcctcctttatttcaaaaagttggaaaacaaagaatgaaaaactttgcctcactaaaaatatctgtgccaaactgcaaatatgtatgaggaagttgtcacttaataatagccaggcaaactctttcaaaatacctgaaaccaatataacaataattattattcacttaaaagctctgagcttagcatgatttctatatttgtgtgagctttaggttatcatatttgattctgtctcatttcacagcaaagcaatgtcatatataatgatattattgacctcagaaaaacaactacctgttataacaggatatcttaatcctgctaaattagtggtttgtcactaatttgctccagcactaattttatcaaggtgcaaacaccatgcatagcaatccacctgcatttactggtattaaaatctaggccttttcttcaacaacactgccaccttctgcttagtatagactttcactttatttctatgccttcaagagttgtgagattcactttgaaataatatatacttaaaagttagaagggaccatgagaatgtctaatcaggtccccacattctatagatgaggaaactgaggcccaaagggattaagtcacttacccaatgtcctacattcattttctccagattaaatctcacagttattaattctccctagttctcttcccactgacatatttattattaaactgtatagagaagttacatcaagacattgattataataatctagaagcatggaatcttagactatgttttatactttttgtttatttgcattatataaattttttatcataagcaaaaaatatattttttcaattttaaaagatttgtatttgttcaatgtgtagccttaaatagaaaaattattctagatcagaaaagcagacaactaaaattttttcttttaatctcctccattttcttctgaattatgaaaatgtctatcaaatcaggcacaataccaatgctaatgggtaggttttagaaaaataagatgcaagaatgtagcatgcaaacttagaagtagccaacaagaattgtgttgtaaagctttatatgtttagcaaatcctatagatatattttaaagtaggcgattttaaacaataaactcgcgtttagcagggttttttgaaaaggttttctgccaacttaaatgcctcatttgtttaggttgggtgtagattctatcagcatttctagtataaaccatgcttagtggagagttactatctttctaacataatacatatttgtcaatattttgttacagatttttttgtctatgtcacaagggatattgatctgtagttttattttactgtgataactcgttttaatattagagtaatgttggcctcataaaattagtttggcctcacattttctggaagaggtttttataaagccagaaatatttctttcttatatgttttatagaattcactagtaaaactatggtttcctttgaggtaaggtttctatttatgaattcaagttatttagtagagatagatctattctcattttttatttatattttagttcattttgttaattggtatttttcaaggatttgtccatttaatccaagttgtcacatttattggcacaaagatgttcataaatattttctgttgtcttctcaaattctgtaggatctgtagtgatatcccctctttcaatcattggtgatttgtctctctttttcttgattagtctgatgagaggtttatcaacattttttgtactttccaagaagtagcttttggttgtattgattttatctaatgtttctctaatttttatgttgttaatttctgctctttattgtttctttcctcctacttactttgggttctttttctagtttcttatgatgaaagccaagatcattatatttaaatcgcttttctaacataagcatttaaagatatgaatggatttctataccctgctttagctgcatttcacaaatttttatatattttattttcattaatattcagttctattttctaatttctcttgtcatttcttctttgacccatcagtttttttacagtgtgttgttaaatttccaaacatttcagaattctctagattattatgttattgataacttatttaattcagttgtggtcacagaacaaattctgcataatttcaatcctttaaacctagttgaaaattgttttatagttcagcatatggtctatcttagagaatgttccaagtacacttgaaaagaattcacattctcccattgtttaaatgagtattctattaatgacacatagatcaagttggtttaaatagttttttatgtctaccaactcaatattcaaagtatacatttactttgtagtttaaagtttatttcaataatttttagatcactgtactcaccctggagtgatatcaaaccagagtttaatatcattgcctaagcaattaatcagtttgaaagctagagaccacatgatttcctaagttattctaaaattttataattaggcacaaatttgaaatgtaaattagaactcttcattgaagggtcaatggaattttgttctaaaatataagattagtgaaataaaaggtaaaattaagagttattcatacttttacaaagtagaataaaatttaacttgtaaaattgtcaatgcatttagccttctaggtttaattctaattaacctacattatatgaaaaaaaattaaagttctttgtcctaaagctggtgggttattatgatgctttgcttccattttcttaaaactggttggtctgtaacttcttgatttatgctgtggttcttgcatactgtacttcataaaatatagaatataaataaaggttagaaattagagatttctattatttctgttaattaaccttaatttaacagaaccttctgttcaatttaacctttgggggctgcatgcatatgtacatatgtgtgtaatacttgagaaagacttcaagattttccctgggaatatatgcagagttctgagatagtacagatactgatctgggtatcccactggaagaatagcttaccttcatttgtcagtcgtaggataatatgctatactccaccacccaacccattctactaatcagcaattgtggcaagagcacctagaaatatatgcaaatattcatattccttttcttgtattcaaagccaagacctctgggagttctttaacagttcagaagtttaagctgcttttctatctcttcctctctcaccagtccacaatgactgcacctgctggaatactgaaaactgtcataaaatatctaaggaaattatcattatttgagaaatattgaagagggaaagaatatcagagaagggccaaagtaaagcaacaacttgttgttaaaagacatgagctttatataaggtgatgtaaaggactctagcgactcagtagggggagggtaagaggagggctaaggataaaaaactatatattagatacaatatatactactcaggtgataagtgcatgaaaatctcagaattcaccactatataattcatccacgtaacaaaaaaacagttctaccccaaaagctactgaaataaatttttaaaaaaaggatacgagctttgaacatgaagaaagaatcatgcctggtttttcatttaggaattgtgtgacactgggcagttttaggccaacttcctcatctataaaatgagcattataaatgttttatagacacatataatacgttgcatagtacacagaaggtgattactaggaatttccctctaaccaccctccagcacacctgtccaattcctctactggatataacttgatgttttaaggacacagtttcatcttacagattacggttgtgaaagtaaatatcaggaagaataggtgtatttcccacacaaatttaagcaatgcgttgtgaccatcccatagaccataaaggcactcgtttttgtttttttttttttaattatctgaattctacaatacatggtcctaaatcctttattctccattcctttttcagcagccaatcagattgtttactgtataagttatacttactgtgttatcacaggtgacagtagtcagtaaatattaactaaggttcaagaagtgtgctttacagtagtaagaattgaaaagtatttattcttagaattttaatcacattataattaaataatatgtatactaatgagtcattagtgaattgagaggtaaaaattttcagatattcttcttttgaaattacctctacttgtataattttgtttctaagggaaagttcatcattgcttaacagatcgaacatttggttgagaagcttttaactcctaacatataatgaggacagatttcgttaatcatggtggctaccatgccagcagcccctgcaaatggaaactgccccatgcccacagcttctgcatagtttgaaagtccgggcaacatcttctgattggactaagatgattattgacccataagaagtcaatccacagtctagtcagtaatctataatattatttgacctgaaaaatatcaacctctgtcttaggaaatttaaaattgttaaaaatatatattatatctattaaagaaagccagtgaaggctcatggaaaaatataggatgaaggaaactgtgagagctgaatttatgagcaaaccaaaattatgagtaagcagaaggcataaggtagagaaaagatatataaagaatggagggtgatgaataaagtcagtagagtgaggagaatgaaacagacacatgaaaggtaactgaatcacaataatggcagagcccttgactcaaaatcaatagactcctgctgtccaaatccctagatctgccttgaattctgagctgacgtctagttctggtttcttcttgattctcatatgttgtgtcctcccctcaccccaaattgcttgaaacaaattgattttcaaatctttccaatcaaatcagtgtagtgagaataaagagattaaactgtctactgcttccgtggtattcttattgcttgaataagcatctgatggtaatgtatttgttattgatccttccctcataaaagattagtacagaaataataataaagtttatttaattatcagtttttcagatttcattttaagtagcatttaggcactctgtgatgcaactgttgggtgaaggcagattgaatccagaaataaagaaatacagaatctagattgagaataatcaaggctaaactctccatgtacaacaaagccagctccacaaaagaaagaatattaggtactattattataaccatattaaaagattcacaagccaatggtcttagatctacaggaaaaaaataagtcaaatttttagtgtttcatatgtagttgtatgttaagtacacaatccctaactccaatacacaaaatagaaatggagaaatctgatgaaatcacatataggcaaaatattcagattaccaaatttgagagatgaataagataaactgaatgaaatgctaggagaggctgggcacggtggctcacgccggtaatcctagcactttgggaggctgaggcaggtgaattgcctgagctcgggaatttgagaccagcctgggcaacatggcaaaacccatccctaaataaataaataaataatgctgggagaggaaggggagagagagagagagatcagtggagagaggatattctagaggttaaaattatgctccaaaacctatatacaaatacactttagacttcacaaggaaaattagggcaggctggagaagcattagtcaggcctggaaaaaaagtaaaaacaggctgaagaatggtaggatgatggagtgtagtggctcatgcttgtaatcccagcactttggcaggcctaggtgggaggatcgcttgatccgaggagttcaagaccagcctgggcaacatggtgatacccccatctctaccaaaaaaaaaaaaaaaaaaaaaattagctgggcatggtggagtgcaactgtggccccagctactcaagaggctaagacaggaggatcacttgagcccaggagttcaaggctgcagtgagccatgattgcaccacatgcctaggtgacagagtgagaccctgtcacaaaaacaaaatttaataaagaatggggaagacaaatgctccattcatctttcaccatctcagatttctttatcaataaggcgttataatttgtattcttggctgggcgcggtggctcacacctgtaatcccagcacttttggaggctgaggcgggtcaatcatggggtcaggagttcaagaccagcctggccaaaatggtgaaatcccgtctctactaaaaatacaaaaattagccagccatggtggcaggcgcctgtaatcccagctactcgggaggctgaagcagagaattgcttgaacccaggaggcggaggttgcagtgagccaagatcacaccactgcactctagcccgggtgacagagcaagactctatctcaaaacaaacaaacaaacaaaaacttgtattctttagttcaatgttgtaatgcatttagctatgaaaagaaattaagaaggcatttacagtcaatattgaaaataaaaatatgttgctcatggaaccccaattacatttttgttaaattatgttaatgcacttatgtgtttgtttatgggatgcctgagaaccttgatccatattatacgcccttctaattttcatcatgtggctttggttttttcagactatcttatttccccaagatatgtcatgttttgtgctctgtgtaaataataattaaaatcaagtcaagattatatgtagctagttgtgcctgactcactcaagggatatgcccctgaaagatattacccatcccacctccatagccatcactaccaccagatatcagaatgtagtactcatataagaccttactgatggaagttaggcctggtgatatagtatcgacattggggcggaataggatgtaaataaatataaccaccactctatgactattatggggaaatacattccatatcctagtgaatgagctaacaatttaacctttgggggctgcatgcatatgtacatacgtgtgtaatacttgagaaagacttcaagattttccatgggaatatatgcagaactctttaaaaatccaagggaaaaaataactattttagtgttgcttcactcaagaaaaacattgcattaacacatttgttttgagacgtcaaaactttcaccaagggtagagaggcattgtttttacacattgcctgaaggtgagttcaaaaagaaaggtgccaaatgttcgtgtcatattaaatgttaaaagttttgtaatctgttataaagtttaaatgacagggtaaataaattttttaatggccatagagagaaaaactgaattcacttttttgggagcctattaaattaaagtgatttttagcacacttggcattctccttgcttcaaagagaaataataattcagagaccagccctttttttattcctctgagaggcataaaaaacaatgactgaaatgactttgagaggagaaaaagaactgacagccagcagggagagtggatactgctgtgataaaaggacttagaagtaaaaaatatattcagggtaaaggaagtaaaagtgtagtggaaatggagaaacaagcacagaagaatggatgggtcagggaaaatcataaatactataaaagttttgcattcaaaacataaaatataggacacaatattgaccagaaaaaaaactctgagaaaaaaaacacattacttctaatgcctgtaaaatatattcatgctatgaaattccttttttagtgtactcgttatttccaaagctggcatcatgactaaatagattgtcacatttactatatttatcacttatccttagttactaaaaactccaaattaaatttcaataaggaaaaataaagaaatgagaaacaaagtctctacctctttaagaaacatacttgcttcctttttccattgcattgcaagaatttttgcatgaagtaatcatcaaacctgtgaatttcctttttaaacttctttctttaattttacaaccaatgctcaactaaaattttagaggttaagtagctgccctacccaaaatatatttgtcttttttatgaagtatcaaaccaaaaacagcaaatatcaaacagaagttttgtaaaatacaatcttaacaagtcccatttatgtactaacatgaatcccaaaactctgcccagtaatgcagttaatcttttactaattgtaaagtaagtatatcctcattagaatgacttctttctttcctcagaaccttgcaaggcaagtacctgttcacagcattaaatgccatcatatgtacaatccagagaagcaccattcactttggggctcatatacatggtgccccctggaattgtgcagtatacaggctatgtgacagtacatgaaagccatagcagtatttatatttgccatagtcaattttcctgctgtcctatatcattaacctcaatttcaaaaagtaacagcaacaaatttgttattatttattatcaaaactgaatctatctttatcattcatttcctagttaggtgttgtgaaaagaacaccagccttccttcagacacatttagtttaaatctcaaatctgccactcactatccatgatattttctacaaattatccatcctcttggcctcaacttcctcatgcctaataggattagctatgtctcaaataattgtcataggcattaaatgttaataatgtaggtaaacttcctgaccctgaataggtactcaacaaatattaattgttattattatcatagcaccaacatactcaatcttacaaacttggattattaaaaattccaaaggttaaggggctctggatttacataggagctcagaactgaaaactgtgcccctgattagataattgtcataaacaatatgcatggcattctgtattttaatatatgtataaataagagttgtgtcatatggagatttgaatattttcatatacacatccacatataattctccataacatacatgtatttaaataaaggaatattaatatatatgataacagttaagaaaaggttattttcatttgtgaaaaatacaactctaggctcagatgcctttacaagggaaaagtaagttctctaccaaacattcagagaacagataattctagtcttatatatattgatttaatttaaaggagggtgatactgatgcccaactcattttgtatcaagaaataaccttgacacaaaaatcaagatattttaaaatgtaaaattatagattcatcttacgtatgatcatgaacacaaaatcctaaacaaaatattatcaatccaaatccagcagtatatttttaaaaaataaaatattttatttatcacaataatacaaagatgaattaatgcaataaaaatctgtttatgtaattgatcatacaaatggattataagaaaaaaaattacataatctcctcaacaggtagagtgaaaaaaaggcatttgataacatttaacctactcatgactttttttacattagcaaaatagtactagaaaaaaaacttcattaatttaaaaagaatatataataaaaactcagaatgagtattatacttaatggaatattatactaaagaaaaatcaggatgtttcgaagcattccctttaaagtcaaacataagacaaggatattctattattggttctattcaaccttgtcctggaattcctaatcaatcagtaaaataaaatttaaaaaagagttaaggattggaaaggagtgggcataagtatcactgttttgtatataacatgattttcaacctagaacacttaaaaaaaatctgcagataaattacaagagagtttagctgaatggtgtctaccgccataccaccctgaatgcacccaatcccatctgatctcagtagctaagcagagctgggcctggttagtacttggatgggagagtttagctgaattgcaaggtgagaaaaaagcaatacattaaatctgtaatgcttccatatacgtgtaacaattagaaaatgtattttttaaaagactccatttttaaaaagactccataacaacaacaaaaactataaaatacatacaaataaaatttaaaatgttgggtagcacctatatggaaaaaatttaccaaacatcatctcaaggtagaaaaaaataaccaaatgaaagaagaaatatatgatgttcatgggtggaaagagttgaaccataaagtttttcattttgctcaaatttatatataaatcaatgtaattccaatttaaaactccatagatttctatgaaacttgaaaagctgatgctaaaatttatttagaaaagtaatggaacaataaaagctgagatagttttggagacaacaaacaagctggggtaacttgacaaagcagtgaggaatcaacacttactacaaaactctagtaattaagacaatggagtcttgactaattacacaaatgagatgaataaaatgctcaaaaaagaaagaaggtgttaataaatggttgtggtacagataattgagcaaatatattaatatttatgttaaaacatatttatttaataaattgggctgccatacacaaaagttgtttgtgatttaaaagaacagaaaatgaaaaacaaaagtttacaacatttataagaaagggagactatgtttgcaggatgaaaaaatatttctgaaacaaggcatcaaaagacaagcaataaagaaaatacttatactactgactatacttttaaaataaaactttagtagcacaaaagacacataaataagaaaataaaatatgctatatgccaggagaaggtataacaaatataaccatcaagggatgggatccagaatttagcaagaactctgaaaaataagaaaacaaaagctcagtataaaataggccaaagatagaaataggaaggtcaaagagaaagaaacacgaattgctaatgaacaaatataaagatgttatcctactcagtaatctagaaaatgcaaattaagactatgatatgataccatttcacacccatgaagttagcaataaatttaaagtctgtcagtaccaaatgttggcaagaatatgaagcaatgaactctcctaaactactgatggagttacaaattggtacaatgttggaaaaaaatttggcaatatctaataaaattgaaaatagccatactttttgtctcagcaattctactcctagagaaaccgtaacaaggtctccaaagagacctatacacaatattctttgcactgctatttgtgatagtgaaatgttgaaaataacctatatgtctaccaacagaaaaatggattaaaaattatgtggttaaactatgggatattatcttgtcatgtgattctttacacttttctgtatatttgaaatagctccctttttttaaaatggtcagggagggtcagagtagatgatatttgaaaaatgaaattcttccaaatatttcaaatctattagctatgcttgaaaaatgagcaaagaaatctttacacgataaattcacaaacaccttgaatacatcaaaatgaatgatctgtaaggaacaggtctcattagactaacctaattttgtaacatgacagagtaataggcctggcagatcaaggggcagagataaatgctatgtcccaactttagcaagaattcttatcctgtgccatatggtattctcatcaaagaaacgggaaaggtaaagaaatgtaaaaaagaaaacagggatagcatagtctagacctggactccagccaacagaataaaattacccagcacactagaagatggataactcttccttcggggcttatcaacctctgagaactaaaccaaagtctcttggcctggtgataaaatgaaaacccataggccttaaatgtgcaattgacatctaagaggcagtgagaagagctccataatatgaagatgtattttattaaaatcgaggaagtggtcaaaaccgagctaatatttaaagagaggatgacaaaagagtagcacaaataaggaagggaaattaatattttaaaaataaaagtgccagctaggaagcacaattcatattcctctacatgagaaacaactttatccgggaaagtggtgattttctattaagcagtcatttgatgagagacacacaggatagcaagagagggatcaggcttctctgcagctgcatctccacgctgtcccaggaagcaaacctgcctgagagaccattcatgtgagcgaccagccagacagtttcatgtactggggctgcccagttgagagtagaaatcactttagaggtcagatgggacatcaagttgaattttaaacatgaacgtgtcactgtgatctggaaatctattaaaataatgtaacataaaagtaggaatgctgcactgacaaaccagaatccccgttttctccattttggctccactgcgtgtccacttccatttccaccacttaaagatggaataggatataggaaggtgggtggggagattcttcaaaatcagccagttgttataaaattatgcctgtggaaaacaaatgattttaaaatccagattgtgagagaattttagtaagctatttcacatatacaaaaggccttaccgagaattctgtggccagctgttcttaattagagagataagaaaataaggatttagatgtgcgagatgggatacttagatgaaaaattttacacgattttcctgacagagagcagctgataaaccttaggaagactttacatgagaaattgtagaatcacaactttaaagaaggcattctttaaataaaatcttttctgctctggataattctctcaaaatttctctcagccctcaaataaaaactgtcccagaaatattctccccacctaaaaaaaattaccaaacaattttgaggaaatatattaagagaagaaagtcattacatattatacattaagcacatggcaaagtaaactttgcactgtgcaatgaaggtattttaccttatactatacacccacattcaaaacgttgttttgcttttaaaaagcattggttaatgcttcacagaaaaatatataatttcagaaaccatctgcctatgagtcatatttcctcattgcttcctcgtgttttcttaactaatttgttaatatttgcataaaaacaggaccttactttcatgaaaacacagatattcaatcaatgtttataatattacacatttgttgaaattacactgaacaaaaagcacatatataattcttaggtgcttgcatgctgaatgtgtgagcactcctagaataagtattatgtgtgtatctgacatggtaattgctggtgtttttctattctccaggatctgttttcttatttaaggagtgagcccaactcttccacttatagggtggagtggcaaagaggagagaagaggtgagaggttatcagggtgtggggtgtggtggtgcctccctctgtgtcactcctacacttgctttctttttttattattattatactttaagttctagggtacatgtgcacaatgtgcaggtttgttacatatgtatacatgtgtcatgttggtgtgctgcatcccttaattcatcacttacattaggtctatctcctaatgctatccctcccccgtccccccaaccccacgacaggccccggtgtgtgatgttccccaccctatgtccaagtgttctcattgttcaattcccacctatgagtgagaacatgcggtgtccttgctttcttaaaggaatgagggcaggtcaccgatgcacatgcacacatgaattgctaaaatggggagtttttcctagctgagattcaacaacagctctctctggccaggaagtgccacttacaagtgcaatcatttgggcccttagcatcagcaactacaaccctcagactgaacaaactattgatgcaaatgtgcacacagaaccatttccaaagattctttgaagttacacatgattgtgaggaacattttaagtttggagggatttcatccatttcagaccaaaccaaacatcacaccaagttagaatcctaaggcatcaaaacaatagaacacttgaaaatttttctaaatgacaactccagagattaatacatgtgttttagacacacttaaatgtgcctcaaattagtctttataaaaggtgtattatcacatcatcgtttatatgtaagtgtaggtgtcggcactatacgtgtacagccacttggtttcagggggcacctacctcaaatagaccaccccactttttattttttctggctcctgtttcttcataggaagtgcacagagatgcatgtctacacacacttttacaggtacttatacattcacctatttaacaccgtgcatgttcctacacgttaggtggatactctgtacatgtagtatatttacagatgatttactgagtcataaaatcccccttaccctttctcagcataataagcatgaagcagttaaagaaaaaaaaaaggaacaaaacacacacagggacttggcagaaagctaaaaataacaacgacatttttgaagagaaaattgtagaagcaggctttaagggggataaagtttttccaacaccatgggaaagtcacatttcttccttaggcttccaaaccttatttaagctgttaggcaaacatgaagaactgtacctcagcttctagcagctgcacatggagtgaaacctgtatagactacctacctgtaagtttagtctgggaaaaatagatatttttaattaaactttaatactttcagatatctataataatccaagaaggccaagaaatggttaatgtggtgaacctggatttaatgaatagataagcagaatttcttaacaagcccacaaatattcttgccaaatttaaatgtatatcaaattcaaattagattttttaaaaggtataacctgccatgtatattttaagctaatcacagaaaatctatagcataaaaatgcttttaattccacattctaatgtgttcagacatttagagtcacaatatttcaaaattataccaataagatatcagctatttcttatttggaagaggtgtaaagaacacttccccaccccagcccattgaccgctactgccgtgtgtaaatttgctagaaaacgttacagcagtggcaagagggatgtcaggatcacccctcccttcctaggagatgatgctattgattagttgcaggaaagaggggcaacatagtgatcgctatagccaaggaatcatttagccttaatagagttttgtgaagccaaaatggtcacttgtgtgttttttaattcatattaaattcctgtttaatggttcacacaatgttttacttctctagaacctcttttatgaaattttcatggagaagtaactcactaacactaggttgcttttgtcatatccagtcaagagtatggctccaaatacagcaattggccttcattgaataccgtacagacagtgttatatttcacacatacccatgctgtcctgagttttttccttcttttttttttttggtttacatttttttctttttattgtggtaaaatatatataacataaagtttgtcatcttagtcatttttaatgtacatttcaacaacattaattacatccacaatgttgtatgaccattatcatatctatttctgaaatactttatcatgctcatcagaaattctatacccactaagtgacaacttcccattcctccttctcctcaacccccaatagccactaatctacttctatctgtatgagtcttccctactgtaagtatttcatgtaagtggaatcatgcaatatgtgtccttttgtatctggcttatgctacttcaattagcatgttttcaaggttcatccatgttactgcatatactggaacttcatttttacagtcaaataagattccattgtatgtgcatatcacattttatttatccattcatctgttgatagacacttggattgttttcaagttttggctgttgtaaataatgctgcaacaaacactgatgtacaggtatctgtttgaatctctgtttttgattcctttaagtttataacttaagagtgaaactgctggggcatatgatcattctaggtttaaccttttggaggatccaccaaacggttttccacagcagctgcaccattttacattcccaccagcagttttctccttctcaagcaactttattttaagccttagaatagccaagaaaaaaaaggacggaataaagaattggcctgtatctcaaagagccagcctgtgtaatctttaatcttgtcacactatactccttttataaatggcctgcaaaatagtccccattttaacacttggttttgtttgtgtttttctattaaataatcacatgcaattaagtaaatatttcttcttttagttcagtagcccatattatttccattctccatgacagcactgtgggaaagcactattttggttgaatggaaggaaacatgtccaaggcctattattagttaccctacgcatattctgggaattgtcctccgctcccctaaatacccagatccttccacaccaccagattgtggttacactttccagtccttttcctcctttaaaaaattttcccatgtcatttcccagagcaattgcaggctgctcttcctgctgctggcagactgattgtctcatttagtggtgtaattttgtgttgcctacagaaagaatttcttctgcattaatcttttgtcttaaaatttcaggaataacctcactaagtatacaatttagtggttgctaggaatgtgaactgcacttgattgcaacaaaagagaccacggatgacattcttgaaaactgcactttatacatttttttggtccatatagtgccatcaactgatgcattacaaagtccttagagagcaagaaccccactagagggcgcattctcaatgtgcgaccaaaagcagaccctcctttctcatattgctaacctacttaggaggcagatagaaatcaaaaataaaatgttattattgagtggctagcaggggccaggattaggatgaggcacgtgagatagtccctctgggtgcaaaactgaatgagtgccaaaaatcttggtaatccagataagtaataagttaatgtaatattttgagaaataaaaattaacgcaaaaacatccatgatgaacaacataccaaaattttaaataaagataagtattactgcctttttctttttcctctggctcttatatggctcagcacagcactagtggctagaaaggttttctttttgacaaaagaaaaaaagaatcactgtaacatttctatggttccattactctacttcctcaaatttctctcccatggaaatcattcacacagagtcctgggcaaaactgtgtaccaagtaaagtttatcctgagggggttctatctctttttccctgccctcatccccaaacacccagtgttctcatgccgtcctgacttctcagggcgtcccacttgggcatcttagctagacctgctgtctctaaaaatagtccaaactctgcacctcttctagcccttgtgtagcaccccccaaaaaaagaataggtcccaaggggaaaagtagtttgatatcaaaaaagcctaagaccattgagatagagaaaaattagtcttacatagagtcgtacaattctagaataagatgagagctctaccaaaccaattctgtttattttactaataaggttaacaggcttgggggaggagccaatatggccgaataggaacagctctggtctacagcttccagcgtgagcgacgcagaagatgggtgatttctgcatttccatctgaggtaccgggttcatctcactagggagtgccagacagtgggcgcaggtcagtgggtgcgggcaccatgcacaagccgaagcagggtgaggcattgcctcactcgggaagcgcaaggggtcagggagttcccgttcctagtcaaagaaaggggtgatggacggcacctggaaaatcaggccactcccacccgaatactgcgcttttccaacgggcttaaaaaacggcgcaccacgagattatatcacgcacctggctcggagggtcctacacccacggagtctcgctgattgctagcacagcagtctgagatcaaactgcaaggcagcagccgaggctgggggaggggcgcctgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaaggggcagactgcctccttaagtgggtgcctgactcctgacccacgagcagcctaactaggaggcaccccccaacaggggcacactgacatctcacacggcagggtactccaacagacctgcagctgaggttcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgcctctcctcctccaaaggaacgcagttcctcaccagcaaaggaacaaagctggacagagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggcttgagaactacgtgaagaatgcaggagcctcaggagccaatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctatgtctgattggtgtaccagaaagtgatggggagaatggaaccaagttggaaaacactctgcaggatattatccaggagaacttccccaatctagcaaggcaggccaatgttcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaattaagcctcataagtgaaggagaaataaaatactttacagacaagcaaatgctgagagattttgtcaccaccaggcctgccttacaagacctcctgaaggaagcgctaaacatggaaaggaacaaccggtaccagccgctgcaaaatcatgccaaaatgtaaagaccatcgacactaggaagaaattgcatcaactaacgagcaaaatgaccagctaacgtcataatgacaggatcaaattcacacataacaatattaactttaaatgtaaatggactaaatgctccaattaaaagacacagactggctaattggataaagagtcaagacccatcagtgtgctgtattcaggaaacccatctcacgtgcagagacacacataggctcaaaataaaaggatgggggaaaatctaccaagcaaatggaaaacaaaaaacggcaggggttgcaatcctagtctctgagaaaacagactttaaaccaacaaagatcaaaagagacaaagaaagccattacttaatggtaaagggatcaattcaacaagaagagctaactatcctaaatatatatgcacccaacacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagatcagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaacctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaaaaaaagagagaagaatcaaatagacgcaataaaaaatgagaaaggggatatcaccaccgatcccacagaaatacaaactaccatcagagaatactacaaacatctctacgcaaataaactagaaaatctagaagaaatggataaattcctcgacacatacaccctcccaagactaaaccaggaagaaattgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcattctgataccaaagccgggcagagacacaactaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatgtaaacagagccaaagacaaaaaccacatgattatctcaatagatgcagaaaaggcctttgacaaaattcaacaacccttcatgctaaaaactctcaataaattaggtattgatgggacgtatttcaaaataataagagcaatctatgacaaacccacaggcaatatcatactgaatgggcaaaaactggaagcattccctttgaaaactggcacaagacagggatgccctctctcaccactcctattcaacatagtgttggaatttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggataaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggataacaaacaaatggaagaacattccatgctcatgggtaggaagaatcaatatcgtcaaaatggccatactgcccaaggtaatttacagattcaatgccatccccatcaagctaccaatgcctttcttgcagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaatcaatggtgctgggaaaactggttagccatatgtagaaagctgaaaatggatcccttccttacaccttatacaaaaatcaattcaagatggattaaagacttaaatgttagacctaaagccataaaaaccctagaagaaaacctaggcattaccattcaggacataggcatgggcaaggacttcatgtctaaaacaccaaaagcaatggcaagaaaagacaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccaccacacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgttgctataaagacacatgcacacgtatgtttattgcggcattattcacaatagcaaagacttggaaccaacccaaatgtccaacaatgatagcctggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacaagttagtgggtgcagcgcaccagcatggcacatgtatacatatgtcactaacctgcacaatgtgcacatgtactctaaaacttaaagtataataataaaagaaaaaaaaaacttaaaaaaaataaaaataaaataaaaataaaaataaaaaaataaggttaacaggctcaaggggattaaaaaggactagtgaaacgattacacatgaggcatagtcaagactaggacccaggtctacttgcttccttcccattacacaaaattgtcagaacttttttgcttttattccatgtttttacatttgtaggcaaatatttaaaaattcagaaatttctgggacatgagatcattccacttgtattttagagtttactacacagtcaacataattaatgatttcaaatatttattcagagattattttgtatccaagatactgtcataaaaagtcaagatcctagtgtaggaggtgaaatttcaaataatcattgaatagctaaaaaaaaaaaaaaagaaagctcatggagatagaaaatgggcaaacataaatgaggaaattcagaaaactaggcactgcataggtttgctacaataaaaaaagagcaagcatttaaatgggttacaaaattggacactggaaagcttcttcgaacatttcagtaatcagaatatcttcaaggtttggtacaggaatgcaaaaggatttcctgacaattgtatcccatataccaaacaagtgacctggcttcagactcctttgccttttaactagtttctcattacagatgctccttgacttatcatggggttatagcccaataaaaccactggagtcaaaaatattataagtcgaaaatgcatttaatatgccaataaacccattgtgaagttgaaaatcattaagtcaaaccatcataagtcagagaccatctgtgctctattatatgaaatataaaataagtttccataaatcaaagttaaattaaaaaaactaccaatagcttaggaaatgtatgtcaatgcagttcagtacaacagacaattttggtggatggaaaaaaactgagtagacccattcccatatggtgaaaaatatattgaatgtagtttgtggattggaggggagtaggcatgatccttccttttctcaggttattttctgaaaatgagtactgcaaatccaggaattttaattgacttttttcttttactataatattggcgacttttttttttagacgaagtctctctgttgcccaggctggagtgcagtggtgcgatcttggctcactgcaacctccgcctcctgtatccaagcaattctccagcctcagcctcctgagaagctgggattacaggcacccaccactgcgcctggctaatttttgtgtttttagtagggacggggtttcgccatgttggccaggctggtctggaactcctgacctcaggtgatcggcccaccttggcctcccaaagtgctgggattacgggggtgagccaccacgcccagccgagacttttttctcttcatttaagtggttgcctattttctgcaaatcgtcaaaaatctaaagattttactttttttaacaacagaagtttgtaactcattttctaaaactctttagaacatttgagaataaacaacaatttttatattattgccccaaattatacttccaaattcaagatgacaatcatgttggagttgtctcacttaacatataataaactaacacaatgacaagacctgtggagaaatctacacaaataagcgatgtgtacattggaatctaccccgcccccaacccctcaaattaccaagacatccttttcccaacctgttgttttgccacattttcaaaattcccagaaattctacatttctattcagaattcagccaatgagttacaaagcaaatatctcgtcattggacactgtttttcaatttttcctagaggctgtcctgccttcgacgcagtagtttccttgttagtaattttacctctgcttcctcaagtgcaaatctaacattattaaagtttattcttgtccagtttccacatccttactagaaagatgacaacttcgtgcaaataccatgtaacaggatcactggctgctaattcggcatttctgggaataggcagagaatgtcacaaaccagcttcagaacagcacattaagcctggaaatgtagtttataatttcacttgactttcaaatatttgattttacacttgatgggcggcatttctaatcaatagtgaaacgggaaaggttcccttgtccccctcgcagggtgtgtaatggggaagtggctcgcttcttcagtgccccgctgctcaaacctctaggggagcatagagatgggcaggctgtggggctgtgaccccacagcagtgtctaggggtgaatgtttacagctcctgaagccccagtgggtgagtgttacagaatactcttttagtttgccatctactggcggcttgtgttaaccagctcagttagatccccttccttatcacaaagacaaagggatttctgtattccagggtttcttgccttggtgtaccagaagaatccgatcacgcatggtcttggagaatgagtgcaaggttttattgagtagaagtggctctcaacagatgatggagccagaagagagatggttttcccctggagtcaggctgctaggcagccccgactcttctcagactgctccggccaaactctgggacattccgctactggatggcctgccggtctgctggtgcctgtcagcatgctctcaacgacaagccacccatgttttcttctaccaaagtattcttcatgacttccagctgcttctgtctctgccttgctagggtctcaggtttttataggcccaggatgggggtgtggcgggccagggtggtcttagaaaatacaacatttgggttggaaggcagaaatgcctgtcatcacctaggtccatgggggtggagccctagccagggacaggcctttctctacccagcacttcccttccccgttccttatcatttaaagggaccacaatcttcccttcccagcactcctgtatcaatagtattaataagcactaggcaggtgacaaggtggaactaaatataccatagttacacgcagagcagtgtttcaacaacgaagtgcctgagaccttaaggcaaaattgcttcaaatttcattgttcacttaaagaaaaatgttaaaagatgactcaatgactgttccttcacaattaatattctttaaactgtactctactaaacagaaattgtgaggtcaggccaagcatacattaagttgactaaagcattagataaaagtaaaataatcacagcactttgggaggctgaggtgggtggatcacctgaggtcaggagttcaacaccagcctggccaacatgatgaaaccccatctctactaaaaatacaaaaaaattagccggacgtggtggcccgcacctgtaatcccagatactcaggagactgagacaggagaatcacttgaatccaggagtcagaagttgcagtgagccgagattgcatcactgcactccagcctgggcgataagagtaaaactccatataaaaaaaaaaaggaaaataaaagtaggttttcgtaccacagctgacactctggttaactcttattcaaataaaatgtccctcaaagtttaattccagacacttagttcagaaataaaatattggagtacttaaggtttttttttctgataaaatgtgtgcaagcttatataaaatgaagataagtatatgaaataaaatatgaaaatgctttcacataaagagtttccatttttcagtcttcagatgaagtatcttatgaatgtattggtgttcattctgaccaaagctgaagaaatgttgaatgaaatgaaagtaacatgcaatagactgaatgtttgtgtccccccataatttatatgctgaacttctaatcccagtgtgatgacatttggaggtagggtctgtgggagatgcttaggtcataaggatggaacgctcatgaacgggataagtgcttgatatagtttggatgtttttcccctccaaatctcatgttgaaatgtgatctccaatgttgaaggtggagcctagtgggtggtgtttgggtcatgggggcagatccctcattaatggcttggtgtccttcccacggtaatgagttcacatgagacctggttgttaaagaccctggcacctcctcctctctctctctcggtccttctcttgccatgtgatatgccggctcccccttcaccttctggcatgattgtaagcttcttgaagcccttaccagaagcagatgctggcaccacacttctttttttaaaacttttaagttcaggggtacatgtgcaggatgtgaaggtttgttacacaggtaaacttgtagcatgggggcttgttgtacagctattctattgcccaatattaagtctagtacccattagttattttttctgatcatctccatcctcccttccccccactctctgaaaggtcctagtgtgtgttattctcctctatgtgtccatgtgttctcatcatttagcttctacttacaagtgagaacatgtggtaactttataccatagtattccatggtgtatatgtaccacattttctttatccagtttatcactgacaggcattaagttgattccatgtctttgctattgtgaatagtgctgcaatgaacatactcatgcatgtttctttaaaatagaatgctttatattcctttgggtatatacccaataatgggattgctgggttgcatgatatttctgtatttaggtctcggaggaaccatcacactgtcttccacagtggctgaactaatttacactcccaccaatagtataagcattcctttttctccacaaccttgtcagcatctgttatttttcaacttattagtaatagccattctgactacaccatacttcttgcacagtctgcagaactatgagccaaatataactcttttctttataaattacccagtctcaggtattcctttacagcaacacaaaatggactggcagagtgcctttataagaagaggctggagaactagatagctcccattccaccacatgaggatacaaggagaaattggctgtctacagcccagaagaggcaacagaacctgaccacactggcaccctgatcttgggcttccagtctccagaactgtaaaaaataaacttctgatgtttataagccacccagtttatggtactttgttacagctgcccaaactaagacataacaaccaccaaggaactaatgataattatgtttgagtttacaaaaccaagaataaacatcagaatatttattctatatttttaatgtattaactgtgccctcctactcacttccaaataataatatatgatgagttagacaagactttacagagtaaattttacgatattaggtagaatgattaggtacaatgctgcagggtatttagagtcaaatttatcttactcttgggaaactgcccattagaacctacttccttggccacatttgacccaatagccaccagctacaggctgtcatgcaacttatatgaagatctaggaaaagactcctagccactagagatgttttgtcttagatagagatggactcaccgagtcagatctcactcaggagtctgaataaaagacaaatataaagtgttagaaacagctgatgatgagggcaaaacccaagagataaaatattaaactcaaactacatggcagtaaatgtcatgttagctgtttaagtaattgcatttaatgtcaaataaaatgattctactcaattatttgcatcatccagcccacacgatagcataatcttgtcatcgtctagtacattctgggaaatttagtttttctcatgcctccatccagttcaatcctcctcactgccagctggcttctaaccattgttctcagctcactggagatttgctactgtcccagactgaaattcccattgcctttattccaccaacactcttcacctaaggccattacatataacatatacaacatatgtttactgaggataattaaagtcgggaataactttatagtgaacattaaacaccagtatctctagcaattcatcggccattccctaccacaggttaattacattggccatttttctaggtaagccctgtcttttctccattctacagggcacatttctctccaggcttatatgcgtatgggtgcaaagcaataaagttaatgagtagcttttactttcacaaataaagttttcttcaaacacatggctttgtcagcctttccttttgcaaatttttaccttattcttaaagttactgtttttaaaaatacatatttgtgtgtatggtgtgtgtgtgtgtctgtgtgtgtgatgtgattgattttggcctcattttctagtaagtaggggatggtaagcactcaaacaaactaaaaagtgccttcctcttctaaaggaggtaactggtctccagctccagcctctgttgccgaggcaggatgccaacccaatgccaccagatctgccaacttttcaagagaagccagatatccagtatgtataaatgtcctaattttaaaagacctggctactattttaattttttaaatactatgtgaaaaaaataaaaattgtatgaggcagtctatccagctagaagaagaccctgtcttccatctcaaattctagggttcctttctgctattggagatgccaatggacaactctaaaatttctgttttaaatattgtagtaacagtctgaactggcttaagaaaggataattcattgagtgtatcttatggggcccaagctgaggaatgtggctggatcttgggaacactgagttcagggactcaaatctcatcagaattttccagttgtaatggctacttttcctctacagctccttcatttctctctcccccataccttctctctctctctgtctctctctcattgatttgattttattcatgtcttctgatggcaaggctgcagccatgaataactcccaaacatttttacaagatttaggcttctaaagagagctagccacctctttcttgattttcaaaattcccgggaagcactctgattgtccaatcctgggtcaggtaaccaaacttgaaccaatcaaatatgaccacactggggtaatgctcagacagtaaatatgtaaccagaaggggctgaaatagtagagaatgttgcactgaaaaaaagaaaaaggtgttgctatgcaaacaccattgcaaacacacaattacattcacaaactttaagtaacagcaggaagttgcccataattaaatgtgcagctctgtatacaagcaagttaagctacagaattttcaaaggatttattagcttagaattagtagagaaaaactttctgtaggatgagggatatgagctaccctctgaagtatacataagattttgtttgattacagggagccaaagatccaaaatgcaaagcagagccatgaagagggacattccattcaattccacataactttgtcagggacctgtgcagtataagggattgtaccagaaaccaaggcccaaattcaatcgtgaagaattagaccataacagtctttctgactgaactcttcttggttaagcaatgtgctcaaagaatgttaatagatttttgtcaatattaagggaagtccctagatgcattccacagaacattacagtctaccctgactcttaaacgtgttatcaacttaaataaagacacttaaagcatgctcacaaaatctgctgagaatacaaatttgagaaggtttaaaaatgactatttcaaaattgtaaaataataggtcaaaaccagcataataaaatgtattaggaatcaatgtgaagtgctacactgaggatcaaaaaaaaaccgtcttggagttcagaatgtggtagatctggcacaagagcaatcaagtggggcagaaaagtaatctatgagcttctcttaattgcaatgtggctatgagtaaaaaaaaatttttgagacagaatctcactctggcacccaggctggggtgcagtggcacgatctccacccactgcaacctccgcctcccaaattcaagcaattctcttgcctcagccccccgagtagctgggattacaggcacccaccacaacacctggctaatttttgtatttttagtagagatggggtttcaccatgttggccaggctggtctcgaactcctgacctaactgatccaccccgcttggcctcccaaagtgctgggatgatacgtgtgagccaccaggcccagccggctatcggtcaaacttctggcagggcactaacatataagatgcatccttaaggagaattaatccttgtgtccaaaacaagaatattggtcataccactactcaatatcattacatctagatgattctattcaactctggattctgcatttaagggatacattgacaaacacttccaaggaaagaggactagaaagtggaagggtctagaaaccatgtcataaataataacttaatggggtctagagaaaaaaggaccaaacaagaaaagactttcctgagaacttagactaactctgagggtctctagtgggtggagcttgtaccaatttaaggaagttgacaagaagcagtgttggatttactttgagaaagaagtccataatgaatactgccatcctataaaaaattgattgccttttaaagcaatgaactagataaatacctgccaaagagatatggattatattcctgccatgagaaggaggttgggttcactgacctaataatctcttccaacattctatactccattagtttctttttctgcatttatttacatatgtttacatataaagggatggctcctttagccatgccaaataaaaaagccagccaatgtcctttggcttcaacatatttagagtttaaaaactaatatcaactcagcaaagatttttggcaattttattttgttctaaaaacctcaaattcaatttccccagaaatagacatcatactatcaattcacagatgacttacttaggtaagaatgaacttggagattcaattgtaaataatttttgcctgaagatcaaagcagaaattgtaccagtgtctacaactcatttccggacaaaataagtactactaaatgttcttccatgaagcttctgtctacggctgctgagacagactctgcaatagaaactcactttgagtatgggctatgttgcttactagttattttaacttgggcaagtcattagcctgtctgaagcccaatttttcatccctaaagtgaagctgttagtgcaataatatcttccacgtaccttttggggtacaatgatcaagtttgataatatatgtgaaaatatttataaattgtaaaatattagctattatatgctgaggaaaaacagcgtatattcaattacaaatttctgcagctgggatactgaaacattttaatgttccataaaaatcccagcttccacctgcaaggctctctggctttactatacagggttacattttaaagataaaaccattccctaattatggttgcctgctacattataaaattaactgttttgctttagtgcagagtttagcagctggttcaaccttaatgctttttactcagaccacacactgtggcataatatcctttcattttattacagtgtttcacattaattttatatttaattgtcctttacagtatttctgtcttaaaaatttttttggaggttaagtgaagcttatcctagaaccaggggctaccaaacaatcagaaccgtcacttttcctaatgagtcattcaaaaatactgtaaaaatataactgttcaacaccaaagatgagattttaatttaaattatttataaagcagaagggcagaattaggtattgctgaaacaaaaagattttgcactttcagtatgttaaatgattttacatgcacagtatgtttttaaaagtttactgatcccacatttagtaataaactccatgggatgtctggcagaaattcccagccacaacagtttacgccgaccatctgtgtctgcaagaagcttccagatattctgccacctgattcactgtcccaactcttctcacttctattcacaggcttcttttaattttcatcatatactatatctaccctgagaggaagaaaatattaccaaaacagtacagtgttacatatttctgaaaccaaaataagatgggagaacttttaacaaccaattcaatttgtaatggattgatgaatctcttgctcttcagagtgaggctgtatcagcaacacagaatatcacagaaggaagggtctttatagattgtctagttcactgccttcctttgacagataaggaaactgaggcccaggaagtcagaggcttgcctgaggccccatagactgatgccagggagcagggaggagagtgtggggtgcagttgaccccacagcatgagcatttttcaacacaccattcaaattcagctgtcctatgtcactagtgactgccttggttccagatccaaagaccagcctatcaattcccaatctggctttggagagtagacctacctaataagaaggaaaaaatttacaactagataaaggctatctgcaaaggcctcttttcactgaccctcagcacccaatctcccctcacccagtgcctccaaactcttgactccagaccagtggaaagcacacgagctttggcaacaagactccagagtttcaagtctcagttctgctattcggctctctgccctagggcatgttgctaaccactctatgcctccatttccttctctctaaaataggcttaacattctcacttgttagggctctgtgagattttaatgagatgtatttttggaagccttatgtgtaagtagtcagtggcttaatagaaccacaggattgtcatgggcactaaggaaatatctgactgaacgctacaaagggagttctaaaaagtctgtcaagtttctcaatgtttgcaagagagacaattctgcaattttgtgtaatctatttactactctctacttcagcattcatttacctaaaagaattagggcctattatgtgaaaaaataacaactcattgcaagactgcttctgtagataatgatctcaatgtaagaggggcagaataggtcaataaatctgtttccatatctcactcgttcactacctggatattggccaggctactcttagggatccccgattatttgcagattgttgaaatctctcctgtggccataaatatgagaaggtgagtctacaacttctctttgtaatttaaaataaaatcaaaaaaatttcactataaacagttgagtaatcacgggtcaggggtggtaaggatgcttatttctaaggaaagtaacttcaaccttgacctgtactcaaaataaatcccatccatcatcactcattttaatactctagtattccatgttaaggttggtgagtacttacaggtttaagaggagctgagtgaaaagagaaggttgagtttagaaatacagtagcttctgcttatactcagttttgctttccacagtttcagttacccacagtcaaccacaatcctaaaagattatattgaaaactccagaaataaacaattcgtaagttttaaattgatagctattctaagtaacatgatgaaatctcaagctgtcctgttccataccacttgggacaggagtcatcactttgtccagtgtagccatgctgtagaggccacccacccactaggcactcagcagctctctttgttatcagatcaactgttgcagtatctgagtgcttgtgttcatgtaacctttattttaattaataatgtccccaaagcacaagagtagtggtggtagcatgttgttatagttgttctatattattattaggtattgttaatctctcgatgtgcctaatttataaatcaaactttatcataggtatgtatgtatagaaaaaatatatagtatatatgggatttggtactatccatgattttaggcattcactgggggtcttgaaacatatccccatggaaaagacgaaactgttatagccagttagtatctgctgcacagaggaagcctattaaacacacttctaatattctatcatcttgaacttttataggtccctggatttaatgattaagattttgccacactgaaaattgtggcaatggttgtaacaattccaaattaaattagtgcaaacatagtaaagagaatcgagaagagagctaactagctaatgaataattttatgaagtgtcaaaagcagctgacaagaaaatagtaatattaattaataccaactggcttcttaaaacatatctagcagcccctcttgggatacgtgattactgggtcacagtccacagattcatgtggcatttggagtgagtcctgcatctctcaacattctggactgtgaagaaccctcagatggagcaatgatctcactcagcgtaaatcgtgccaagccttgggtaactcccccatcctgtactctctggagagatgccacctcccaaaaactgtggaatgtaacacattaatgtctcagaaggtgggaagtggggggggtgtagattttctctgttaaaatgttaatacaattatatgagtttaaatgtttaaaggaagataattaggatttctcagggcaagttgataattttctttttttctcaataacttctgtaactaatagcaaaagtaatgcccacttggaggtgatagaaaaagaagtgcttgcttcagcagcacatatactaaaattttaacagtacagagaagaattagcacggcccctgcgcatagatgacatgaaaattcgtgaagcattccatttttttaattaaaaataaatcaaggaaaaacccaaagaaatgaaattaaattcaccaataatcccctccattctgaaatgaccactataataatttattatgaatttggcaatgtggaagttgaaccaggactacgatgacaagactcggggcaagaggaaaactttggctaagccagaaacacaatgatgctcggggcaagaagaaaaggggttaaaaaatttgtttaagaaacctataaacattaaggattattttggtgcaaactaggtagaacattgtaggggaggtgcacatcctcattgtcacactagactagctcacaggggcagaagctgagattcacctttgtaacttagcacctagcccacctggaaggaagaaaggaactccctgctgtcattcaccccaatcaggctctcaggcagaactcgcctgtatgagaaacagcttgattttacatcaatgaagcagagtccttgggatttgtccatttaagattcatattctacaccttttttgctttctcagtccagaacatcttaatacataacacgtccgtcctcaaagcagtcctgtagtccttccgctctcaggttcagatgacatctctccctttgaggtatcgcccagagcccgcgcagaatttgaatgttacgtacatcaaatacttcctattttaagtcagaaaaccacaagcatactccacggttggggaatatttgttcagcgattttcccataatacagtagcatgcagagagaaacagctaatggtggtcaatttcagctcagttcactgcaacaaatattgattatgtgttgtgtgtcagcaatggtcctaggtatgagtacataacaataaagacattctcccatcttgagaatctcacagtctgtagaggggagacagacacagaaattatttttgtacaattgttaagtacaagtgtctctggtacatgaaagaaagaaggatactgtattcccttcaattaactttcctctactcataaaacttacccctcagtttgtttgttttggggttttgaattacttttcatccattaagcacctattacatatggctgccattgtattaattgctttgtagatactgtctcaactctaacaaccctgtgaaatgaacattactttccatatgttttaagctttattgaggcataattggcaaatttaaaaattatatctattcaaggtgtacactgatgttttgatacacatataccttgtgaaatgattaccacaagcaagtaatatatccatcacctcatgtaattacttttgtgtgtgtgtagtgagaagacttaagatctactcttttagcaaatttcaagtatacgatacattattattaactacagtcgccatggtgtacattaggtctctagcacttattcatcatagaactgtccatttgaagcctttgaccaacatctccccatttcccctatccccaggtccctagtaaccactgttctttctctgcttctatgtattcaacttttttagattccacatataaatgaggtcatgcagtatttttttttctgtctggcttatttcacttagcataatatctcccaaattcatctatgttgtcaaagatggcagaatctccttcttttttaaggttgaataatatcacattgtgtatatatatatacatacacacacacatatacatacacacatatataccacaatttctttatccattcatttgtcaatagacacttaggttggtttcaaatcttggccattgtgactaaagctgcaatgaacatgggacaacagataccttttcaaggtactgatttcatttcctttggatatatgcccagaagagggattgctgcatcatatagtagttctgtttttaatttttgaggaatctccacactattttccacaatagttgtaccaatttacattcccaccaacagtgtactagggttcccttttgctcacatcctccccaacacttgctatctttcatcttttcataataaccatcctaacaggtgtgagggatatctcaccatggttttgacttacatttccctgatgattagcaatgctgagtaccttttcatacacctgttggccatttttgtgtcttctttggaaaaatgtctatttgagacctttacccatgttttaatcaggttatttggctttttgctattgagttgtttgagttcctgatatactttggatgttaataccttatcaggaatatggtttacaaatattttctcccaatctgtcagttgcctttgcattttgttgattgttttctttgctgtgcaaagcttttcagtttgatatagttccatttgtttatttttgcttttgttgcctgtatgatgaccaaaattacattccaaagccaatgtcaaggagcctttcccctatgtttccttctagaagttttatggtttcaagtattacttgaatccatttggagttgatttttgtgtgtggcataagataaaggtccaattttatgattttgcatgtgactatccagttttcccaacatcatttcctgaagagactatcttttctccattatatattcttggtgctcttgttgaaaattagttgactatatattcctgggcctatttctgggcttttaattctgttccattggtttacgtgtctgtttttaggccagtatcaaaccgttttggttactatatatgcagtaacataatttgaaatctggaagtatggtgtttgcaactttgtacttctttctcaagattggctatttaggatgttttgtggttctgtatgaaatttagaatcttcaggatcttttgtggttctataggaattgtttttttccatctctatgaaaaaatgccattgaaatttgatagactgcattgaatttatacattgctttgaatagtgtaaacattttaacaatattagttcttccaatccatgaacacaggatatctttctatttatttctgtcttcttcaatttctttcattagcgtgttatagttttcagtgtatagatgctatggtgtaaatgtgatattctttccaaaattcatgttgaaactgaatctccattgtgggtatattaagaattgaggcctttagggaaatgattaagtcatgagggctctgaccttataaatagattaatgcccttataaaagaagcttcagagagtgttcacctctcttactcttccatcttccaccatgtgagagtgccaatgtgagaagacgctatcaatgaaaaaggccctcactagatactgaaccagctggttccttgaccttggaaaaatagatttctccatgagacaaatctttgcttggtgcagcccatgccacagctttcaccaattagagtagggtgcctgaggcttttcagtctttaaaaattactaagtctcaggtattttgttacagcagtacaaatggactaagacaacaaatctgtcacctctttggttacattaataaaattagaaaggaaagaagagacattacaatggatgcctcagtaataaaaattttaaaagatcacaagggactattatgaacaattatatgccaatatattgtataagtgaaaatggatacaactgtggaaatatacaacctatcaaggctgaatcaaaaagaaacagaaatcctgaacagattaataactaataaggagattgaaatagtaatcaacgtcctctcaacaaatagaagccaaggaccagatagcttcatcactgaattccaccaaacattcaaagaaaaattaacaccaattcttttcaaactcttcaaaaaatagaagtaaaaggaatgtttctaactcgtttcatgaggccagcatcatcctgataccaaaccaaacaaagataccacaagaaaagtagactatagaccagtatctttgaagagcatagatgtaaatctcctcaataaaatatcagcaaactgaattcaacaacatatcaagagcattatacattatgacaaaggggggtttatccccagaatgctaggctggtttaacatacacaaatcaatcactgtcatataccacagtaacagaatgaaggataaaaatcaactcaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacaaaacaccgcatgttttcactcataggtgggaattgaacaatgagaacacatggacacaggaaggggaacatcatgcactggggcctgttgtggggtggggggaggggggagggatagcattaggagatatacctaatgctaaatgacaagttaatgggtgcagcacaccaacatggcacatgtatacatatgtaacaaacctgcatgttgtgcacgtgtaccctaaaacttaaagtataataaaaaataaaaataaaaaataaagcagagggaataaatggaaccccaaataaaaaaaaaatcacaatcatctcaatagatgtggaaaaatcatttggcaaattcaacatcctttcatgataaaaactctcaacaaaataggtatagaaggaaattccctcacacaataaaagctatttatgaaaagtccacagctaacagtataatcaatgggaaaaaattgaaagcatttcctctaagatctggcataaagcaaggatcccgactgtcgccacttatattcaacatagtacttgaagtctccaccagagcaatcggttaagaaaaagaaataaaagacatctgatttagatatcagaaaagaagtagtaaaactattcctgttcgcagataacatgatcctatatgtagaaaaccctaagagctccaaaaaaaatactgttagaactagtaaagttgcaactagtaaagttgaagtatacaaaatcaatattcaaaaaagtgaggtttaaatttaacaacattctgcagctggtaaagttgcagtatacaaaatcaacatttaaaaatattacatcactggtcattagagaaatgcaaataaaaattgcaacgagataccatctcacatccaattagaatgactatattaaaaaatcaaaaatagcagatgctggtaaggttgtagagaaaagggaatgcttatacactgttggtgggaatgtaaattagttcaatcattgtggaaagcagtgtaatgattctccaaagaactaaaaacagaaataccattcaacccagcaatctcattactgggtatatacccaaatgaatataaatcattctatcataaagacacatgcacgtgtatgttcattgcagctctattcacaacagcaaagacatagaatcaacataaatgcctatcaatgttagactggataaagaaaatgtggtacatatacaccatggaatactatgcagccataaaaaagagtgagattatatcctttgcagggacatagatgaagctggaggctattatctatagcaaactaatgcaggaacagaaagacaaatacagaatattctcacttacaagtggaagctaaatgatgagaacacacggccacattgaagggaataacacacactgggacctaccttatggtggagggtgggaggagggagaagattaataaataaataaataatggatactaggcttaatacttgggtgatgaaataatctgtacaaaaaactcccatcacacaaactcacctatgtaacagacctacacatgtacctgtgaacaaaataaaaattaaaaatttcacacctgtaatcccagcattttgggaggccgaggtgggtggatcacaggatcaggagttcaagaccagcctggccaatatggtgaaacactgtctctactaaaaatacaaaaattagccaggcatggtggcaggagcctgtagtcccaggtactcaggaagctgaggcaggagaatcccttgaacccgggaggcagaggttgcagtgagccaagatcacgccactgcactccagcctgggcaacaaagcaagactccatctcaaataaataaataaataaataaaaataataaaaaattttaaaagcagttgcatttatttacactaataactatctaaaaagaaaattaagaaaataaatccatttacaataatagcatagaaaaaaataaaatacttttaatatcttacagatataaaagctaaaactcatagattagaaaatttgccccaaatcacaaaattagtaaaatgacaaagtcataagtttgcatcggaatgcaatattacagtcttcaaacaatcttacttttttcgtgatcgtacttacctgggcccactgaagttctcacaactaactcagtatcatgcattccatctcttaatatccaaccatgttacaaagctagtttaactttgaaggtatcaaaatcaaataattacagaagaaaagtttgcactctgctttggtcatataatctcttttaagcaaaaatttccaaagatttaccattgcctttcagaaagatttccatccaaagcaaaaaccctggcattcaaggccttgttgtatgtaatctgttccacttccactgtaaagcctatctttacaaagcccgttttgagccatcttcctccttaggtaaaatcatttatcaggagtgtctcatttaccatatactacccaataaaaacaaatctccaatatatgaacatttgaattactgatggcaatacagaggaacaattttatttaataatgttacaaaaaaaatgcagtaatacatgtgaggtgcttagaagaagaccaggcaaaaagcgataggccaattttattgtcatttaaaaactggaactacagaatgaattgtttcctttatattttggacttgctgctctcactcattctctgggcttcttcctattctgcaatgtttggaaaacatttccattttggttgagaagtaatttggacatttttctctagcctgtctgaactgataacctccagctgtgttgctaagcagagtctgtggatgctcatgaagttatctataaaagagagcaattcaccatcaaatgaatttgtacttccttagacgttcaagtctttttctctttttgcttctctgcgccatctcttgggtttctctttacactagagtttactttttcatgaacacagacacaaaatacagttaatagatttattttgatagagaaaaaatattttttccaactgaatgttcaaaaaataaattttgagaaaaacggtttcatacaaaacatggatatacactaaaaggttaagaatagtaatctcttggtgatagaaacatgatattttaattttgcttatctgtactttctaactttctacaatgcagatatatggcttttacaaaaattaaaaaaaaaaaaaccacaactctggatcagctcaaaattatggcagttgtactgttattatcttattcaaataaaaattttatatactttgaaattgatctaagagaaagaaacctaaaagttctttagtctggatgcagaatacaacaaaactgaattcccaataaagtctaattatttttctcttaaattattaaatatatatgctagccatgaaaaatagcaagtacttttgtcattttagacttattttaattttagtcctatgggtagagtcaatgctcactttcagttctatttattggaggttctctattcatctctttccgttgctgtttgttctctaacatcatctttcagaagggcttagggggaaatgtattctttgactttttagaagtgcaaatttttcccatatttttatatttgaggcttatttggttggggattaaatccttgggttactgtgaaatagtaagacatatatgtaactgcccccagcccctggcccagagctcctaaaatccttgcattttcctgagtgataggggtgctaggagaatcttttgttcaatatttgatctttgactctggttcctgacaatgagctcctaaatcccttgaaatttactgggtaataagagcatattttgttctaatgaggtgacttttgctgggctcctaaagggggctggtcaccaggatgaccaagccatgattggaagcttggagctttcagtctcacccctcattctctagagcagacagagggactgaaaatggagttaataaacctccataaaagtccttaaactataaggttgggagagcttctggactggtgaatgcatcatgtgctggaagggtggcacaaccacgtaaatgggcacagaagctcctgtgttcagtccttccagagcttgccttgtgcctctctttatctgtattctttattatatcctttattgataaactggtaaatgtaagcaaagtgtttccctgagttctgtgagcagtcctagccaattattcaaactgagttgaaggtcatgagaaccctgatttataaatggtaggtcagaaatataggtcacagcctggaacttgtgattagaatttgaagtaggggacagtcttctgtgactgaacccccttaacctgtgggatctggggctacctccaggcagacagtgtcagaattgaattgaattgaattagaagacaacctagctggtgtccactggagagttgcttggtttgtggggaaaatcccacacacatcaggtgtcagaagtgttgtgttgagtggtgagtgaaagtgggaaaataacttttccccccgtatctcagagttatgttttctttcctgaagatttttcatgtatttcccatttatgtattcatgttaaatgttgctgaggagaaatccaagttgaacctgattttttttccccttacagatggcttgttcttctctgcctcaatgcctaaaggattatttatctgaagtcctttcattttacttggatatgtgtggttttcaaactttgtgtgttaaattttcctacaacagtgtgttctttcactcttcaaatcttttcatcttctttgatttattctttgttttttgacttacatatttaaaaaaatcttaatttgtttctcataattagagataccaaacacctatgatagagctcctttgtctttagtatcagtcattttctctcttttgttttttaaaagttttttcacttttctcatttctatctcatgtgtcccttcctttgtttccaacagtcttactttcttgagttcatttccatctttttctggtatctgaccaacttttctaaactcttgtatatttgctttgaatatctatttattaatgccatcaagtcctggcaatgaatttttatcttataaatgtcttcattgcttctttcttttttattatactttaagttttagggtacatgggcacaacgtgcaggttagttacatatgtatacatgtgccatgttggtgtgctgcacccagtaattcgtcatttaacattaggtatatctccaaatgctctcccgcccccctcccccaaccccacaacaggccccggtgtatgatgttccgcttcctgtgtccatgtgttctcattgttcaattcccatctatgagtgagaacatgcggtgtttggttttttgtccttgtgatagtttgctgagaatgatggcttccagcttcatccatgtccctacaaaggacatgaactcatcattttttatggctgcatagtattccatggtgtatatgtgccacattttcttagtccagtctatcattgatggacatttgggttggttccaagactttgctattgtgaatagtgccgcaataaacatatgtgtgcatgtgtctttatagcaccatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaaatgattgccattctaactggtgtgaggtggtatctcattgtggttttgatttgcatttctctgatggccagtgatgatgagcattttttcatgtgccttttggctgcataaatatcttcttttgagaattgtctgttcatatccttcacctactttttgatagggttgtttgtttttttcttgtaaatttgtttgagttcattgtagattctggatattagccctttgtcagataagtagattgcaaagattttctcccattctgtaggttgcctgttcactctgatggtagtttcttttgctgtgcagaagctctttagtttaattagaccccatttgtcaatttttgcttttgttgccattgcttttggtgttttagacatgaagtccttgcccatgcctatgtcctgaatggtattgcctaggttttcttctagggtttttatggttttaggtctaacatttaagtccttaatctatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatactttgaagtcaggtagcatgatgactccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtattgccattttcatgatattgattctttcttcattgcttctttaagattttattgatgtcgtggagggttttggtcacaattttcatggacttggtggctacatttatctggtaagctttgtgtgttacttgttctccctgttactttagtataataatgccgatagccagaagtcaaaagagatcatttaaagtgaacttttcaagtaatggatatacaatatacttaaaggtaaatacttagaaaaagaatataaataactaaaaccaaatagttgggtaaaagtagtcagagaatgtagaaatatactcattttctcattgcttatagtatggagttgatatatttactaaaaaaaatgattaagaatatttaataaagttttaaccaagtacaaaccctccaaattatcaaaagaaatagaaagcaaagcaaaggcaggttatttatgagttttttaagttacagaaacagagtgaaacttaagaacagaactaacaaatatatcagataagaaaactcactcaaaaataaagagagaaagaactgattgaactcagcaaaatgctaagatataaaaggaacaactttaaaaagtgattcaaaaaacttgaaagtgaaaaatagtgggcaaatatgtcagcatatataaaccgttaggaaagaagcagtcatgatcttaatattctgatccagctgaattcaaggccaaaagtatttaaccaaaacaaagatattttatcagaataaaaaacgtgacacacaatggatatctaaaagtaacaaatacctatgcacctaataaccaatcatcaacatttatgaagcaaaaatacaaggtactacaagaagaaatatacagaaatatattaatggtagtagtttttattcatttttcccaggttatgaacgctcaaacaaaaataaataagaatttagggaaaaaatgcctaataaaatagatatatatgttattttttaaaaaccacttttatactctggaaagagatgataaagtttttttccaaatatctatggaccaatcatattatttaaaaaaaaaatcctataatagccctcccaaaaaatgctaaattctgaaggaaaaaataagtaaaaataatattttctgatatgaaagactgtagactaaaaagacaacagtgtggtcctggcatataaacagaacagaaaatgaaatagaatacatccaaaaatagacccagtacgtataaaaattaacaaagtggcatttcagaagtgtggatgacaatgaattactttataaatactgttggaacaagcagatagccatctagaaaattaataaaattgggtcttgtggcacagactatgaaatatccctcaatattcattctccgcttcttttttggtcacagaattcctgatctttagctggatacatagtttcatttccctgattccctgactgttcactttggccttgtgacttaagtactagccaataaggatgaatatagaattgatataccgctttcagtaagtgtttttaaagggaaaggatatggcttttttcatcctttcctccttcctgctggctggaatccgtaagtcttggatggcactccaacagccatcttggaccataaagtgaccttggaaatagaagtttctgatagtgaagtaatgaaatggaaagagcagaaatccttcatcacgaaatatcatacaagctctgaatttgcatgagagagacacagaaacttcagtcttatccatatctcattactttaattatcattcttagctgagcttaaccagtagagttccttttgtcccagtatcatatcttacaccaaaaaaactccagaagtcttaaatatttaaatgttaaaaacaaaacgaaaactataaatgtatgaaaacatgagagaattatttttataattttgaggtaagaaggcctttctcaatataatacaaaactagacaacataaaatgaaaggttgataaattcaaccacataaaaactctacgggaaaaaaaaaaacaccatcacaaggttaaaagaaagcaaaaaattggataaaatatttgcaacatattttgcattacactagggctaaatgccactagctctgttgaaaaaccagcaatgattatgaacagacagtttctagaaaagaaatgtggagaaaagacttatgacctccaaaactataatttaataagtttgtgttgttttaagccatttaaaaaacaggaaatgtgaataagtcttaaatatatgaaaagatgctcagtcttactcataataacagaaatacaaattaaagttactaagaggtagctttttctacccattagattgataagaatcaaaaacttggcaatacctaagaacctgttttctcaaaagcttgcccaaagaatatattatcagtgtaaattgatacaacatactgacagcaatttgacaatatatatgaaaagcacaagtgtacttagtttttgacccaggaattccagttccagatatttatcctacaatacatatgaatatttgccaaattatgcatgcacaaggatatacatcattgcattatttggaaagattggaaaggacttaaatgtccatcaacaggagctgcttaaataaaatatagtatatttacacaatggaattctatgtaactgttaaaaggagctctctatatatactaatttggaataaaaagatatattgttaagtgaaggaatgcagaaaaatatgtgtattataattctttttgggtttgcagaagcagagaaatatatatatacacatacatacatatgcttgcttacgtaatgaatatctttctaaacatatataagaaactcataacaaaggttgcctacagggaggagaagctggccaggagagaggaagtaagggaaatgtactcttagtattcatgtctctgtgcatatttttaatgctgtaatatgtttatatattacctattcaaattaatcatttaattagatttaaatacaatagaataaaaatgaatggctcacaaaatgaaaaagataaaaattatagtttataatctccaattaaatgtgtcatcctgggctaacattaatgtttgaaaagatatgtaggctttcaatttcaggtaacattccagataaaaagttgaaagatttcaattagatagctctataaaatgcattgttgcaacaacaaacctaatgttaaaataatttatttataattgaaacttaaaaaataataattcaaacttgaaaaagggacaatgtttatttcactgtgtaaaaacaacagttacagcaatcccaaatagcctcagtgttctgccattaaaaaaaaaaattagtatggaaggccaaagcaggcagattgcttgatcctagaagtttgagaccagcctgagcaacacagtgagaccctgtctctacaaaaaaatacaaaaactagccaggtgtggtggcacgcacctgtagtcccagctactcaggaggctgaggtgggaaaatggcttgatcctgggatgcggaggttgcagtgagctgagattacaccactgcactccagcctgggtgacagaatgagaccctgtctcaaaatgaaaagaaaataaaattagtaaattcaatgagaatagtctttgtcttgttccctgtcatccccagaggctgtgacagaaccagacacagtataagggcacaaaagtattctgagtaaattaaatatgtaaattgaattatatctaaaagaaacaatgaaaaacataatgctataatgtatcactgaaattctttgtaaattgggctttgttttaacaaatattaatccaaatttctgctgttctgattttcacaacgtctagggtctcactgactttttacctggcacatttactgtactgttagctctggagaacagactgcaaggtttacaatttatgggcaaattttcatattatggcactttctctctcttcacacacacgcacgtgcacacacacatgctcacaagcttctcacttttactgttgtcaggctgctcacttctcataccagctgctcctcccgcctgctccctccaaacataatgtaaagcctccatctgatgcacagaagggacaccaacaaagataagagtaagtttctgaggctggttctattctccattgaggcagagggtgttgaaagagttcaaaaactaggtagcaggaagataatgtggtttcagtctagacacgaaaatagaaacactggcaccaatcaaagtaaaggaaattgtccttttaggaaaggaattttccttctagatgacattcaaaatcccaaatcccttgctaagaatgaagggcatttagtgataaagatttagtctcttctgagaaagtcattgaattcctgataagaatttccatgtcttgatttccaactagtggtggggtttagtaaggtcattttaggtgtatttctcatcacataaattgattaaagaatttgggcactctgagttcctggaagaatatcctgaatgtagatttttttttttagtaaaactttcaaaagtggttcataataaatagtttcgttaagtcttataattggagtatggaattgaataaccaacccatgtattatttttaattgtctaattaagatgacctcagctgggcatggtggcttacacctgtaatcccagcatttggggaggctgaaggcagacgatcatgtgaggccaagtttgaggccagcctgggcaacatagtgagactctctctacaaaaaaatttattttttaattagccaggcaggctggagtgtgcctgtagtcctacctactctggaggctgagacaggaggatcacttgagagcaagatgaggcttcagtgagccatgattgtgccactgcactcaagcctgggtgacaaagagaaatcttgtctccaatataaataaataaataagaataaaaaatttaagctgagcttaattaaaattatgttaaaatctggtttttatttttctttttatgaaagtatagcttatttttgttcaattaaattttttttaattttaattggaatgcatctgctatgggaatctaatccagtcaagtcagtgacaatgtcacaggagccattgctaagaaggaaagcagcaggagttgggagaaatcaggtcacacagcaaaaaccagaggcaaaagccgtggtggagaatcagggtgacatggagcaaacgtaacagtcatctacaaaacagaagcctagggcccagccaaaccaagataataatgtgaaaaggattagatgagataaagtgagtataagcagagaggtttttgttcaagtgcagcactgctgaggggaggaaaaggaactaccaattgtacagccaagcctgactcctgggagttccatttgcaccttatccaacacatattaatcgatactgttttctgtacaaacactaagctgagtactggggtaaagagaacagtctctaacttcatggatcttatattatggcagggagcagggagtggggagcagatcaaataaataaataacctgattaggaagtaagcaaataccactttaagattatgatagagctatgaaggaagcaggcaggatgctgagaggcagaacagggagagaggacctattttagaaagcacggtcatggaaggctgagaaggagccaggcacaaagaaaagtgaaggaagagctttttatacaaagggcacagcaagtacaaagatccagaggcaagaaaaactcaacctattcaaagaaccgcaagagaatccatgtggctgcaaactggttctcctgaggtggcccccaacacccatcacaacttatcccacagctcacaaccctcttgaaatcatagctttactgtagtgtctaaattattcttcctctttcatttctctttagaaatattgtctaaatcataccctcaagctagtgataaatagaaagaaattttcttcacattgttttttgttttgtgttcgtataatgatacagttcaaatacaaaaaaaaaaacactaggaaattgtttaatcaatgaatatgcatttgtatgtgtgtctacaaaagcctgcccacatgacttagaatcaccgacccttccttgttcatgaggttaccatggcacccatcttttcagagcacacagcttatatccacatctagctgtgttggccccgctaggtctcagtggggagaagtctctttagagagctacagctagagagagtcagtaggtgatctagatctgatgagagaacaaaatatgcaagattaaatgaatcatgcagtctgaagtcaatttcctgccttgtatttgttggtggtaatgttaatacagcattttaaaaataagttttttatatatgaaaaaggtttgatttttggtccacaagctagtaatacaaaaaaagtcacatttctttatttcctttctataaacctaaataaaactcaatctccatcccagcaggtggtgggaaattcaattttaatcattatggggttttgtttcttcctactcactgccacctccaactcaaggtcatgcaaaggtctccttttagagaggtaaaaatgacattatctgaaggctctagaaccagaccacctagatttgcatcctggtcctgccacttactagcgtgagatgttgggtaacttaattaacctctttgatgactagtggagatatgatagtaactacttcatagagtttttagacaatagatgagttaatatatataagtgtcttagaatgatgtctggcacttagctgtgcagcatatatctatcatcatcattgtcatcattttcacatgatgtgaaattatctaagatatttctccagctgctggttcactctggttatcaaagaggcccagtctcccaacccaaaggattttctcatatttcaaggtcctgctgcttctgcctggaagctcctaagcctctgaggtgttgtccccactccaggacaacaacttggaatgacccacaggcccccatcaatattccaactatttcccaagaatctctttgcaagcatctcctccattttcctctcttaggaccactgaaagcttcccctccctctcagaacacccagcaaaatgtcttcagtgagcttagacttcacaacaaaactcaacttcagaaactaatagaagctccaagcaatttttgctgctggaaaaaggctggttacctgctgtgtggggaggagtcaggggaatggaatcgcacagagagaataaatacaaatctttattttcctgtcacactgattctgtcatacttgcttaggctgacacatgctccaaacgactgtaaatattgtacaaccaacagcagtttcacaagtgaaaacgaatctgtctttggtaatggctgattgttcctgcctgtttcaggtggtgctccaggatagaagagcaaaaggactgtgacagaaagcacaggagccctactaggtttcatttttaaaagaaggagagaggccgggcatggtggctcacgcctataatcccagcaatttgggaggccaaggcgggtgaatcacttgaggtcaggagttcaagaccagcccggccaacatgctaaaaccccatctctaccaaaaaatacaaaaattagccagtcgtggtcccagctatttgggagactgaggcaaaagaattgcttgaacctgggaggcagaggttgcaataagccgagatcatcactgccctccaacttgggcaacagagtgagaccccgtctcaaaataaaaacaaaaataaataaaagaaagagaaagagaatttgggaagccccaaatgagtgggcagtgtgatttgcaacctccacttgaatttgggggccattagagtttggagattcacccacattcaaaacaaatcctgaaacaactgcagtataaatgagaaaagcaaactaggacaggacagagacacagggacgggagtacttagcaggtacagaggagctgtgacaacgtgagctgaggttgggggaccagttaagggagaggagaaataagtactggagattcaggcagggagccagagaggatggttgtccttgatgcatttgggcagcagaggcaagcagaaagtccacttatggtgggagcagagcaagcgaaagccctgagggggaaagaaggagacacaaatcccaaacaatgactggaacctagatggctccacctcgttctttgacactttgctcatcttttgttgacactcatactagaagctcactttgattttttccatatgattatctctagctttgtttctaactgtgctatctgagttgctttccaggcccacacttctttcatctgttgggggagacaaggaagggagaattctgagaagaaaacttatttattcagtaagaggaccactgacccttttcatggcttttgatcacttgaatttgtcagtccttctctgagcctggacagaattccagctgagaaggacatggggttgaaagagaggggtcacctgtcctttctccccatcctaggtgtctttactcccgatgacccatttaaggcttgagggtggtggaggggaaagtccacgtctctgaatgcctatgcactagttgggacagaagtgacaagtttttctttctaaatagacgttctaagatgtgactttctacctccagggtgtccttgatgaagttctcactttgccttggctcaagagttcatgaaccctgtcctatactcctaacaggaactgcgtcacctccttttggatggaaaacaacctcttgctcaactaaagtggctttctaaaggcagccaatgcctttcttttaattggccttcaaagtttctaaaataagtaccacaggaaactttcttgttccttccacagctatgtggagcagggtgctctgtggtgtgtgcccctgacaccctccccacaggcagtcatgtttaactgcagcacacacctatatatggggctgaggaagttagctctgggtccagtctcacataaaggcaggtaaagactcacagatgggagccccacatatactaggagaccctgatgattgaatgacagaggaccaagccttgtctatactccttacagcaacagctggacctcactttgaaacctgaaaagtcgttcagctttagaacacattgagataaaagtggacttcagtatcactgtttgctctttcttaccttgggaggttactgcctgaagtctcagtttcctcatgtataaaattagcataataataagacctatctcacagagctggtgtgaggatttaatgatattatatgcatatagcttgcaataaaatgcctagcacagaggaagcactcaacaaatactcgtcacctaccttcacttttctttttctttttttttttttttttttttttttttttttttagtgcagtggtgccatcttggctcactgcaacctccgcttcccaggttcaagcaattctcccacctcagcttcctgagtagctgggactacaggcacctgcccccacacccagctgatttttgtattttttgtatgctggccaggctggtctcaaactcctgacctcaagtgatcctcccaccttgggctcccaaaatgctgagattacaggagtgagccaccatgtgtggcctcacttttccttttctataaaaagaccaccattgtctattcttcctgacttaaaagtttcattataaaaatcacttttttgagtttaagcaaaggtatagtctcaagaagacaatagttaaatgcccttgaattattggggatgtaaagggggtcgagggtttaaccttttttcaagaacacattagcctggatttggttttattaaacaaataatatgtctactatttatctcattaaccaatttcaaggaagtagcaagagtggcatagggagaatggagcttcagatctgtacccttatatttttttgtgaaggtgaggaaaaatcatgaaatgtctagagcttagcagttacacagggagaacaagcctgagacagaaatgagggaaggggtcctgtggcctcttgccaagggacaagtatcaagtcacaaggaggagagaataaagacatggttttctgaatttctattctccctagaatcagccctgcattagaaaataaaataaaataatgcagattattaattgtatcagcaggtaggtattttaatccactctgctcaaacatgtcaataagaacttgcaagcaatacttcttgtcttcttaaagttaactatattctctttcaatgacagggtttctctaagactaaagaattcaattcaaccagcatctatcatgcccctattatgtgtcttcaccctacaagtctctgaagtgacagggaataaatcttgtctccactaaaagccaactctgaaaggcccactctgaaagacaaaacagggattcaggagtagcatgctagtcatacaacgttagtaatattaacacagaatttattgtttctgttccacttatagttggattgagactatcatagtgatcagaggaaaaataagttctagtgattaacacagaggggggtgtgtgtgtgtgtgtgtgttttacatattctttattttcttactctgttcaaggccaagagcattctccaagtaactgatatcttcaacagaaggtggttgatgaggtaattgtgctctaaagcctataatgctcttcaaaagaaagatcaatgctgggataattccagcccagccgacagaagggctatggaagacactgaagtttagggtgcacagagaactgaagacaagcatgaaccacatgaaaggctttaagaacatgtaactgatgatccatgtgataacaaatgcagagggaaacctggggtattgttgatcatgagggtcttggaaatagaacaggggagggaggacattcctgataagggcagcaacataacagaatgcccatatttggaaataatcataggtatttggagacacatattcaagaaaaaaagtgtgcagaaactaaatcactccaccagtcaacctcaaaaccttcacattgatctctggtatacttctttgccatttaactctacttagtatggtttattctttttttatatggttgaatctatataaattgaacggtgtgtcagtgcttgtcttacactcttttgtgtatacttctcaatatagtggcttgcagatacccatatggttggattcatagttgatgcccaggcattggaaactggatcatcagctgctcactcgtagcgctttgctagtttcactccatctgttctatgttctcacctgactgttgatctgaaagctgcactactaagctttaaatcataggttttcagcctttgctgcattggcatctcctgaaatcctggagcctgttacccacccccagatattttgataactgggtagggcatgacttgggcatcaggatttctaaaagctcctaaagtgattccaatgtgctttagaagcagaaatgaaacaagaacaggaaggccaatggggaaaagatgagtccagaaagttgtcttagctattttaaagtcatttatcacagtgttattggtcatattaaaatggcaacatttaagtaagcatatgaatagaaatgtctttgcttgaagaactaagagaaaattattatgtaattttaggtcattactattatcgggtattattaataagtacaactaattgtaacctttggattagatgaaacacataagatacaattattataattaaactatttgaatatagagtacattgtgttaatagcttgagcaattttaat

SEQ ID NO: 566 - DNA, 20001 bp, Homo sapiens
ggaccggccattttcacttcttttgtggtgggatgtcatcagttaaggcgggtcagggcatattcacttcttttgtgatttttcagttacttcaggccatgtgggcgtatatgtgcacgtcacaggaggtgcgatggcttggcttgggctcagaggcctgacaagaataatgttaatcatgtttactcattcattttattcaatagatatgtttcatttacatgtactagttgttattctaaaattggtttgtccagttttacttttttatcttttatattacttgtgctatccttttatttttatttttatacaaatgataaaactgaagctctgaaaaataagtaccttactcaaagttacacatggtatggaagatctagaattgaaactcatctgtttgaccataaacctatttgtataccatgtagactcattaaaaataagttaatttatagaccttagggaaatgctaaaaagaaaattttcttcttcttagcaaatttttcagtcctccagtaataggtgaatctctgtgtgtttttaactaactgtatgtattagatgtgtgagatcaaaatcagtgggttacttagaacagtttggtgagaaaaataaacttcctacaataaacatggtttacaaaaggaaatgtaaacgagaaagtgtctgagataggtctcaaatcaattttgaagtttattttgctaaggttaaggatgtacctgggagagaggtctgtgcctttctccaaagatgtttttgagggcttaaatatttataggggaaaagtgggctggaggggaaaaatggagggtatggcaatccacatgttgcaggagaaaatgagcaggcaggggaatagtcaattatctattcatctggagctgagtaaatcagcactttacataagataaagtgagcacagagtagctgcctgtggagatatttaaccttttatatctagctctctgcttaggaacaaaaggaaaggcagtttcttgcatgactcagctttcagcttaattttattctttgggcatagataattggggtcctgagtttttattttcctttcacatttctcccacaatttaaaaaaatctttaagagaaagcattttagaagaaattgagtctctggtctcaggttttgtctgatgactcatggttgggattgtttattcctagacagataggtcccacattgttaggaaagctcatttttagcaggttgtggagtctcatgtcccatgaggaaaatatagtgggaacaagagagaaataaaacaacacacaaacaaaacaaaacaaaacaaaacaaaaaaagagggaagaacaagcctggaaaactgaaataggtcatattaccctgaagtctacacatcagtaggtaggtatgaaagtggtttgtgtatataaatgggatgctgttattgtcttctgaagtttaagttgttagcttcagttcacagggctttaagaatagcagaacttaatttttcatgttttcaaatcaggaaaagtggggagaaaaggaaaagaaaaaaaggaaaaacattgaaaacattattttggactgaatttgtccaaatggtagacaatagtaaaaattgaaaagaattaggcaaggctagaatctaattgtagaaaataataataattgaaaagaattagacaaagctggaatctaataacagctgtactatagtttattttgaaacctgatttctctctgtccaattgcccatttttattaaagacaaaatcatagaaggatcaatttatttgtaaaataagttttagtactatcattcttggcttgattctttgcataaagtgcagcaagaataatcatttgtcatataagctcactgtttttttttaattggctttactggaacatatttcataaggtgtctaaaactacatctttttaaaagcctcaagcccagacaaagatttctctgtgcctgaagtgaatttctctgtgcctttctgtgtgaattgggttaatttctctctttttaaggtctcaagaaaacctggggttcctgagtgtgtcagaaactgacattctttacttaccacaggtcagaaccctgtaaaggacaaggtatggggccaggttttctaaggagctttcatcagctctataggtcagccccattttctcaaggacatgtgaaaatatgttattccagtcaaagccttggtaaaataaccagtgtctccaactatgctctgttataaaagaaaacagattcttactgaacttttgcaaatcactatattgtcataaattaataatactcacaaaatagcttccaaattttagagaaattaggttgagagaaaggaattatgttttaaattttgctcctaagaatatattttactaaattgttaagagctataaatagcttaaaagaacataaagttttttgtgtgtctgaaaaataaaacaaaaagaatcatcaaatgttttaagtaaaaagtcgtaaaacattatttcaaccttccattagttcagttcatgcaattaactcctgttctgcttgatatttaattaataatccttatgaatacttcagctgtctatgaaagtcctggaagtttttctctccattccaatggtacaatctctaaagttatcagaaacttgtatttacaagtgtgcctcagagttccatagctgattataaactgccctattaaagtatcaatgttggtccggcatggtggcttatgcctgtaatcccagcactttgggaggccgaggtgagtggatcacgaggtcaggagttcaagagcagcttgaccaagatggtgaaacctcgtctctactaaaactacaaaaattagccaggtgcggtggcaggcacctataatcccagcaactcaggaggctgaggcatgagaatcatttgaacccgggcggcagaagttgcagtgagccaagatcgtgccactgcactccagcctgggcgacagagtaagactccatctcaaaaaaaaaaaaaattatcaaagttaaacaacaattatggatgacaaaagtcttagaaaagccacgaatgaagaaacagttcataaggaaatttggttacttctatgaaatacaacaattttatgtaatatcataattattactgatgacatatgcaaatacatatcagaatcacagaactctcatataattttggatcatatactagtcacacgtttatataaatgttataatccaaagaaggttaaacaccatttcatattttgcaatccttcctgcatgattttattatagcaaataagctgaatatgtgtcttctgaacttctggagacttaatataaaaaaaaatgagatcaaaaattttgaatatgattttaaagtgtcaaatatcaaaagttacttgatatcacaaaatagaaccacaggtccttgtaaaataagcaaataatttagccaaagtgataacgatttctttaaaaagggaaaaaaaaacatttattctatgagagaggagacttaatatctcaaacaacaagtcttaataaagacagcaggaggccaattaaatctgtctctcaaatctttgtttataacaaatctattaaattttaatcatcttgaccattagacatagttttgataagccttttttataaccttttatttttttcttaaattaaaaagtaggttaatgctccaaggaaaccttgttaatctgacacaggggccaagatgctggggttgcatcaatgtgcctttgatattaatattttctttagagaaagactctgaattaatattctctctcaaattcagcacttacaatctcacatgcccaactcttcatggtagttcctgggcttagagtggttgaatagttttaatttctgaccctgtgtctcaagaacttgtttattttgtttgtcatcttctcctgggtctgaaaatgaggctttaactgtggtcagtgtttaagatttagcagtatttgctgttctttatagacccaggaatcaaagccgtgtaacttaatagcacaaagactttagaagcaatacataaaaagttacatggatgtacttaacttttctttcttttttttttttttttagacagagtctcactcttttgccctggctggtgtgcagtggtgcaatcttgcttcactgaagcttccagccttcttggatcaagcaatcctctcaccacagcttcccaagtagctggcatgacagtcacatgccacccatcaaaccaatttttgtattttttctaaagacaggcatctcaccatgttttccagggtggtctcaaactcctgggttgaagtgatcaacctgtcttgacctccaaaagtgctgggattgtaggcatgagccactgtgcccagccaaatttcagttcctcctaagcaaatcaagatgttagtaacaatgacataggaattatttcaataaataaaatgtaaaatctgttaggccagttaccaaaaggaaaaaaaaaagacgttccacagtgtgattgcttttccctatgtggactccatttagaaaacctgtaagtcaaactaatgaaaatggtagctgaattagttagacataggaagagtgtgtcctgggttataagtgaaagttttcagatttatagaacaatttagacatattaagaaaagccaagagcacggaatgttatgttggatgaaaacatgtcctctatacatttaagaaactcattttagcatcaggctacaacagcatttagaaactgaagggaaaacaattatgggagctaatgagaaagttgcaggagagagttatctaaggccttctcaaagaagagagaaagttaaaaatagtaagatgcaataaaagttgaatttggcagtaaaaaaaaaattaaaatatcttgtaattatattaagaagaaatcaacacttcagaaaatttttttgttctaaccaagtttttagtgtactagtgttttttcatatcaaagcccagtctctaaaaagtgttattatttccttgtaattacaaccaacttgatcatatcaagttttttaatcatgaattctctttttataaagtgtttacagcttacacaaaccatttacagcatgcttgaacttcctgttttatcctaaatatccctccttcttaaatacctggtcattatattttaggacagaaaatttaccatacaagactctttctcatattaaattattgtcctttgactctttcttaccaaaaaatacctttgtatatctataactttctttacatctctcatatttattgtttcagaaataacctttgagttagacaaaaactattttgctttaaataaacattttttttagaaaactattttccaacaattttttttaaaaactggaaatgaccgagacatttaataaatatctattaattaattcaacataactttagattctaaattatatgacaagttaatttataagcatttatttcattaaatttacccaattaatttatttttaacagattatttaagacaactgtggtagtcatcacttaacattatttttctcttaaccaattttacaacctgtgaatttcaggtgtttattgaagtaaaaatcttaaggtttaataaatattgggctttttggccaataattcaggatttaggtgttttcattaaacaaaactattaaatgccttatttctaaaaaaaaaaaaaaaaacacaaattaattctctttcgggctgcaagctttataattctcatgccaaattttgacactttataatatctgtcagagataagtattgagctgcttgaccaataaatctaaacaataatgtatgttgacaatactgaagacatttctcattttattttaccaataattttaaaaccagtttacttattaagcatttatttgagtcacgtgaacttgaaaaagcatttgggcttaaatgtttatttttctaatgaagctcttttatgtatatttggaagtgaaacattatacacacaatacataaatacatagacatattagacatgcagacagagtagatcttataaattcataaaacctctttttcttcctatttttgacttccaatttcttgataaccgttacccaaggcaacttgtcagccagttagccctaaatttgcatactaaaggaacaactcaggtgaaaatcagacagtaaaatttacatttccaagtggggagagagagagacagatatatatatatatatatatatagagagagagagagagagagagagagagaggaagaaagcccactgtgctagagggaaattaaaaatggatgccaagtcaaacataaaattatataaatcaaccataggattttataaggaaaccaattttatttagataggtagtttaaaatttagtctttatcttttaactgcacctctgagctctaggtagagcccacactgaatcctgggtctccaaaaagagagatatcatgaaactaggtcatgaaatgattttacagtgcattttgttacaaagacatttctgtaaaacacacaaaagaaaattctaagcctccccaaacaactaaatggactcctctcagccaagcacattataaagtaaacactagttcaggtcatgatgggaatgggtggttggatatgcttccttattaccttcctccttttggaattcaggcacagctgaccagcattaatgttaaaacagaaaccttaagactgacaaaacagaatctttgtaccaacgtgacagacagcagaccctgaaataaattaaactattttaccccaaaatatatttctttggcatattttgaaatggccttacaaggctgtctcttatagagaaaatctacattctgtagagaattcctttccatttccaggtctttttcctgatccaggagagaattaattaagagtctggcactttataagtctgataagaaatatgtataatatactctctctaaagtctgctacctgggtgcttcatttacttataagagccttggtctccacaaccccttatcttaacacagacatttccttgtattggtccgaggactttaggtaaattgtgtcaatcaattgccaataagaaaatctttgaatccacctatgacctggaagcccccactttgagttgttccaactttccagactgaatcaatgtacatcttacatgtattgattgatgtcttgtgtctccctaaaatgtataaaaccaagctgtagcctgactaccatgggcacatgttctcagaatctcctgaggatgtttcacaggcaattggtcattcatgtttggctcagaataaatctcttcaaatattttagagtttgactctttatcaacatttctctaagtgtttaaaccatatcctttatcatcttaaacatacaagagtagcccccctagcaataactatttcagtcaaaaaagaaaaaaaaaaaacaggtaacacaatacaaaagcaagtggtttaagatctgagaggaatttgtttgtttatactcttggggagtccataaggaaaaacagaggtttctcccaaaaaggagtctgatggcttctctgatttctttaaggaatcccaggctgttagaaattatgttaggtcctttatgtagcggagtgtggcaagaggagggagagacagtcagaagcaaatggaaaaaaacagaattcagacaactgagaagaaagaggaaaaaaaaactttttctcaaaaaacaagatcctaggagagaaaaaaggggacaaaggtcttttaaatgtatatacatcttgggtatttgctttaaactgagctgacttttaaccactggaactcttaaaaaatcctttaaaatttcttattaacatattttagttgggacaaactgctgatatttcaaaagtaacacaaatatcaaaccggaaaatgactggattaggaaacaaactcaggctgtcatggtgaaaaaagggcagaattgtagctcctgaactacagcatgggttagatggctgccattgctttttcagtttggcttggctagcaaaaggtagacttgttaggtaaataaagcccctcagggggtcaaaaattactctttttttgcttttgttggcctttttgtttttcttcttccttttctttcagcttcaggaatttagccaatccagaggtcttgtttcccataatttagaagtttccttcagattttgccaaatcaggtagcattggtcaaaccaaaggggaagaagactgaaataacaaaaacaacaacagaagaaacaaacgaaaaacagttaagcaaaagaaccaattgcacaatttatatgattactgagctctctaattgtaaggagaaattaaagccagctggttgttagtcttaacttttagtctttaaggagaatttccaagacaatactccaattcagctacctacctaggaatggagtgctctctaccactttagaaggagaaaaaaaaacaaaaaacctcaaactcaccttcactgttggaagcaagctgaaactccagaaagaagttgtctgctctctatcgtcatgaaagcaggtacacacacctttctcatcggatgcgagtaaaactccagaaaaggagctgtgcagcaaaataaaccttagctgttaaccaaattttgcgtgatcagggattcactggagaagggagttcccaggcctcagcaaattgtcctattggtttaagcaacaaatatagctgaagctgatatagataagatcactgatcagagatttgtcaaaggtcagggtcaccttcatttctgttggtcaccaatctgtaaaccaaaaagtatctgagacaggtctcaatcaacttagaattttattttgccaaagttaaacatgcacctgggagacaggtctgtacctttcttcaaagatgattttgagtataagtatttaaagggaaaaagtgagctagaggggaaagagtgagggtatggtaatcctcatgttgcaagagaaaaggagcaggtaggagattagtcaattatatattcaactgatgctcagtaaatcaacactttacattagataaggtaaacatagagtagctacctgtggagatatttagccttttatacctagctatctgcttagaaacaaaaagaaaggcactttcttgcatggctcagctttcagcttaattttattcttttggcgtagtgcattgagatgtcatgttttcattttcctttcacaggaccaaaacagttttttacaaaaaagaagtgcttaacaaatgtgtttttaaaacaaacctttataaatcttagcatcacaaatcattattctatagaagtatttccatcataccatttaatatgatgggaaatttctttgtctttttttagtaaacggattttaaaactaaacattatgatgataaaatagcaagtaaatataaatttaatttaattgttatggtaattgatatgtaaacatttcccaatcttatttcttaactttaaacaagtataatggttaatctaaagctttattctctcaaagtgctggtgccaataacattttacaatatcatattctcagtaattttttctcattatccagtagtcaaaactgacaaatcctaagtcaaatataattttgatcaagaatgaatccaatttgggacttattttaaattttaaaacatatacatacgtatgataaataaactgcatatctatccatccatccatccatccatccatccatccatccatccatccatccatcctctatctcctctctgccccatttccccttctccttctttacctgcctccctctccctttctggattggacctcccttacctctcctttttagaggagaggaggaggtttaattcatcctttctattcttagatacaagtttatttgagagttttctgtttatattcataacactatgaggcagcaatgaaaatattgcctatcctaatatgcactagagcctcatgtggatttttatctcataaacatttttcagcatttttagtaaagaaacataattctcatatcaaaatttccaaagttaagaactcttctcaacatgaagcatttttataaaggataaggaattgcatgatttggtaagcagcaggaaatgggcaacttggaaagaactgtctctaatttttaactggttttatagaaagcttgtttctgagacctgctgggtgtccaaattggttcatgggttcagagaataacattagaaatccttagaacaaagataatggaatctcaggccttctgggaaatctggatcaatggatgatatccaatttcctcaaagatcgacttcagttgaaaagttatacacatttattcttattttaactattttatgagatcttgacatatagaattattaatagtatgactatctgagtaaaatatctaaaattttgaactttcatttccttcatcttcaaaattctatattataggattgttagatgactaaattaaataatatatgtagatggcataattacctgcctgaattatcagtcaatatgaccagtattcatgattatggtaataatgacaatgacaatgatgctgtcaaagccaaactcaaagctttgatatctatttcagttcttcatgtaataaacattccttgctctgatttcagatattctactgccccaaatttccaactggatgtttcctgggtatctaatattaaaatttatctttaacaatttgtaaacttccatttctccttccagacctatcaaccagtatcatctacatcatctcccccttcccaaacctgccaccatgacactatccttatcttggtgcctggcattctcagaatgccccaggcctgctctcccacacagaaaaatgtcctcctaggtgtctccctcgcaagcacaccatctgccttccctcatgtcatctgatctctcatctctgcctaatctatctgagaatgaaaatggcgactacttactggatgctttttccttgacaagcacaataattattttaggtctatatcacatttaattttttcaatagctttttcatttacagatggacataccacctcacattcattaggatgaccattatttaaaaaaaaaaagtgttggagagaatgtggagaaattggaagccttgtgcactgttggtggggatgtaaaatggtgcagtcactatggaaaacagtatggaagttcctcaaaaaattaaaaataggggccgggcacggtggctcacacctgtaatcccggcactttggaaggcggaggtgggcaaatcatgaggtcaggagttttagaccagcctggccaacatggtgaaaccccgtctctactaaaaatacaaaagattagctgggcttggtggcgggcacctgctactcaggaggctgaggcaggagaatctctagaacctgggaggtggaggttgcagtgagccgagatcatgccattgcactccagcttgggcgagagtgtgagactctgtctcaaaaaaaataaataaataaaaatagaattaccatatgatccaccaatcctactttgggttacttatccaaaaaaattaaaatcaggatctcaaatagatattctccctcccgtgttcactgcagctccattcacaatagccaagatgttgaagcaaactaaatatccatcaatgaatgaatggatagagattgtgatatataatataatataatataatataatataatataatatgatatagtataatatatatgaatattattaaatattcaaaaagaagccctgctctgtgcaacaacatgaatgaactggtacgacattagctaagtaaaataagccaatcacaaaaggacaaatactgcatgattctgcttacatgagatatctaaagtagccaaacttacagaaacagagagcagaatggtcgtttgtcaggggttgtggggagggacaaatgaggagttgctgttcgatgggtgtaaagttttagttttataaggtgagaaagttctagagatctgctgtacacccttatgcttataattaacaatactgtaacttacacttaaaaatttaagagggcagatctcatattatgtattttttgaccacagtgaaaaacattatgctacataatggggattctgaaaagaagagcacagtttacttctacagctgtcagtttctaaactgaaaaaacaacccttgaaatgaactatgttaattgcagcgctgttattagactttgtcagctaagatttacattttaattcatttgataatacacaaagtaataccctatcttcatatgaactctggatgtctcaatatgcaaaatacaaatttgaaagagaaaaattttgtgcttattttctgagcttattaattttttgaaagtagctactcttagtgcagatggatttttttctttttttgtccagcttggatgtaccttagaaaagaaatgttcagatgcatttctaatagaactttatcatgtctggacaaacaaaaacttagcaatatcaaatacattactataaaaatgtcctgtaattagatataataatctatgaataattaaatgttgcagagagacggcacaacaaaaccacacaagttgtaaggcagctttttggcttcttttcatatatcccataatagctatgtattaagatgacaatgtttaagaaaaataaccaaagaacaatgctctgataggctaagaagtcactgatactgattatatttttaaaaatatgtcttgtaattagatcatccaaaaactgtattgataatgttaacttttgtttttatagtgtttgaaagtaatatagataattaaaaaattaaggccaattgaagtttacactttatattgatcccagtcatattttctagcacctcctattctacctcagtcttttagttttatgttgttagcatatacgtttttaaatggatatataatagttgtgcacatttatgggacacgtgaaattttgatacatgcatataatcaatatgtaatgatcaaatcagggtattcagaatacctatcacctcaaaaatttattattcatttgtgttggaaacattttaaatcttctcttctagctattttgaaatatataataaattattatggctaactctagtcaccctacagtgttatcaaacattagaacttctttcttctatccaactgtgtttgtacccattaacccagcccctcttcatccccctttcctcagactcttcctagcctctggtaagcatcattctaccctctccctccagaagatctactgttttaactcccacatataagtgagaacatgaaatatttgtctttctgtgcctggcttatttcacttaatataatgacctccacttccatccatgttgctgcaaattacaggatttcattctttttatggatgaaaagtgttccattgtttatcatccagttttataattcatcatttcctcctcaattctcctataccactgaattcattcttccttctagaaattttttttttatactttaagtttaagggtacatgtgcacaatgtgcaggtttgttacatatgtatacatgtgccatgttggtgtgctgcacccattaactcgtcatttaacattaggtatatctcctaatgctatccctcccccctcccccctccccccaccccacaataggccttatttgtgatgtacttattggtttaggtgcttatccccctcccccgttcagaatataagttatttgaaacagggctgtattagtccattttcacactgctgataaagacatacccgagactgggaagaaaaagagccttaattggacttatagtttcacatggctggggaggccacagaatcatggtgggaggtgaagggcactttttacatgatgcctgcaagagaaaatgaggaagatgcaaaagcggaaagccctgatccaaccatcagatcttgtgagacttatttaataccatgaaaacagtatggaggaaaccaccccatgattcaaatgatctcccaccaggtccctcccacaacacgtcggaattatgggagtacaattcaagttgagatttgcatggggacacagagccaaaccatatcaagggctcacagattattactctttgtacatgcagaatttaggttactgtctgaaacatggcagttgatccaagcaaaaaagaattaatatattcaaatattctataatatgcccacctcaaacacataaaaaagatactaaatgttgtttttatcctattttttctaaggccctgaactcttaagttcacccaggggaagtaatctaatttctaaaagggacataaagtaacactgacattaaagtcactggatatatgaggctgtcactagatataatagatcgtccaccatggtgctagatttaagtcatccaggctatattgttaagatgactttatcaaatctttcttggaaaagctgtaacacaaatcttgaacaattgcttcgcttagcgcatgctgtttacaaaacttcaataactagagtgaactttgtttctctggatgaaccagaatatagccatgacctatccctgagttcttaatttgcttttttgccatgtaacctggagagtaaataggatgaagaacttcagaacccagtttagttgatgacagggttgtggttcaggagttaaatggcctcaaattcctccactgaacaattaattaataattaatactggcacttacttatgccaagctctgtaaaagattctgagtgatagtaaatatcttttctcttttcccttgttagtgaacatcttttatctttcttctttttttttaccttttcgctcttatttaggagtttattccacattcctcctggttcttgtttcagctcaattccttctcttgagctgaatggaatgaaagaaataatgccattttattttattcttctttttatttcaaagaaaattaaaacatgatcaaattgtctgagaatttgctgtttccctcaatatgttctgaaaaataaacatattattctcaggctcttacacataaatattttacaatgatttcattcttgagtccaatttctcttctcagcaaaagacccaaatttccactgtcatcctatgccattccttctaaattttatcaccatattcgtaattgggcccaggtctctacctcacatatagtgagtacccaatacatgtttgtacggacatcttagaaattgattatggttggctgagtgcaggtaaaagtaatagggtgtaggttcatgtttacaaatatcttgatagaaattcccagagaagcaggaaggaattctctctaaatgcttaggcaccttttacatcaaggctaaatcctgaaaggtaaagactgggtagcacaaggtgctgacctcttcagaagagttcagatgaagaagggagaaatcctgtgcctgtagacttcttgagtggaggaaacccaagagatcagagcttgtttaggagcctgagttacccataaaaatggctgaccaataaaataaaatgcctcagaaaagtgacccactggaatgaacactctagtatcccaaatgcattaatgataggatttgcagatgcataaaatgaaggtagtctgggcaggagttgctttctgattgacatgtctctagctgatacgttgtgcgcgtaagtggtagtttgaggtctattaaattgagtgtctatagaagcttgctgactccaggctgctgtgctacctttatctatttctctagatttagatctcaggatttgtattctgaaagcttatgtggcttggatttggtcttactctaataagtaatcaattattctttcttttccacatgcaatcttctcacagtttatggaagacttttgcaaatgtcgctatgacactttattgtcttgtatttatacctttttgttgtatcttctcatactgtctgtgggattgcccaggagacttactggcaaatggaacatttgcaaacttgatggacacatatgctgaaagtgtttgcacattgaggctcaccctgtttctcttcttggaattctgctgctatgtctgaaaaactaagccccagtcaactcccagatatgtgaaaggccatccttgataatacagccaccagccaccttggcatctgaatgcagtgcttgagagaactcagtagagataagcttagttatcacagatcagaagaaccacctgagcaaccttcagaatagtgagctaaagaaatgcttgttatttcgagtgactacatttgggggtgatttgctttgtagcaaaaactaactgacagagaaagtgatacctagacttgagtgcttccataacaacaaaaccaaacatgtgaaattaactttagaatcattcagtgggcagaagttttaagacgttttgtgaaatctggaaaacgggcaagcaaattattaatggaggatgaaaagattgtgatacatgttatgtaagattacaaaacaatgataaaactgttgcctagagtaatttgggagatgaaaaatgtggatcttggaaagataattttcaggaacactttaaaattttattggcttcttttagttttctgtgataagttataggaaaagagagataagctaaagaaagaactgatcagtttgcaagcagagctcatatggaatagagaggagccagggtgtactggattgggaacataactgtttcttatatgaggtctatctagccaagaaaagattctcagactaaattaaaacctgagggtgttaatcaagatcagggcacttccagtaaaacatttattctatgtcaagatgaaatcaaggacttaagaaaaatttatggtgatatctggtggactttctccactagacaaaagaacttctaaaacccttaatagcattgcctcatagcagcttgacaaactgcccaaagcagagagaggccggttttgaaaataattgtggatatgacttttgttaaatgatatatagaaagcccataaccttgttaagggagttaaatcagcaaagggcagctaacccagaaaacaaaaacaaacaaacaaaaccttgagacagttcaagtaaaatagaggtctctataaggaacttaacaagcaaaaaacaaacaactccattaaaaagtgggcaatggacttgaacagacactttttaaaagaagacatacacattgccaataagcatattaaaaatgctcaatatcactagtcattaaagaaacgcaaatcaaaactatgtgaaattccatctcacactagtcagaatggcgattatcaaaagtcaaaaaaataacagatgctggtgaggttgtggagaaaagggaatatttatacgctgctggtaataatgtaaattagttcagtcactgtggaaaacaatgtggtggtttttcaaagaactcaaagcagaattaccattggacctagcaatcccattactgggtatataccaaaggaatataaattgtcctaccataaagacacatgcatgagtatgttcattgcagctctattcacaatagtaaatatatggaatcaacctacttgcctatcaaggtagactggataaagaaaatgtggtacacatacaccatggaatactatgcagccataaaagggaataaatcatgtcctttgcaggagtacgggtagagctggaggccagtattctaagtgaactaagacaggaacaggaaaacaaataccacatgttatcacttataaacaggagctaaacattgagtacatatggtcacaaagaaaggaacaatagacactgaggcctactttagggtagcgggaaggagaaggatgaggatcaaaaaactatctattgagtactatgtgtatcacctgggtgacaaaataacctgcatatcaaatcccctgacatacaatttacctatgtaacaaacctacacatgtattcctgatctaaattataaggtaaaatgaataaataaatagaaggctctggactaccaaatttctattggaagaagacttagaaagcaactgaactgtcaacctgggcaatttattttttacagaaaaataagagtgccttggaggaaggatctaaaagtccagggaccatagcgaagaatcagggaggaaaatgtctagggatcctctccagtgagtagaacagcattctagtcaataaatattttctaatccttggtgtagggtttcaggcaacatttgccctgccaggtttcagaattgttatggaccaatgattattacggtttttttttgtcctctctctttatgaatagaagtgtttttttcagttgctctgactctgtctcaatattttattttgggtgaattgagaatcgaatagcttatctttttagttgatatgctttgatcaagaggagttgcagcagagttgttcattcccgcctgatatggatcagaaggtactagactttaagcctgatactgtaattttatgaagtttctggtagttttgggagagggtacaagcagagtcctctatcttaacgatgggaatactttttgagaaatatattaggctattttgttgttctgtgaaaattgcagagtatacttacatacacctagatgatagagtctgctacacaccaagactgtatgtagagcctattgcttctaggctaaaacctttacaacatgtttactgcactgaatactgtaggcaattctaacatgatgatatttatgtatctaaagatatctaaacatcgaaggcaacagtgaaaatatagcattataatcttgtgggaccactgtcgtaaatgtagtctgtcgttgaccaaagtgccattatgcagagcatgactatatttgtgatgtgggagggatatgaattttttgtgggcagagtgaaattaggccagattgtttgcagaatggctgctaaaattcctttcgcagtagccatgatccttggtagttcactcctacagtgacttgggaatgtgacttatttgtattcgcatgtgacttacttcagcaaatgggacattagcaaacttgacttagcagtgattgtgagttgaaaatcgatcttttcctaaccattgatctctttatcctctgtgtaaagaagttatggccagcctgtttgatgagtaaaacttagccagccaccactgtttccctacatgcccctgccaaccactagacatctgagtgaggctctgctaggacactgagttgccagccactttcctaactaaatatataagggacttctgaagaagttatttaggtccatccaagtcacgagaaccaaacaggcaacccacagaattatgagttagtaaatgattacttaaaacactaaatttgagagtggcttgtgatgcagaataagttaacatgttgtctaaaactcttatcatatgatatttcaattacctgttgggggtctgtacctattactctactattatcaccatgctgcaacagaccatgtcttagtcaccactatatttctagcaccttatataatgtctgggagataattgggaagggaaatgtaatgaactctattgcccctgaaaaatttaaaactgattgtgtgacttccctattgaaaattctataatatttaagcatgtataaggaggaatttaataaatatttataaatgcaagttaagcttatagcatgccttttaaaacaaattaataattcttcatctttgtgttccccagctataaaattcttataaaattaatgcattaatgaattcataaaaaatttattaacacttatatcaggcataaaatatgccaacattctaacaagggaaacagggctgaaaacaaaggcaaatac

SEQ ID NO: 567 - DNA, 40001 bp, Homo sapiens
ggagggccagatacggtggctcacacctgtaatccaaacactttgggaggttgacatgggaggattgcttgagtccaggagtttcagatagtctgggcagcataaccagacccccacctctaaaaaagaaaagaaaaaatacaaaaattagggccaggcacggtgactcatgcctgtaatctttgggaggccaaggtgggcggatcatctgaggtcaggagttagagaccaggccggccaacatggtgaaaccccatttctactaaaaaaaaaaatacaaaaattagccaggtgtggtggcgcatgcctgtaatcccagctactcaggaggctgaggcaagagaatcacttgaacctgggaggcagagggtgcagtgagccgagatcacaccactgcactccagcctgggcaacaagggtgatactccatctcaaaaataaataaataaattaaataaaaattagtcaggtgtggtgacatgtgcctatagtcccagcttctcaggaggctgaggtaggaggatggcttgagcccggtagttccagtttacggtgagctatgctctcaccactgcactctagcctgggcaacagagcaagaccctatctctaaaacaaacacacaaaaaactgtgcaatggtatcttaagtcctacatcctagttcaaataagatgttgtggcgtatcctaggaatttattgaaatgttgttttagtggtaaatttttttcttaaattgaaacaattcattaacaaactgtgaaactcaatccatttctaatctggataatacgaattattagtaagaattgtttctgtccactacttaaaaatctttaggttaaatgatgtcttctggcctttgaaaaatgccgtttttcatgtccttgactgtttgagatacctctcctattgagactattgctggctgaatgagtcctgggctgctaaacacttgcgttggtcaaccccacaaaccaagaggagtcggagttttcctctgcctttgtctgctgcttcattgctcaaggtcatctttaatggaatgaccttgatatttgggaataggttttgagaaacatgcactctgctctgatacctaaaatgatattattagcataatcactgtatactttctgattcaacgtaaaacagtaatagcaatcacacttcatcatgatcaggaatatcttcagttggaaaatacatgcttacaattgcaggctcttcatgattacagaatctcaccttgattggatacaatgtgattattaggcaatttctgtgtgacagtccctcactcaccaacttttactgctgagaattgatgatttaccaatactttgtatcctcatgatcttgtatatcatatactatccattattttatctttatcttatggttttataataatttaacttcacttccaagtatgaggttagcatgaattctcaggagttaatagaacgtgatcttgttctgtttggattcatccctatttatggtaactgtattccagaacttatttttgctctttatggaaaaatggctgaatctcaactcgacagtactgtgacctggagattttatttctcatattaatttatacaggcataggtaaattgaatttttttgaatttgcaaaaaaaaaaaaaaatgatgggagagtctttattggaatcatgaaggaaataacttgatttccactgcttgatacttgattctctgggagtgaaataacttttgttgagcaactgtaattagagatcagtgatctgaaaaagctaattacccaatatcaatgttgatggtattctgaaagtttggttcatatcagtctcagagtgtttatgtcatatcaatatttttattagatcaagtttataagactcaaatatctcataatttcatagttggcaaatgcaatgtaaagctggaatttattttaattacaattctcttcctacatgttaaaattatttcaacctttagcagcatacaattattacagaatagatcatttttaatgattcattatgtatgaggtcatttgacaatgcaattagctttgtgatgaaaatttctattcttttgatcattctgtacctgtaatgaatgaggggcgttttacttctaatttcctgaaattagaagattaaagatagaaacagacttgtgtatttaaatgagacacaaaatgactacattgcattagtcctttagctgtgcaccctggaactgaaaactttgtggtgttacttctttttctcattattaattcagcagatccattggtactgtgctatctgcttctattatcgccaaaattttcgaagtgtgcttttgactgtgatcatgagattaaagaataggtctagcaagttctcaggaatgacacgcatcagcacattgtgcataagactgagaaatgaagccaaaaaaaaaagctagaacagaatttctgaaaccctgtataaatgttgcaatgtgcagtagaaactattttttggtttttttgctattttttcatttgtttgttttactttctttggccagatatttactatatatccaattaggccatattgtgttatttccaagctctttgttgcattgtagttaatcactgagacattgtatttcccatttaaaatgaatttcaaaccaaggacaacttttatagtcaatgaaatttatataagctattattcctcatctagtaaatacaaaaggaaattcaattgatgtgaaaaaaagataaaatgagttctagatctattaagatgtggttaaggatggaaacatagctgaggcacatcatatatgtcattgtgatttaaactgatactctcaagttacttgcggcttttggctcatcacaagaaaacataattatatattggacagaatgatggtttatccttagaaattttaaggctaggtttgtttgtgcataaagttttattgtcattttgctgatttttttccaaaaacagaagatgtccaatgaaatatttttaattcatttgatatcaaaggtatataaaaataattttcacaatcagaaaagtataaaacagaagtatttttctcttcataagcaaacatatcatttctctatgattaatgcatcttttaaatgtagattattgttagtgtgactgtttttaccttggaaaataggataaatgaaaaatgaaactctcttaataaggtatagtcaacttcttattaaaactgattataaagggaattaataaatggaaaacttcaaagttgataacatgggatttaaaagtctttgcactatgaaatgtttgacctcacatataactgcatctgacattttggaattctcagtgaagcaaccctgggacattggtttttggcctggatttctacacctgccctaatctctatgacttttgtaaccagaactgtatatggaaatatacatcaagagatttctgtacctggataagtcagcacagaggaattatttttcactctttatagttttttattgaaagaaaaaaatattaatcttttgtccaaatgaaaatagaactctaacatttcatgttgtatgaagaaattatatataaatttaaattcaatatattgaattatatagactgaattttgtaattaaactcttaacattaaaatttaataatgcagtatagactatttttacccaaagacaaaccagaattaaactatattttattgtaaatcaaaagtgtaatatatatttatagttagaataaactacgtaagagacaatctcactccagatcttgttttatttctgcatatagtcaaaaacacagaaactttcagcaatatctgcctccattaacctagtacttaaaaaaaacagttgtgtagttaggaattattacagaaaacatacttatgtaggtcctaagctgccataacaaagtaccacaaacgaggtcttaacaaaaaattattgtctaacagtcctggacactggatgttggaaatcaaggtatgggcaggaccatgttttccctgatggctctaggaaagaatcttttgcttcttcctagcttctgatggcttctgtgatccttggtgttctctggcttatagctgtgtcactccaatctctgcctctttcaggagccttcttacctgtatgtgtgtctctgcatgtccacttattttactttttttgcaacttcaaatttgtttcccttttttttattaccaagttttaattttagaagtacatgtgcaggatgtggaggtttgtaacatagttaaacatgtgccatggtgattagctgcatagatcatcccatcacctagatgttaagcccagcatccattaactattcttcctgatgctctccctcctcccactccccaccctctgggacaggccccaatgttgttctccaccatgtgttgatgtgttctcatcattcagatcccacttatgagtgagaacatgctgtatttgattttctgtacccgcattagtttgctgaggataatggcttccagctccatgcatgtcactgcaaaggacataatctcattcctttttatggctgcatagtattccatggtatacatgtaccacattttctttatccagactatcactgataagcatttaggttgatttcatgtctttgctattgtgaatagtgctgcagtgaacctacgtgtgtaggtatctttataacagaatgatttatatttctttgggtatatactcagtatgggattgctgggtcaaatggtatttctgcctctagatctttgaggaatccccacactgtcttccacagtgcttgaactaatttacactcccaccaacagtgtaaaatggttcctttttcttcacaacctctccagcatctgctggtttttgactcttcagtaatagccattctgcttttgtgtgagatgatatctcatcgtggttttgatttgcatttctataatgatcaatgatgttgagattttttttcatatgtttgttggccgcatgtgagcaaagaatatccaaccgatttcttatgaataaatgagtcattgggtttagggctcaccctaatccacaatgaacttacattaactcaattagacatgccaagatcttatgtctaaaaaaggtcacattcataggtgctgaggggtagaacagggacagatctttttggggcacagaactcaatccactatatcaccctattcagagactcatgagtgacattttgagtaacttgtggatctgttgctccaatggatctccttcaatgaagtggcaaattctaggctccagggcactttctctctctgctttgtctacctcttcctgttgccagattataggtgatcgggacaccattaagtcttccatcactcattctccataacagacctccccttgcctgcttacatctgctgcctattaatttcccgcagctccagactgcctgaatctgtaacttaaaagccaggccagttctgtgagaggtagttagtgacccctggctttctctttttcattttcacactctcacaagattgacagacagttagataggactatcattcttctacatatacacaccaggagacacacctttctgatggagacattgaggaattactgtttgtagagataaaatacatgcaacaatttgaaaaaaaacactcacaataaagagaaaatagagaaaaatcaacattttcatagagaaaaaaatcaacattcgaaatgtaaagttttgcaatattttctgtgcaacattttctgatattcttggtgtataatattaatcattaaagcagtacagtactcataaatgtccttaaggaaagggatctctgaatatatgtatacccaatacttgctaatttgagataattaacaaaatattttcacaaatacccaaatatataaatgtgccctgtaaatcaaagcaaagaatttttaataaaacctgcaaatgtctttttgcatttctataattgcctataactggcttgtaaaagttgtacgaccttacttcattcagctcctctgaaaacttgtttcattctagtgtctaatgattacatactcattttcttttagaaatatatgtctgcgctcacacacgtacacacaaatggtaagattgctttcaataatttggcttttatatttcagcctatttcttaactaaaattatattcacaggcctagatataacttttaataattaaactgattataccttactccaaaagcaaatgctattacatataataaagacattttcttcaatcaaaacaatgaatatgttagctaaaaaatgtagaaaataggattcattgtgtttttatttctttctattttcaatttgttgttttactctttattagttttcctaaagcagggggtgcttgagccttcgtttcatacaaagaccactcagtactgaaataataatattttaaaatctgtattaagcttattctttttggtcagtgatctctttttgaatccttttccaaatgcagtcacaaagagtataattagatgagcaactataaacctttaagcaaacatcactttttgatgagctggagaaaaattaccatgtgctgataactctttggagaatgaagaattaatgaattgactttgttttacattctctttaaagtttcctaaatactatcttgtgttatattatttgtaaagcacctttatttttacaatacatgataaataattgttaaagaaaagatgcacttatatgtgaaaacctaagtttgcagtttttttaagaaggttttgaaaaaaaaaagcacaatggaaaaagtttaccatgctccttcttgaaaaagataaggatttgttaaaacctcaataaaaataaaatctacctgatcctttgctcaacttgttatacaatgttagcagtactgttatatagtccacaactaccatataaatagtagctcttttaaaaaataataatagtgaagtaaacttctagtgaatcaatttaccaaaaaagaaatgcttttgtgctgaataataaatcatagccattcatgatctcctgattaaccatttgtgtatggctctaatgacatagacaaatgacttgaagttacggtctgtagattttgtatcccaaagctacaacaatgttgagtatccttgaaacagattgaatacggataacaatgcaaagcaaaacaaataaggctgaatcctatgtgccattattataaaaccatcaatcagtggtcagatgcagtgtgttctcttagttaacaagaagttttctgtttttgcgatatgcattctctcaaaaaaggtcttcacctggggaggactaggagcgtatctattttaataaagagagcatccagatttgatatcaaaactactgacagatctctttgcttgaaatgctcgacatgggttggctattcaattatgaacgctgttaagaggaagtactccaagtggaattccctgccgtttggttgaaacagcagaagttctgataaaacattaataatatgcccttggctatctcaactactttgcccctagatgctggcagcctgggcagtgcgtgcatgttcactttgattattgcatttggctttacttcctgtttctcacattttgaacatttccgatgagcattctgttttattggtgagaaaggatacagcaggaaatatggctgaatggcgtccaatgggaaagcatgagaaaatttcattaaaaaagagagaacaagaggaaaggaaagagcctgagtatgctatgcctacttttaaaataaagagagctcattttgcctcctatggaaacacaaggctggacaaagcatggaggagaaagtctgaaaacagaggagtcaccttacctaataatttttaatagaggtgttctaattattacagctttacccagatcagacaagatgcggagatgataaccacagtggaaacgtggttggtaagcacgtcaaagcgtgggctggtgtgggaggctgccctatgtcgcctctgcccgtgagcagtggtgacttcgcttagatgcctgatgcctcaggcttccagtcctggttccttgtgtaaaagcccccagtggatatgtcatactgaattcctagggaacgaaagtctcacattacacacattcagctggtaacaaagaagaaaaatatatgtgtttttgaggaggaagaaatatgcgctagaaatttgctaattttcacattggcaaactgcaaagacagacttcaaaatgaaaatgagtcctgtggatttttaaatataagtgcaaattagccaagtgctactagttctgtcatgtatgaggataaaacagggcattcagctctccactgcataagggataagaaataatgtatgtaatatatggtttatgctgacgttaacgtataaacttgtttctctttaactttttcctttgtaataagcaggtacttaattttggagctggttgtgttcattattttattttattttgttttattttattttattttattttattttattttattttattttattttattttattttgagacagtgtttcactctgtcgcccaaggctggagtgcagtggcacaatctcagatcactgcaacctctgtctcccaggttaaagtgattctcctgcctcagcttcctgagtatctgggattacagacatacaccaccacaccatgctattttttgtttttgtttgtttgtttgtttttgttttttttttttagtagagacaaagtttcgccatgttggccaggctggtcttgaactcctgacctcaagagatccgcccacctgggcctcccagagtgctgggattacaggtgtgagccaccgtgcctggcctattatttttaatataacttttataataaaattttttgagaataggtgaagttttctaacctttcaatataagcttgcttttgcaaaggagatacttttttgagagttgaaattgcttttcttttatgccaaagcataggagattgttgatagttttgccagttaagggaagcatttaatacttctgttaaaatatattttagaaatgagatagatatgaaataaatgctcttgacaactatctatttgatagtagatagaagtaaaaatataaagggagaattattgcttttgtaagaattattgcccctataaagaaagctgggaaaatgcctctttcaatcacagggattttaaaaattcatttattcaattatttgataaatgtttgttgagtgcctactctgtgcaaatagtactaaatgctgaagatgtagaaatgaactaataagatccattacattctgtttgaagacacagatgttaaatgcctaactgcaaattcagtgattttaattgctgtgcatgttgtgaaagagaagcacggggtagagaatgtacaggggtctgagaaggcttccttgataccttttgaacagagcactgaaaggtatgcagaaattatctgagcaagtttgggaagaaggagagcagagctttccaggcaaggggacctgcatgtgcagggccctcaggctaggaggagctgacactttttaaaaaacgaaagaagagatgtggagcaaaaagcatcacacagactgggaatggcccacacaggatggtgcagggctttagtgccatgtcaaagatttgttttttcctcttttttttttttgctgcaaaaaaagagaagccactgacgtattttaaacatagcataagcaactggaagatcttagtatcatgtcgtacaattttatagctaaaataactgaggcctataaaaggagaaatgttattcccaaatccccagtggaatttagtatggaaggtggaaatattttctctaaactcctcagaaacattttagtggagggtgatatttacaggttaagaggccctggcattctttcctgcacaagttaagttaaactgggagaagggatggaaacataccatactacatttatagaacagccgttgtaataattgatggggaattaataataactgataatataataaaatgataagatcaaataattctctgtattaagttaatactttatatatattagtttttgaaatccacctgtaaagggatatatattttccctgcctcctatttcccatcatgttcactccacacattttcaaacataaattatctcatttatgagtgatataaaaaccatagttgagtcacctaattttaccgtttaagaaatactggaatctggactaagaagtagattgtgtccttgggtgagggtactggctctgaatcctgactctcttgttttaaaatatgctctatatatcctgtattttggactttggcaaagttagttaacctctctattcttcattagctatatatacatacattagacacgcacatacatacagatattcatatatatgtatatattctctgatgttatcatcaaaggatatatatctgtatttcttatatatttatgtataaatgtatttgtacatttataaatttattttcatatttatatttataaataagatatatatctatatgcatgttttaatttacttcattaattattttaatccttgaaagtacactttctctttataaatacaggtatacatacatacacacacatatgtacacatacacatatatacacaaacatctagatttttgttttatcatatatatgtatatatgtacatatgtgtgtgcatatatgtatacctgtatttataaagagaaagtgtactttcaaggattaaaataattaatgaagtaaattaattaaacttggctgttaaagatactggagaatggaaagacgtaaacaggtacatggatatatgtgcatgtgtatatatgtgtgtatatgtatgtataactgtataaagagagagaaagcatactttgaaaaattaaaataattaatgaagtaaattaataaaataataaaattacttagtatatttcctggcatatagtaagtacatgataaatattaactggtatatgtcatacttttagacaagaccaactttgaagatagagattaacatatacagagatagagattaccatccatctaacatgtagatataaatttacatcaataatcaacctggccccacaaacccttgatcttgaaactcaaactctccatcttgaaacttccatcttacttggccattgaggaatagagtgagttccttcactgtagatgtggtaagaaactctttctttagccaagataattgaaatttatcataactaatttaggttatgagatgaatagaaaatgtacagactgtattcttacaacatacatataaacacccagacatgaagagtttttcaaaataaaaatggctgatccttattttagctaccgcataacaaaatattggcttgagcaataataactgatgtgacacccaacacaagtggatctttctctgccctttaaagttggctattaaagatactggagaatggaaagacgtagacagacagacagaccaacagacagagatggaaattctcacacttcttatcaaagcaaattttgatcaataccattgtcaaaccagttgaaagaattagacaatcacaaaatctgcttcccaggtctcttcatctacttgggtcattacggtcatcttcatcatcttttatgatgcactctgatctgcaaggcagatgccctgaccgtccgacccatggctcacttacgcacacaggttctcagattgatagagaagaaaagcatttgctagaatgacacacaagatttttgctctcatcttcacctttataaactttataaagtcacctttatgactcggcttctgaaattaacttgtataatttagtaggaaaataggttgcttttacgttgcctttacaagtgaaacagtcaagaccattggccatgaaacagtacttcttcagccataatttcctagtctttcctcaaaaacacacttacttgtatttacagtctccaagtgtctgcttctacaatgttccacagctgaaatttgcaccttgccttgcccctgtctctctcatacaattctttccatattttagtaaaaggttaccttccagtaaaactttacctccaccaaattccaaataatatcaccatactctgagttattgaagacatgtctctctgcatttcttatttatttagattatactattaaattaacatttcataggtaggttttgtttcttcactaagtcaaacctaatttcctaattagccaggattgttacttagacttctttgtattcataggcatattcagcagagacttattttactttgaagattatagatttcaagattacagtttgattataaatatctaattaattgatcatcggggtatcttctgtttcatcctctcacctgaaaaattgtagaaaatgaagcttattccaaaagttggtgaatccacagggttgcttacttttgttttatcattcagtacctgtatataacttcaacatggaagagaaagaaggaaaaaaagttcttatatttacatattcagcttataagaataggaaactactctcacaaacccccaaaagagagtttttcacatttttcatatttaaagtgcatgaagtcagtaaattcacaagtaaacacagagcttgttcttttgagagcagcatctcggggtttagtctaccaaatcacactacatatgcaaatgttgtttgaacgcaatttagctgcatgctaagcagtacagaaatctcaagggtcaaagatttgaaaatgttttcagcacgaaaatcgtagaggcaaatgtttgatgtacagatgtgtgtactaaaataggttacggttagatagtttcatctattttagtcaatcccttatttggaagtgcttactgggatttttttagagtgtatgattttggtttcagttctatgatgaattcaaaatggtgtttcatagtcaatattagcccaaaatataatgtatgtttactatgtggatggtaggagttttatagaattctctagaaacactagaacaaattcaatttgagtgtgctctctcatggccccctctctttctctatctttgattatgtgtgtttctgcactctgtggggcctgtcataatataagcttttctggagttacatatctttatttctctagttgaggaacatagttgtgcactgaggaactccatcacaaatgtttctggattatcattagtctaaactctgacttgtaatatgttctttcactaaaggatttcccatgtgtaaaatgtaaccaaatatatagcttaatgatataccatcatcgtttgacacaggttttaaaactttctactaaatactaaaaaaccccaaaacctaaatagaatagaagagctatcttcaataaatttattctaaaagaaaaatactcaaaaagccagtaatactaaaagtttctaattatttttagtgttgagataatttattatttattcatgcaccaaccatttattgagtcctacacattatggtgggaacagggaaccaataatgaacaagatggatatgatccctgccctggagagtacaatctagaaacatatacagagctttcaaagatgaaaacaaaggagataatgagagattattcactgactaagtgaacatcatgccaaagttttaacttcataaagtgttctatatgaaagaattacatattatagaagtttccttctttaattttatattataagcctgttttctaaggcaccttctcagcaagtgttctcctagaagttcaacttgatagcattttgatcaaacttacaaagctcccccatgatcccaaagtcagcaaatatcataaacagtattccctagactcttcaccagtcgagcactggactcttcaaaaatattatatttgcgtgaagagtttagacatgccatgaaatgtatcataaaaataccataaaatgttcttaattcaaaaactttttaaaactacgaaaataccattttaagtgaccaaactgaatcatcaaatggtcgaatttttctgaacaaaccaactatataaaatacctatgtgagttgtgatagaattttgaattagcctcattgatttgaattttgaagacaaagtcaagattattttcaaaaagtgtacatgaatattcatttttatctgcagaatgaatgtgttctttctgaagtttttgcatttggcatagactatatttttattcattatatataccctgcatttgtagactaagaaaatagatgattaaaataaatatctacagatattctgacaaatctggattttgacaagtcatacactcttaaaattagaaattatgtaattttttctttatgaggattttagttgtcatttatatagaaaattattaactggaattattgcacttataacagttgctcatacaggctgtaagaaaatgtagagattagaggaaagtacagccaaaggcaatttatatatactttccaatttttatttttttctatatatttaaaatgtaattaatttttctaagactgcatgctggtttatagttgattcttttttattgtttcctgtgattgttttgttaacaaaggtgtattggtttacatgcaccaaaattcaccctttttagttgtatagcccaaggaattgtcacaaatacagtcatttaactatcaccactatcaagccacggaatatttcagtagcccccaacaagtcccctactgctcctttgtagtcagtctctaacctttgacaacacagatgtgttctctgcctctatagtggtgcctttttcacaattatatgtcattaataaattttgagttttggcataagatacattatcattaatacttacaaaatgttgtttcaaagagaaaagcatattcttataaaaatttactttattaatttttgcacagtattgctgtatttaggagcttaggagaagaacaggtaacaacttttctttaaatgtgtttattttgtggatgttttcttcagttggctataaaaatatgtttatctttcatctcacctggcaaatgtagatttttttcatgtatttttattttctccttgtttgttttacaaacatgaccattatgcaatttaggatttgatagcatactctccttatattgttaatctaatcagtacacacacttgttaatgtcttaatactgagccactgaaatctgaacagaaactgtctcctgataagaggctcataatggaccaaaatccaacatcctaagtacttaatggcttgtattttataaattatgtggggcaaggagattaagtgatttttttatacataaatcagaatagttttagagaaacagacattctccattgatctttaccaagcattgagcaccattgttcccaatcttttggtgtttgagttacttttttcacatactcaaactatttttaacagacttaaatgaattaagagactcaaataagagtttataaatgttacagtaccacaatatataccatatacaaaacctctgacagttgttacacttttggcttgttagcttttcagtgctccatgatggcttgagaagaaggtttacttttatcctcaagaggttaagccattgcatatttcagtagcctggtgatctttctttagagttactgatcttcctttttttctctcctccccacgatgctccaacgtcagacaaacagtataacaacacactcaccactagcatataccccttttgcattgtttatgtttatgattttcccattgtggctgcattgctgctcccgtgaaatcatccgaactgccatggccaggatttagtcttaggtcttcacatacattttagttacttaatgttcttgaaaacctacaaacaaactggttaaacaagcaaagaaataacagacgtaaaaggagaacgtttgcttttagttaatgttttcaagatttatttattcatttaaatcaattattaattgagtgcgtactaagcacaggaatataacagggatataagaccccgcattgaagttgcattccagtgtgggaaacataacagaatgaataaaatgaaaattcaagacaggaaagggataagcaagataaagacgatgattaatatttgaagaaaataaaacatcagtaaggataattggaaaagacgctttctctaagaaggcagcatttttactgaaagaccagacttgaaaagatacaaccaaaatgataagaagtatcaaatcccaaaggcagagaagtcttaatgtgatcaaggagcagaaagggtagtgtagacagtggcttggctgcaaagaaaaaggtggaatatcttcatttggaaagacaggagaaggtcacattcttcaggaccattatagctcctaataaagagctgggattttactttacatgcaatgagaattaagtgaaggaactgaaagtggaatagcgtgaaattatttgaatcacatttttatattatcactttatgtgctgcctaggggatggatgaggaagacccagaggaaaattccagaggtgatgggttctggaagtaaaaattgatagggaagatgaagaaatgcatacatattcaagatctcgctaaagggtaagctttgggtgagaaacaaatgagaaagcaaagccatagatggttctatcattaatggtgatatagaaaaccttagaatccagtacatagaaggtggagttcaagagctccatttgagcctgttaggtttgaagggagttcaagagctccatttgagcctgttgggtttgaaagaattattggatatttaaatgaagaagtcaggtaagcacgctattttggtctagtgctgtgagagtgatatgacagtatgtgtcattaagcggtatttcaatgtggaaaacataacagacaagagaacagacctcaggactgaatgaactctgaggctctccagcaaaggcccaggaggagaaaaagcaaaaacaggagctggggtggaaggaaaatttgaagagcgcagacagtctctcaaaaattgctttagtgtttcaggcaagacgaagtagtcaaatatgttgagaaattggaaaaatgttaaaaatgcccattggaattggcaagatgaagtcccaggtatcactgacagtgatggtgaagatgaggaaggagaagccgtcagtgtgttgttgaagaatgaatcgaggaagggggtgtttgtgtgggtatgtatgtgtactggagcaacaaacctagacaattttttattgagaaattttaatactggatgcatctgagcacacttttaggtgtgcttgaaaccattcaggagggaggggaagcttagtgatgcagggaagaggagtaaatgaaggaggaagcttctcaaaaaagctagaaggaacttcagagtgtatgaaaaatttgattttttttttttttttttttgagatggagcctccctttgtcacccaggctggagtgcagtggcacgatctcgactcactgtagcctctgcctcccaggttcaagtgattctcctgccatagcctcacgagtagctgggattacaggcacgtgcgggctaattttttgtatttttagtagagacggggttttgccatgttggccaggctgatctcaaactcctgaccttaagtgatccacctgcctaggcctctcaaagtgctgagattacagacgtgagccactgcacctggccgaaaaatttgatttttaaagcagtaagatgaaattaacaaaatcagcaaaataattttgcttttaaagtatgcttcttatattaatagttttgctctagtatagaggaaagaaagcacaaagatgtagaaataaactactatgtggatttgaatttgaactcgaccctatatgttctgtgtgagtgaggcccttcacttacctgctttatagatgagtgataatgcttgtaaattaagtagcatgtaatagagactaaacaagttaaaggggttctccagttagcactgaatttgtagttgtcctaacagtagtatttcctgagtttcacactcctgagcacacattttcttgatgtagtgttttaagaaatattaatagaatcttccaaaaaatcctactaaatttcatagaatgatttatgtaacacgttctagtttctttgctagaaggaaatatttctattgctttattaacaggtgaaatcttaagttggtataatttgccatatttgtgaagtgacagtttataagatactgcaaggtaccatattttgtgtgcctaaaaatgcttaactatatcaattgacaactatgaaaactgagcaaaagccatagcattttgattaagcagttttttggtaaaaacactgttctgtgatgcaagaatatagatcaaccaaacgtggttctatttagagtttgcttagcatatcacacaactctctgtatctaaataattttcagcattcttttagatgattttggggattcttaacatcactcacctttgaatcctcacaatttaaatctgacaaaatgaagagaactattttttaaaattatgttttatgttcattgacaattaagtagaaggtgcatatgacacagttcttaaaaatgtaacattataatattctaacattccagtcaacacgcaattatccctatctaattgcgtttgtgcaatcttttatatgtgttgctaattatatttacatatattaatatcttagctgatctgtttgcatccctatggtttttgctattttgtccaaagaaacaaacaattcacttccttgtttcaattaaatattacttgaatgaagttaaggacttcccagctttttcaagtatattttcatggtgtggtctcttgttagaaactatgaatttatctctttccatttaaaaagcggaagcacaggctcaaggcagcctttttggccagtggctgtcccaggactgagtcctgagtcctgattcatggattcctggtgaaactgcagtttctctaacatccctgatttttttttttttttttttttttgagacggagttccactcttgttgcccaggctggagtgcaatggcactatcttggctcacggcaacctctgcctctcgggttcaagagattctcctgcctcatcctcctgattagctgggattacagccatgcactaccacgcccagctaattttgtattttttagtagagacggggtttctccatgttggtcagcctggtctcgaactcctaacctcaggtgatccacccgccttggcctcccaaagtgctgggattacaggtgtgagccaccacgcctggcctaacatcactgacttttcaatcctcacaatttaaatctgacaaaatgaagagaactattttttaaaattgtgttttatgttcattgacaattaagtagaagtcattttttttagttatgtatctatgattatcaccaatcttcatgtacaaaacagtttctatctctggacctcattatataataagaggaaggatagcattgttctaaatataggtataaagaacacttacgacttgtgattgattaggctatcatgaaaataaagtattttactactgtgtgatcttatgaaggctgaattaaaaagaattcattagtaatgtatttcttcatgattatatggcaaatattttctgtggtgagtgtgcgcccaaaataaatgacaaaaaaagaaggataaataaccatggaaaatagcaaatctctgttaatacagactctgaagaaaaggatatgctaaatcatagcctgacatatctaacttgtgttctctgttatttaagtaaacaattgcctctagcagatgcatataaagataaaattacagcttataaatactcatttctcttttacaaaatgaatggagaggcatatcaagatcagtgatgaataaatagacaaatttagaggctacttatttgaattaatctgtaagtcactaaattcatttttatatgatacataattttatagggtacctagtctgaaaattcacttgctcatatatttttcattaaaatagctaagtcataaaataggtgcagagagaaaaaatatatctgtttgtcatacatacctgccagaaaaaaagaaactatatgaaattaaaataatcagtccaaatataaaaaagctaacaagcaacactagagaaaactttaacccattacaaactgtttaatttgaggaaggtatttatttaaataactttttttgaagacaaaagtgtccttctgcattcaactttgttgatcatgaaagtccatcacaggaagggcaggggcagaaaaaatttgatcaaaatcttttacataataaggtatatattttcacttattaagaaaatagatttttaatactttagaaacattatagatttatatacgtagaaaatattacaaatgtgttttttcaactcttattttaaattaaggagtacatgtgcagaatgtggaggtttgttacataggtaagcaagtgccatggtagtttgctgcatagatcatcccatcacctaggtattaagcctagcatccattggttattcttcctgatgctctccctctgctcctgacccccagcaggctccagtgtgtgttgttccctgccatgtgtccatgtgttctcatcaatcagctcccatttatgagtgagaatatgtggtgtttggctttctgttcctgcgttagttttctgaagataacgacttccaactccttttatgtccctgcaaaggacaaggtctcgttcctttttatggctgcatagtactccatggtgtataggtatcacattttctttatccactctatcattaatgggcacttaggtttattccctgtctttgctattatgaatagggttgtaattatttatattcttttaggtatatacccagtaatgggattgctgggtcaaatggtgtttctggttctaggtctttgaggaattgctatgctgtcttccacaatgactgaactaatttacattcccaccaacagtgtgaaagcatttctatttctcccagccttaccagcatctgttgtttcttgactttttaataatcactattctgactggcatgagatggtagctcattgtggtttgatttgcatttgtctaatgatcagtgatgttgagctttttttcatatatttgttggccacatgtatgtcttcttttgagaagtgtctgtttttgtcctttgcccactttttaatggggttgtttgtttttttcttgtaaatttgcttaagttccttacagactctggatattagacctttgtcagatgagtaggttgcaaacattttctcccattctgtaggttgtgtgttcactctgatgatagttccttttgctgtgcagaagctctttaggttaattagatcccatttgtcaattttggcttttgcggcaattgcttttggcattttattcatgaaatctttgcccatgcctatgttttgaatggtatttctagattttcttctagtgtatttatagttttgggttttatatttaagtctttaatctatcttgagttaatttttgtatatggtgtaaggaagggatccaatttcaattttctgtgtatggccagccagttatcccagcaccacttgttaaaaaggaatcctaatcctttccctattgctaatgtcaggtttgtcaaagatcacatggttgtaggtgtgcagtcttatttctgagttctctattattttccattggtctatatgtctgttcttgtgctagtaacatgctgttggttactgtagtcttgcagtatagtttgaagtcggttagcatgatgcttccagttttgttcttttttttaggattctcttgactattcaggctctattttggttccatataattttagggtagtttttttctaattctgtgaagaatgtcaatggtagtttaatgagaatagcattgaatctgtacattactttgggcagcatggccattttcacaatattgattcttcctatccatgagcatggactggtttgtccatttgttgtttcctcactgatttctttgagcagtggtctgtcacttctcttgttagctatagtcctaggtattttattctttttgtagcaattgtgaatgggatttcattcatgatttggctctctgtttgcctattgttggtgtataagaatgctagcaattttgcacgatgattttgtatcctgagactttgctgaagttgcttatcatctcaagaagcttttgggctgagacaatggggttttctagatataggatcatatcatctgcaaacaaagataatttgacttcctctcttcctacttgaataccctttatttctttctctttcctgattgccctggctagaatgggcaatactctgttgaataggaatggtgagagagggcatccttatcatgtgccggttttcaaggggaatgcttccaggttttgcccatttggtatgatattggctgtgggtttggcatatgtagctcttattattttgaggtatgttccttcaatacccagtttattgagaggtttttaacatgaaggatgttgacctctattgaaggccttttctgcatctattgagataatcacgtgttttttttttctttagttctgttaatgtgatgaatcacatttattgatttgcgaatgttgaaccaatcaccactgaccccacagaaacacaaacaaccatcagagaatactataaacacctctatgcacatgaactagaaagtctagaagcaattcctggacacatacaccctcccaagaccgaaccaggaagaaattggatccctaaacagaccaataatgagttctgaaattgaggcagtaataaatagtctaccaaccaaaaaagcccaggaccagatggattcacagctgaattctaccacaggaatgaagagctgataccattcttttggaaactatttcaaaaaaataaaaagggggactcattctatgagaccagcatcatcctgataccaaaacctggcagagacacaacaggaaaagaaaattcaggccaatatccttgatgaacattgatgcaaaagtcttcaatacaatattggcaaactgaattcaacaacacataaaacaccttatccacctcaatgaaattaacaacaaatgtattttacagaattatctatagataattctataaaagtttctttagaaacttcagtatatcaaacttgtatatgctcatgtcagctcatacagtaaatgaaaaccactatattgtattgtaaacactttataattaattcatctttttttatattttaagtgggcatctcaggccaaatgaatatggttaattgaactggctaagttaaatctgttgcatttttttattgaaaatttctgcagataatagattcacatgagagaggcactgtatgctctacccagttttccctttgggaactttgtgtgaactatagaatcacaaccaggatactgacattgatacaattccccaatctgacttaggttttgccagttttacaagtacttatctatgcacacgtgtgtgtgtgtgtgtgtgtgtgtgcgcgattctaatcaattttatctcatgtataggttcatggagttgccacttgactcaagatgctgaatacagtcatgtgctgcataacttttcagtcaatgacaggctgcatatacaacagtcgtcccgtcacgctgtaataccatagttttactgtaccttttctatatttagctatgtttagatacacaaatacttaacattgtgttacagttgtgctacagttgcccacaggattcagtagagtcacatgctgtacaggtgtgtaacctgggagcaatgggtcataccatatagcctaggtgcccaataggctgcatctaggtttgtataagtgcactctatgatatttgcacaataacaaagtcacataagcatgcatttctcagaatgtagctctgccattaagccatgcatgagtacagtttcatctccacaaagctccctcatgttgcccttttatattcacatccaaccccttcacggttctcccccagatcccacccccacctccatccctaacccctagcaaatgtgaaactattctctatttatagaattatttcaacaatgttctacaaatacaataacacattatgcagtcttttgggattagctttttttttcactcagcataattccctagagattcctctgagttattttgtgtatcaagagttttctcttcttattgctgggtactattccatggtaggcatgtgccacaattggtttaaccgtccacaggctacaggacatactggttgtttctagttttggctattacagtgaagatgctgtaaatatttttgagaaggtttctgagtgaaaataagattttatttctctgggataaatggccaagagtgcaatttctggttcatattataattgcatggttagttttattacaggctgccaacctgttttccagagtgtctgtgccattttacattacccgccagcaatgtatgaggatccagatctccatggcctcaccagcatttgatgttcacacctgtttgttcttattttagccattctgataggtgcatgatgatacttccctgagagctctttatgagagattctttttgtcatatgtattgaggtgaaattcacatgacataaagagaaccggccgggtgcagtggctcatgctggtaatcccaacaatttgagaggccgaggtgggtggataacctgaggtcaggagtttgaagccagcctggcaaacatggcaaaaccctgtctctactaaaaatacaaaaaaaagcagggcatggtggcgggcacttgtaatcccagctacttgggaggctgaggcaggagaatcgcttgaaccccggaggcagaggttgccataagccgagatcccgccagagcactccagacttgggcgacagagtgagaccccatctggggaaaaaaaaaaaaaagtaaccatttaaaagttaacaattcagtagcatttagtacattcaagtgttgtgcaataaggaatactagtttaaaaaaacattgccatcattccaaataaaagtccttacagtttactgcttacagttcctttcaatttttagttgggtttaatttgattttagtttgccggttctgattggatttttttgtttttttcattgttgaatttgaaattcttcatatagtccagatactagttctttgtcaggtattgagtcggcaatatttgctcccagtgtgccttttatcttttcatcctgttcacaaagtctttcacagaacaaaaatttttacatttaatgaggtccagtttacttacatttccttttatgtgtcatgcttttggtatcaagtctaaaaattctttgcctggccttagatctcaaagatgtttttcctgtgttctttttttcccctagaaatgtcatagtttatgttttacatctaagtccatgatccattttgaattaatttttgtacaagctatgaggattaggttgatgttcaatttttcaccaatgaatgtccaattgcttggcattatttgttgaataggctgtctttacttccttgaagtgcttttgtacttttgtcaacaatcagctgaacatacttgtgctggtcaatttctaggttctccattgtgttttattgatctatacgtctatctctccaccagtactaaactatcttgactactgtagcttttgaggagtaagacttaaaatcagagtaatgcctcccccttcatttttcttggaatgattattatagctcaaggtcattgtgattattttagggcctatacctttctatataaattttagaaaaagcatatctatttctacaaaatccttgctgaaattttgatgggaatgacattaaaactgtaaatcaatttgggagatgatggacatctttattatgagacttccaatccttgagcactgtaattcttgctattatttagatcttttaaaaattcctttcttcagtgttctgtagttttcagcatatcaattccatacatgtttttgttttagagacactcactttattgtcaaggctggagtacagtgacatgaccatagctcactggagcctcaaactcgggttcaagcaatattcccacttcagcctcccaagtaactgggaccacaagtacgttcatcacaccctgccagttgaaaaaaaaattaatcttttgtggagacaaggcctccctttgttgcccaggctggtcttgaactcctagcttcaagcagtcttcccacctcagcctcccaaagtgctgagattacaggcactactgcacctggccctatacatattttaagtgtacacttaacatatttaattttctttgggtgactaaaatgatactggcactagtcattgttagtataaacaaatatgatgttttttgtgtgttgatctttcatcccaagactcttctgaacttgcttagttctaattcatttattagttctatgaacggtttttgtagacttttcaggtttttaaaatgtaaacaatcttgtcattttcaaagagaaacagcttaatttattttctttcctatttgtcttttacttattttacttacctgactgctttggctagaatacttagcactattttgaataaaagtggtgacagaagacatttttactttgttcaatatcttaggggaaaagtatccagtcttccaacattatatgtgacattagctgtaggttttttctagatgttctttgtggagttgaggtaattctttatccttattttgatggaagttttttatcattggtgaatgttagattttattaaatacctttttgtttacaattgctatgatcatctgactttttttctctacctcattatatggtgcttcatataaattgattttcaaatattgaaccaggtttccaaacctggaatgaatcccatttggttatggtgcttaattatttctatccattgttagatttggcttgctaaatttggttgacaatttctgtggctaaattcgtgacagatattgacatatattatatatatgcatatatatacacacgtatatatatatacacatgtgtatatatgtatatacatacgtgtgtgcatatatatgtgtatatatatacgtatatatattttatatattatatgtgttatatatgtttctcggtattatatttgttagatttagatgccataatactggcatcataaaatgaatagaaaagtgttttctcctcttctattttctttataattagtattatattttctttaaatattagtagaactttctgataaattcacctgggcccagagattttttttcaaagtctttaattataatttcaatggcattaatgattatataactatttaagtattttatgttgactaggttttgagcttgttgttttccagaaattagtccatttctttgaagttgtggaatttatgaacataaagctgttcatagtgtttccgtatcatcctttatcatgcctacagcgtgttttcttatgggagaagggagcctcagtccatgaaaacatttcctggcttagcacctaagggggtgatcctccctgattgtttgggatggagcgaactttctgagttgggcacctttgcagcaggatccccttattcatgccacctcctcagccccttcccattctgctccatagtctctgggctgagcaggtgggtctcaggcctgaagatcaaagaggcatcctgggccgggacacttgttgtgactaggtcccatgctggtccctcacccacctctgctcaggtgctccacctcagcatctcttggcatggaggggagcttcatgcatatggggatggagaatatggactttcctggtcacttggtgttagcaaatcttctgattgatctccctctccagtggtacctggctcacctgttgtcaggactcctgtttggtatccagaagaagaatgagcctacctcagctaccttctgctgctggattaggggtctaggtcatcttctgttgggtatgaggacataaaatgcccagcccatgctgttcctttaggcctggggttccagaccaactaccttcttcttactacctttctgagctgctccgtgtttacttcttgagtcatttccagtgttaaaattgtgcttatcagggaggaatgaggaaaagcatgcctatgccattatgtctgttccagaagtctgtatttgatcgttaaaagatcaaattcttttgtttcacttgtaaaattgaaataaacagtaatttgactagactgcctagcacacacacacacacacacacacacacacacataaaaagaccataatcattttttatttttattcagcaaaattcaagcacaaatattaaaactttcaacaatgcactgtctacttagattttgacctggaatgttttaaaaccttataactttaaaataatttaaaggacttagaagtgtatcaaatatttatttccctttatccattacataaatccaggtatatactaggtcaaagatgcatctttcatatttctcaaccattgtgaataattaatatgtgcaattaacaacaccttatcattgcttctttctagaccacacaactgacatatgtgctctgtgtgtgtgtatatatacatatgtatgtataaatgatatatacatctgtgtgcataaacaggcaagtatataggaaaaatatgtaaaaacatatgtatatatgtgtgtgtgtgtatatgtgtatatacacacacacacattttctttcagcattttttctattttttggctcaaattgtgttggtccctatgggattcatctttgctagaaatactatttctcctactgtttctttttgtgtacatcaatatcattaaatgcaatgtttagttagtgttaacaactgctcttttaatgaacattatctaattgaatattcacaataagcctataaggacaatggcactgcgattcccatgtcaaagaaaaaggcaccccaatttagagaggttatttcaattgtccaagctcaaatagtactggagtgccaggattcaagacaagttaatcctactgcagagtctctgtgatgctacagtagactgagttgcagaatttctgtttgcagactcatcttgagtagcagttgtttatttgattgctgcttactttcttcttccttcctctttgctttcgctcttctccattttgcagattgatagttgcttccatttacccctcctgatctaaagctagtgccatagtaacaaacaaatttctcttctaaaaaatctaaagttgttcattatctatcccttcctggacggtgacaagaaccttttcatgatttgtgttgaacaatcacccgcctcacctctcatgttattctttataacttctccaactttttaaatgacaaaagctattatttaatagtcaaaagttaattaaattatctaatatgttctctatatttgtgggaacacatttcttctgccagccactctacatcttttgaagcatattttgtagtttgtttttcaaaggtggtctgtatttaatggaggaacattcttgcctactttctcttttatctctgcttctccataattccttcactgttgatgtttttcggcggggggagaagagtattttctggaactcctattagacttccttagaactttttaatcattatcatattttttggtcctaaacaccttgatcacatcttcctttactaatctttcctccacttactctggctttctgctgttccaaaaatacatgatgtgtattcccaccaagtcttaaatgaaaaacatttctcaaaatatacccttggctcaatatctctctccttttgatactgacctaccttgacctattttttttttcttttgaggctttctgaccaatttcctcactttttttatactccacatgtacttttttcatttatttctgtttttgttacattatttcttgtcttgtataacacattatttcattgttaccctttattttaaacatacttatttcaaattcatttaaaactgatctgccacttcttacaaatcttgaatgatttcattttctaattgttgatttttttttgttgggggaggtgtctttaacattagcctttttatttgtttttaatttttggtttgcaggcttatgtttaattaaattctctctctgctcagccctgcaagtattagagtctaggattctttcatttgtctttaactaaatatacagggccccatttcataatcacggtcctatgttagcaggttggggctttagttactcctcttctggggctcagttgtagtagggcacattattctgcaggatgaatatgactcattggctctgcctccctttgctttcaaaccatgttgcattttgagtgtatttttatagaaaatttttttaattttttaatattattttaacccataatctgttgacttggtaacaccatggaggatggtatcaagcatgacatcatcacgttatcttggcctaaaatttatttgattaatattttcatttaatgccagccatgagtcagggtcactctcccaggcactgaactatacaaatttgcagatttcagagcattagagaaggaagaaaaataatgaacaaataataagtgctatgaattatgaataaaacaggacatagagaatgagaatggaatgctgtttttaatagagtggtaaaaagagaactcataatagcaagacatttgagtgaagatgtgactcaacctgagtaataagctaagtggtatctaagaaaaggtatttgcaaaaagaaaatagcaaacgcaaaggccctgttcaaggaacagcaaggaggcagtcccttcgtcattctagatacctcatttaattaatgtagcttcatttgacactaacaacttttttttctctttctttaaattacgggtaataatcgtacaaacctgacaaagctgatatgatagcattgttatgaagactaaatgattcaatgattttaagttcttttaaaaatcatgacatagcaagtagaataaacatgtttgcttaaaaaactaaaaccagtttagtacccgatccagtattataagtgataatgctttatatttaatttagaagatctatattatttggaaataaaagttctgctgttttgctttttactgcttggtttggttctgaggatagtgttaaatttagaaacatggcacaaattattagttatagcccagattatttaaataaacaacacaaataatttatagaatatttccattgttttttccttatctataaggtcatctaagaactatggcaatgtctatagagtgagtgcaaaactagttcatttatttatttattacgatgggttattttattgtgtgtgaaatatcttttcatttctcacacactaatctttgcccttttactaaagtcaggcacagtgaatatatctaaattggtaccttaagtatttgtggctaagttaaagaattttcatttatctgttctcagaacacgtcactaacaatgacatcagcaaagcagaggtgtctttgagaaagacagtctgcaggttcccatggtggagccaggtaaggctgtaatactcaccagctggtgaccttgcccatcttcaatttcttcagttttataagaaaactgttgatagcctggaactcctgggtgcaaacaatcctcctacctcatcctcccgagtagctggggccacaggtgggagcaaccaccaagtccaactaatttttttttctttttgtagagatgggatttcaccatctttcccaggctgctctccatctcctgggctcaagtgatcatatagcctcaacctcctaaagtgctgagattataggaataagccaccatgcacggctcatatctgagtttccttccaagtctcagtagaaaacatccaagagaaaaggtttaccaaacccatttaattaggttataaaataaaaataaattttgcatatctaaaattatgaatatgaaccctataattttataactgataattattacaagttattaaattctttaataattacatgttttatggtagcaaatatgttctaaaattaattctagaacaaggattatatttggttatgagaataaaagataggttttattctcataaaaaagatcaaaaaaggaatctgttttattctcacaaaacagataaaaaaaaagatctgtttttgagtttagcctaagaaatcttaaactgcaagggcttatgaggaaaaaaaatgaatctgtggtaaaacaaaaaactggtcacataatttatgtaggtcatgataaaccctgaataaaaagcaacatagatgataataattcataaaatatttaacaattgaattggggattgttttgcttcgtgtttcttatttataaattcatgcgcatgtgattgaacaggcacatttttctgacctaaaatctgaaggtgcgtttctttcctcaagtcaaatctggagctcatttgaacactgtccacaactgctcacctgcaggtgttgtctgaaacttgccctcctgtattcatcaccctcgccctgaaggacaagtccagttcctggatcaaaagtgttagaagtaaccaggaaattgccttggattgattgttttatctagtgacagttaaattccagaaaatataaacccattgggtatagagaggcattctgtttcctctgttaagtctgtatctgtctactgagcgtagatatctttgtctatatttgcttaaatacagccatcttgaataaggagagaattgtaagtaagctacatatttttggggaaaaaaaggaaaattgtaccaatcataggaaggaccaattaccctctgaggttgcgtacaaatagccaggtggaaagagaaggagaggagagccagtttgataatatgagggttagtcaaagtttctaagcacaggttgatttttcccacatcaggtctgcatctcctggaactaaatcctctggctaactctactctgtgttaataaaactattataattaggccctgaagattgagagctgcctagagctgtagtgctcagcaccagattgcctctgagtttgcagctgagaagtgagtcaaccatggctaaggaatttgacacagactgttttaattatattgcctatatttttgtggagggaaagtattatcacatgtggaatggtagcttgtgttctaacaaagaatcattgtatggtagaatattcttatattcattacagattcttggcctttttcgtgaaaagattcttcttcaatcttttatttttgtatctgtgtatataaattaacccagagcatattatattttaaaatgttattggtgtccttaatatttcttaaaatttaaataggcattagtttatctttttgaactgaatatcacattatttccagttgctgctacaacattttccacaaatttagtggttttaaagcaacacaaatttatcatcttacagttaagtctaaaatgagtctccgtggggtaaaatcgatttatccatgttccttctaacatctataggagagaagtcatttccctgccatttccagcttctagaagtacctacattctgttgacactgggtcccctttgttaacttaaaaaaagaattaaaagtttagaaaaggagagagggagaccatatttcttataaagtgttacagcctgcaaggtggccatcaagcaggctgggaattgcagcccctgggcaagaccaaagataggcacttcaaaggaggaggggttggggcaggatctttaggccaaacaggttggctaaacagacatattcaacaggttacaggaggagctatgaatattcatgaaggggtagtcctggcacatgtgtactgagaaaacatgcatgtaagaaaggccccatgttcactttggggtgaaaacttcacatttaaatgcattacagttagggcctgtacgtccaaaggtcttttcaggatgcaaaggtacacaagtgtgcagcctctgtaaactggtcagaaccagttcttggttggtggttttcttatcaggaggaagttattgagatcagtcttttgtccagtcaaagctgcatttatggctggcagaacagggagtcagtcagcttctgtgaactggatgagttgtaattgttttaatgttgcttatttccaggctggtgcttgtttagctgctggagaaaaaaggaagccttgtagcagctaggacatggtttattctttaagtgtaggggtgtggacctaaaccttgcctggcaaggccttaggtcttgtttataaattggtatcttattgccacaaagagtccattctgtcagtcttatgatctctattttaacattaatgctggtcagctgttgtgtctaaaccacaaaagggagaggttataaggaggcatgtctgacctcctgtcccatcacgggagggaactaagattttaaggtttttttctgaagtttacttggcgaagcggggttctattcagggctgcagaacttaggattttacttttaatttacaccttctgtattactttgttttcacgctgctgataaactagaaactgggtaatttataaagaaaaagagatttaatggactcagattaaatttaacggactcagagttccatgtggctggggaggccccacaatcatggcagaaggtgaaaagcatgtcttacatggtggcaggcaagagagaatgagagccaagcaaaagagaaaccccttataaaatcatcagatctcatgagacttattcactaccacaagaacagtatgggggaaagtgcccccatgattcaattctctcccaccaggtccttcccacaattcaagatgagatttgggtggggacacagctaaatcatatcaccttccatgtacaaaaccagaaatgcccagtcaagtctttctgaggctgcatcaatctgacagtgactcttccgcctccctgttctccttgtaaggactctcctgattacattgggcccacccagataatacaggataatctcccatcagctgattggtaacatgaattgcatctgcaaccttaattctcctttgccatgtaatgtaacctattcacaagttctaaggattaggatatggacatttttggttaccacagatgtcttgtttggagttatctgttaaataatcaaggacataaatactaatatagtggttggtataacaaaggtgtttatatttcccacgtaacaatttgagatgtgcaatctgcctttcattccctgtggttatcaacctcccaggcaccattatccttctacttcaccactggaagtgtgtgattttcacctctatccaacatacccacattctcagcacgaggaaaaggcaagcagaaaggacaaagaatcattccttttaacattttcttttcctggcaaccctacttagtgacttctcgcactttatggctacagccagctccgagagatttgtacttttgcgtgggcacactgtcacccagagcagaagtcagcactctgtgggaaagacagaaaggatgttgtgtgcgcaaacaagagcatctacttcttcatttatagacacgtgacagaaaacctccttgagggctttgggaaaacaagatatctgtaatataatatgtctatcaaatagcatcaactacatatacaaagaaataccaaaaaagcctgtttttttatactttatatactaactgtattaaatgtaaattctttttataagcagtaaatgattctctaaacatgtggtccatatcttctgctccagtgatttccaaaataatagtgtatgtgaaaatcacttgggaacataattgaaattttcaattcccaaatctccaccaaagattctgtttcaaaaggtctcagagggctctgcattttaacaagcaccctgggtatttctgatgcaggtggtctgcaaactctttgattgtgttaaaaaaaaaaaaaaaatcccaagtgagcacacctgcactccatttaacatgcatgcattgggtacctgctatagcattgtactagataccgtaagaggtataaataaagtaacagaagacctgatccctgttcttaaggaagtttaaaaaaaatgaagtttccagcttcagcttccattgaaacagcgcctggacccacttcagctattgcagtgtgagaagaactgtgggaaaagcgaagaggagagtgtgctcattttccttcctagcatctatcatgattagttcttacatatttttgtgcttatttaatttaagtctttgccactagaatattagcaccacaagagcagataacagtttctcactattgtgtttcttgtaagtagcaaaatgctttactctctgtaaaaatacgtgataaatatctgtcaaatgaacatagtgttgtgcgtgttcagaataaagttaaaatacattaattaggaagaataacaccacctacatagaggaggagagagttcaactggctctggaaggtctcaggaagcagaaatggaggaaagagatttccagattgagggaggactatgatcaaaggtgtggataacatgaaagtatgtgaccaattaggaaacctgtaataacgttgtcttcagcagtgttggaagagtttccttactgtttctgacacgtgacatggtttagaggtaatattccgttctgatcgttatttgcttgaatataatagatgtctgtatttttatagaccttatataatttcaaagatgtttaatctattagttcattttttctataaaataatctggcaaactcagtagactagatattataatggttgctctacattttaaaacacacaccacacacacacacacacacacacatgcacgcacacacacacacacacacgcatgcgcacagaaacccagacaccaaaaatggaagagtcactctgtggtggaatttctgattgctaatcaatgctcagacaccttccttttacatttttgaagtatgttcttcatacagtattaataatttcttaagggtctatttgtgtgttaaatagtgtgggtggtaaattacctgagatctttgatttttatgttaccataagtcaaaagtaagcttaatataaacatttttcatattctcactgaaaattaggaagttgagttgggaaacgaaaataaaacatcagtcttttttataactacatatatattgttatacgacatattgtatgtgtgtgtgtgtgtgtatatatatgtatctttcaattctcttcttttcttcttttctctcatatctcttctttgacatgaaaggcacactgaaaaattagccaatttaaaggatggtggaaatgataaagaaaggggcatatgatctaataaagaaaattaaagacatttaatatgtagggctaagagatatgatgacaaatgaggggatattataactatatataaatacttgcaatagtatgttataaaagagaaggaagatctattttagctagctaaggtcttagaacaaggaataatgatctgaagttttaaaaagataaaaatttaagtataatgaaaaatgtttctgtcagtgagaacaattagaaagaatattcttccctgtagacatgagcactagagatgatcaaaaacagacaagataaaatctttggggacttaatagatagaaaagccactttataatgtcctctttcctggtctggttaagactttcttctatcatatatcgttaatcacttgaaaaagaaattaatgatccatgaaatgggaatgcttatttcaataggtaggttgttccgcagagtttcaaaagatctgtggttgaggccaaaactcccattaccttcctgggtcgtatatttctaagttaacttctctatcctaccaaagtatcctttctgttctcttttttaaaatgagaatgattaataaaggactattttataaaagcaagcaagtgtaaaggtttcttttatttcactttatagtattttttcatatctgtctgcctgtctatgaatcatctatcaacctatcttactaaatatttcaattatttctccaggttgactaaggtacatactgtgtactaaagtacatacataacatgatgtatcatggaatataggtgcaagttaacaatttttttttcatattgcttagtttaagatctccatagaatattatcatggtcaatatgttgagcagtcctcatcaaattaaatgattagcaaattctctgagttgattctgtatacacataaacacacagacgcacacatacactcacttgagcatacacgtgcatgtgtgtcatctttctattttgtataatttcttttactttcatcatctttttatattgtatatcatatatgataatcctagagcaaaacgagaaaagtcacaagaagagtgttagcaatggaaacagtgcaaacaggagaatctgagatttatttcaaaggcagaagtcatggaataatgagattggtcatttatatgagatttgcaacaaaaagagtcaaagagagctccaagtttcctaggattcttaactgtttagaatcactaggactgtatgggaatgagaaagtgagtggggagatgaatttatctgttttgaaatttggatattttcttgtatataagtttaggtacttggatgtaaccattcaaaataatacttaaacatttctttgttttttgtttccgtgtaagcagagcttagccatgcgtggtggcatgtgcctatgcctgtggtcccagctactcaggaggctgaggcaggagaatcacttgaaccaagaggtggaggttgcagtgagccaagattgcaccactgcactccagcctgggtgacagagcaatactccatctcaaaaaaaaaaaaaaaaaaaaagaatatgctataataaatctcaacatctttctaggctcgttactgatgatcccaaaggaggtaaccattccatattcttttggtttgtatcaaaggttcacacacacacacacacacacacacaaaggtgcacacacatacatacatattatatatagtggttatatatgagatatatatttatatactctctctcataggaagataatagaagtgcttccatactaaagaagagcttacacttaaaattgcctgtgctgctcctaaaattccactgttctcagaaaactgctagttacaatcagtattttaataaccctaaatctttccttcaatttcagaattttagggccctaaaatactttacaaatccatggttcaaacagctcttacagaatctagtagtcgaggaaatagatggtttcaatctgttttagtactcagaggattcaattccgaatatctgtgtgtttgcgacttctccagtgtattactcctgctccctttaggcatcgcatctttagtctttaattaggcacttacatctccagcttagcctgccttctgttcatccgaaactcccagagaggaataattgtgttggcttcttagcaagttttaaccatcttctctctcttcttctcttttcctctg

SEQ ID NO: 568 - DNA, 20001 bp, Homo sapiens
ttgaacccgggaggccgaggttgcagtgagccaagatcacaccactgcactccagcctgggcaacagagtgagatttcgtctctcaaaaaaaaaaaaaaagaaaagaaatatgcttatttgaatgatttcccttggctaccacacaaagcctaaagtcatcagaatcccatgtgctccattcctctcattattctgttagctagggccttacattcaccatctgtcagacaccaggtaaaactaaccctagatcattttttcaatatgaaagaattaaaaatagtgtcgttttcacccacagcttagttgttactattccttcctgaatagggccatttgcagacaggactgctctactgaagacacttatgacttggtgagaaagtaagtctcaaacacgtgtaaggaaaggcgagctatgcacatgtgtgtgcatgcatgtaatcacggcatcagtgaaggtgcacccacagcggggctgagggattgtctgtgcagctgtgagtagccatcaatactagtgtgaaggaaggaacgaggtggagtggatgaggcagttagaaacttttcagtggcatgtcttgaaagcccagttaaagaagaaaaatacccaaagagatgggacatctgtgaaaggcttgttaatttccagataataaatctgctgtagtagatgaaatatgctggataaggggaaggtggaaaggggaatctaaggtcgggcccaggtggtctgtgtgtgggggaaagggaaggacacagggctgccccccactgaggaagtggtgtcaggctctgcacattctttgaccagcccgataaatatggcggggagggtaggccacacttgtgctcaaagccagccattcaatgacatcccttccagcacagaatgagatcaaaatccatggtgtggcatgtaaggccctacaggctctggcctttacctaccatgtagcctactgctaagtctgcttcagctacagggacctccggtttttcctggatcatgtcgagctctgtcctgccacagggattttgcacttgcttttacctccgcctggcactctttctcagctactcatggctggccctctcaacccttcatgtggccgcccagtatcaccttgtcagcaagtccttcttcaccattctaattcatccagcacttgcccatctccatccacttctagccacggagatacatttattttcctatatagcacttgttgctgcctgacattataacaaacgtgttttggcttacttgtttactgtctttctctctacctataatgcaagccttctgagggcaaagactcccttctgttgactgatgtatgaccagaacctagacaaatgccagcctctgagtgggtgctcagcagatccattctggaaaatggccagggcagtgaatgagcagaatgagcatgggaggggaagttgtaagaattaagaaaagttaaacccagaggactgtaaacaaggcacagaaataagctttgggggacagaggcatctggtctaagattaagattggagaagtcacctctgtaagtcaagatgagactgaaatctgtctgcttttattctcagcttctagcttcttcactcaacagcaatttattcatttttttttccaacactgtgtgaagacaggactgtctccgccttatttccattgaattgtccacgtgatagatatcagataccaaagtgggtttgaggcagacctccatgtgccaattccaaaacgaaattgtgaaaaacagggacctctcagccagattcgagatataaaaatgaccaggatacaggagttcgacaccaggctggccaacatggtgaaaccccatctctactaaaaatacaaaaattagccaggcgtggtggcaggtgcctataatctcagctacttgggaggccgaggcaggagaatcacttgaaccagggaggcggaggttgcagtgagccaagatcgcaccattgcactccagcctgggcgacaagagcgaaatttcatctcaaaaaaccacaaaaacaaacaaacaaaaaacccaggatatggagagaacagaaatgtttggaaatatatttctttgccaggagtcgccttcttcatctcaaggctagtgaagagaatcttccacgtgaacaccagagagctctgaaatgtgttctccacagtcgggaggtgcaaaagattagtgtctgactcccatattgggtacacagatggtgaaaaatgtgcccactccacacagctccgtggacattttcctctcccaggacttactgatccaagacatacgtctggggaccaaatatgaatgacaacaaaactagagagatggagcattctgggtttttcccaagggaatttctgcaaagagcgagaagaccccaatactgagattctgttaagggtaggatgctgcaggagttgaactgagggtgctggaggtaatgcaaagaaaggactgtccccagtgtcataggaattgccattggagggaacacatgaggaatcttctaaccatccccaacacatctgtgggagagaagatttaaccatctaccagccgcaaggatgatgaagacacagacagataaagaaatgtcttatcatcttctctcttcctcaccaccttgccttccccacttcgatgtaggcagccataaaaccactagatagtgataggggaggaaatgagggaggagggatggtgtaagccaacaggcttcctttctcttccctctctgtcttaaccagaggccggtgaccacccatttccagcctgagcatagacgaaagggaagttgtactttaaatggagatgcaaggatgtagaattcctctttctcttctcatcactttccttcctgaacaattcagtgcaggaggtgagagattgattatatacaggagaattgatcaaataagcaaacctatttttaatgattcttaatacaaggattgttgtattacaatagagggagttacaaatatggaaaagaagatgactcgaataaactgatgatgttggattggaactggagatatcagtgtgaactcaagcctcagatggacagatacacatagatgtaactgtctgtatacttatagatattttctagatccctgcattgagagcatctgggagcagtgtcaccccaacatcagcgagcacgcctaacatccaggtcttgcttctaaataatattctcaactaacagaaaccagaccttcttggagaaatggctgattccaagaatggagcaaggaagtccaagatgaggctggaattctttgtgtcagaagataaagaagttctcaaaaaatgtcagagacatgttaaaaaaaaaaaaaaagagaagccagctttaatgcactcctacctggcaaattggagataatttgatcattaaaataaataatagtagtaataaaccataatccattgaataaaataggaaactaagagttatttaaataaaaaattattttaaataaaaataaattaatacattgaaaatttggtgaggaatggggtatttatacaatcttgatgtactgtactacagaatacatattaattacaaagggcagttaatcaagtgatgaaatgactctcgttagttctgtgccaaccgacaggatgcacacatgagaacacagcatccaggcagagaccagagccagaacctaatcacgcagaaacatcagagaagacaaacggggggatacagtgaaataactgtaatcttcaaatgtgaaagtcaagaaacaagacgggggaattactccaaacttaaaggctaaagagacatgaagcatgcttctgatctggattactttgctaaagcagaagctaaaagtttcagtgttaatttcctgattttgatggttgtattggcatttttaggtacagaggagaatatgcttgtttttaggaaatacagactgaagtgttgagcgctgatgggtcatgaggtcagcaatttgctcccaaatggttcaggaaaaattttctctgtgctgtatttgcaataattctgtaaatttgttattgttctttaagaatgagaacatcatataactttcctcaagtatcaaagttttctttaacccatcctaaccccaaataaaagatctagaacctctggacagccaagttactaaacccagccagtctattacattaaaatagagaattcatggggcctgccatgagatttcatccagcagcaaaggagttgtgtctccttttagataacgcttatcaaagtaaaagaacaaatgtataataaagctgaaatttgattacaattcatgcattgtctgcataccagttgcaaaaccatttatcctttcatttaatataaattctggtggatgttccatgccccaagtttgctagttactgaagttaaataggcaaataataaccttgagttgatcatagcatagtggagaagactcacatgtaaaaaaagcaacatggcatatgcgttgttatagaaatataaaaatatatgcattgtatatggcagttgaaagccaagggaaggaataatgaactctaaatgggtaatcaggaaaggtttcaccaaagagatgagattttgatctgggtctcctaatttgaaaagaagtaggccagcaaggcaagacaatggcagagggacgttggcggtgggagggattctcagcacttgtggcctcttgaaagggctttggatgtctgggaaacagagaagagttcagcatgagcggaaggcagtttacaacaaatggaatagggtgagaaagagattagggtggggaggtctgatttgtaaggataccccatccctgattccacttctttccaagatacgtattttcacgttagaaaaacacaccagtgaagaatccatctcacagccgtgttttccctaagggttggcgggctgataaaggaaggtgttgagttgagggtggagcttgtcctccctgacttcaaatgggacttctgggactgcggttggaggtcttgatgaattgccatttactctgccaaatcaccgcttgggtaaaaattcagattgttttccagaaattattaaatgctgtcttaaactcatattgcaaattgtcatagagaaaaaaagaattatattctccaaactgggaatttattcaaaaaattccattttctcatgttgtttggttacatatctccgaaagcagatttagctttctctttgcttttcctgaactgtagctaagattatattttatgtagaaatttaaaatttctatatgatctgaaccaaacagcttccaactttgggggttttgggttttgtttttgttttggtctgagagggttgaatcatctaagtgtttcctttgtcaaacatgcacatgtagacaaagaataagagaaaattaaaagtagaaagatttattacaacctagatttcttccattctacttcctctagttagcatcacccacatagtaacttacttatctaagagtcctgaagatcagctgaacattataagcattatttaaaatattaaacattgtgaaaacatagatatagaagtttattgaagataatgttttcaaacagttacataataatttgaatataggaatcctaggaatttaattttttctgacatcaaatactttaacaacaccagggttttggggtaatcatagtccctcagggctttcaaatatgcacatttagtgaagtatagattggaaaaactacagtgaacacattgacattaatcagtgtattcaaatatgtttcctactattgctgtaatttgtggtgctttgcttttgaggtgacatgctgctcttggattggagcacctttaagttctagaaatagatctaatgattgatacatccaactgaactgaaatatgatgttcgtgcttgcccgagcctcataaaaggtggctgaggatctctggagtggttaccctttcagcttgtgaagcacctgccatgtgactctctaagaggcttctttatttgacacaactgaacatcaggctaaagtgctaaaacaagctactcatttctccttcttttctcttgtgcatttcattctccctttgaagatgactgtgcactcacaaattcttttttttttttttttgacagagtcttgctctgtctcccaggctggagtgcagtggcgcgatctcggctcactgcaacctctgccgtccaggttcatgccattctcctccctcagcctcccgagtagctgggattacaggcgcccgccaccatgcctagctaatttttttttttttttgtattttttagtagagacggggtttcaccatgttagccacacaaatttttaaatagtagaaggggcactacttgaataggcagaagggagtgtcctgtaagtgtctctctccctgggcaactggtgtgattgagggaagaagtccagcatctgattaacttcgcagggaggtttgctcagcacagaaactctaaaggaaactggggaagagacggcaaatggcttcattatttcccacatacaatatcctgtcatagtaatagtgtaataatggatttatgaaagaatattgtcatgattttcttcttttgggatcaaaaggaaagaaaaaaattgtgttatacaacatcgttctcaggagacgtgaattggtttttaaacgtttcagatttagtgctttcttgagcgctacgtcaggatcaaccagatctccaatgataaagctatggagcgaagaaatccactgggaatgatcacactttgtatagaggagctctgggctctatgaagccatctgaagagaaacgtgggaggatgggactgtgaaaacagggacccctgcggcacttgggagccatggccctttgcagtctgcatatttctgtctgggcacccagcgccatctctcccaacctacctgtccccctactcagaatatgatgattaacccagggccctaaccagggaagctgtgttcaaggagaagccagtgcctccacatccatcctggaagacacaccactgggtatagacagggacatggcttccttccattccaggaccttcagagccgggatgtgtgttcagctggtttgtcccccgaggggagagggagaagggagaacaaatgagctgttgtaaacacacatacagtgtggtctttctgtgaacctgataagtaacatctaacttcatgcataggacgtgttaggatggacaaggccacagtcccttgagcctgacctgtagaaagtaaccatggaagggcatggttgaccagtgctgatgagtatggcttgtgggggagggcagtggtgtagatcttggtgagacaagcatggagagactcaaaggtgagtaaaattacatcttcgaaagaaggattgctttctctcatctcaagttaggaaattaaagctattgcatctgcacccagcgttaagcctaaattcacaagaagtgactttaaatatacaattttacagcaggcatatagaatgggtctcgatggtcattaatgaaccaaaatataagtaacttaatttaaatgcttgaaaagtgacctggaggaaatctgctgcctgctacagctcagagcaagtgctaatcatctgagatactaaggtacacacctttgtaaaaggaagcaggtgcaatctggtgtgcgcttaacttaaaattcccactttgaagagggcaaagtacagatcattctggatttatataaagtagtaagagtttggttgggatgggggggcaatgactgagaaataaagttagaaagagtccttgtataatctgctgctgctgatatgccatagacctagtgctgtgatagattaactgagccctttgaccctaaggaaaggaagggagggaggtgggaggcagggaagggagaagacatgcttcacccatgtgaattctgaaccagctgagggattcacaaaagattccagccagtggagataagttcagcttttatcactgacagggctgttgagactgtggcttgattctagggcacagtaactccctatccctgaattctggggtaagacaggcttgcccaccattcagaggcaatgctgaccaaccataggtctgcgaccctaagttagagagctgggagagcaaagcagaaaaccagggtgctctcagcaggaaagaaggggctttcccccgtgacagggtttgggtttgtgtccccacccaaatctcgtctctgtaaaatagaaaactctcatgtctcagtgttggaggaggggcctggtggggggtgactggttcatgggggtggattttcccctcactgttcttgtgacagtgagtgagttctcacaagatctggttgtttaaaagtgtagcacttcctccgtctctcttccccctcctctcttccagccatgtgaagatgtgcttgcttccccttcatcttccaccatgatcgtaagtttcctgaggcctccccagccatgcttcctgtacagcctgcagagctgtaatccagttaaacctcctttctttaaacattactcagtctcaggcatttctttatagcagtgtgagaacagactaatacattccccaaatccaatatcaaataagttacaccctcaacctgggcaaaataaacaggatgctttaggggaaaaccctcctcctataaactaaaagatcagggaataaaggcgcttcttctccctttccccagtagttctgttgggttccttcaattaatatttcttgatttaggctgggtgcggtggctcacacctataatcccagcattttgggaggccaaggctggccaatctcttgaggccaggagttggagaccagcctggccaacatagtgaaaccccctctattaaaaatacaaaaattagctggtcatggtggcatgcctgtaatcccagctacttgggagtctgaggcaggagaaacacttgaaactgggaggcagaggttgcagcgagctgcggtggcaccactgcactccagcctgggcaacagagtgagaatctgtctaaaaaataacaatacttctagatttagtatttagcggtttgagagcccaagcagcctataataatattacaatcacctgtagaggagaagtgagactctacctctgccttcttagttcctggctggatctgagagtgaagttgacataggtaggttatcaggagaaaatcatacaaatttaatagaggttttacatggcacaggagcctgaataagaaaatgaagacccaaagaaatggcaatacctaactgctttgatattaggttgagcaaaaagaagcagctgtggaaaagtaactaaattacgtggggaggctgcaggaagataggcattattttaccacggtctgtttctacagaattatcttcgctatggctcctggtcgcagaatgcttcttttctcccggtgcagggaagggcatctttcacaggaatgtttttatctcctgtttttgaggagaaaaggggagaatgacatgcacttcttctatctgctgtttttcaagtgtttctaactcaaaataatccttatgccaaagtgacatattttggggtgcacattctggcaccctttgcccgtaaatggattatttattccagtggttttcaaatttttacagaaccttggcatcagtgtgaagtgactgtaatagcactcaggtgtttgagcttcactcggtattactaaatcaaaatctgccagcaggaaacccaggcactgagggccagcccataatgccaaaggctttgcagagtccttgctgtgccctcgggatgcagaattaagctggaagcaagccctgtccacagtcttgaagaggaaacacacaagtaggcaaataaattctagcacagtgggaggctgtgacagcaggaggatgggaaatgggcagaagaagccaatcgccaatcaccacagtttcacaggggctggttctgacagccacgtctcagacccggaggatcctggagggactgcattgattaatgggctccttcactttctggctttgagttctgttcagccagcagggcacccccacaggagacagagaaggaagctgggtgttctccccctggctcctgccacagggtggcatgcatcaaggggggctgggtagggaagctcctgacaatgggactctttcctggtggtggcaccaccaggacagggggaggccccagcttccctgtggacccttcaggctagcagtggtaggggcttcccaccacctgagctagtgaactctataccctgtccatacctatgcaaatagctcccttatgaaactctcctaacattaccccatccacatgtgccaatgattcgctgatttgcacaggaatcaatggcttggaagaagattctgaaatcaatcatggaaggcttaggaaatgctgccctgcccatgctcctgatggcacagaggccgacatcatgctgcccgtgctcctgatggcacagaggccgacatcatgctgcccatgctcctggtggcacagaggccgacatcatgctgcccatgctcctggtggcacagaggccgacatcatgctgcccgtgctcctggtggcacagaggccgacatcatgctgcccgtgctcctgatggcacagaggccgacatcatgctgcccgtgctcctgatggcacagaggccgacatcatgctgcccgtgctcctggtggcacagaggccgacatcatgctgcccgtgctcctggtggcacagaggccgacatcatgctgcccgtgctcctgatggcacagaggccgacatcatgctgcccgtgctcctggtggcacagaggctgacatcatgcagaaaattatggacattaatgaatttgagttaacaatagattcaaatgaactgtcactggagaatttctggaagccataaaccaatgtgttttactgatatattcctcttcatgaatgtacaatagtgatacatcattttttaaaatctttgtcttaataagtctacctatctcagtaagtataaagtaaaaatcctgggtgataaagcactttatcacaatttagctgaccacctacattgttttaatgaaacaaagtaatgataaatcatacaatcaatggtattttagattcaataaaaaatgacagtggcttttggcatgagttctgcctaggctggtggtaatactgtgttccctgctttccttctgcagagccatgcatagccttagctatcttttcattttcaacatttctgaattactttattttagaagtctctcttttacatagctcagggttttgctttatgagtgacatttgtttgtcttatttctaccaagaatatatttaatgattttcacaaatccttttgtcatagttccctttgtcgtctcttggttggctgaaatttattctccaatagtttcctaaaggaagagcccatgagaacagtattttctatcttaatgcatgtttaatggtttaatggtgttttactgactttttttttttttttttttttttgagacggagtttcactcttattgcccaggctggaatgcaatggcgcaatctcagctcactgcaacctccgtctcccaggttcaagcgattctcctgcctcagccttcctagtagctgggattacaggcacctgccaccacgcccaactaattttttttgtatttttagtagagacggggtttcaccatgttggtcaggctggtcttaaactcctgacctcaggtgatctagccgcctcaaccttccaaagtgctgggattacaggtgtgagccaccgtgcccagtgttttactgacatttttacacaaaaggacagtttgccttcaactttcctcttttcagtattttgctggtgttgctttgctaccttttagttaaattttgccaagaggaaactagaggctaatcttttacctgccttgcaagtaattttcttttctttttttttcatttttttatgttgttgttgctttggtcgtgctgacttcgaaattctttatcttcaaagcacaatgattttactagaatccatttcagcgtttacgattctagttctattttcctagggcatagtatgcctttcagtatgttgcttgtttttaatttcaggaacattttttgaattaacatgtaaataatcattgttatttttttctgtaggattttaattttttgtgtatcacaactctcatctgatttctgatcatcttttctccctagtccttttaatttttcctttgttcccatttcattgaatttacttttctcatctggcgtctctatccatttgtgcgtcttcaatttctgttcttcctagtgctccttttgatttcattttcttttccttttttcttaaataataattctgagttctctaagctcatgttttctctactgttatttagtcatcatttccttaagttctcaaatatctgatttgtgattctcctgcatagaggttatttattaagtttttttttatcatagagaaacagtcactttaaaaatctgtgctgtggcaacgtgtttctggtgagtgttattcctctattgaaattttgttgcttttcttcaaaatttgtcatgtagtatcttatatcagtgatgccccagctccttcctacctgctattgctttttttccccatcattgaatgacttagaatttgtggaaatttcgtatataaaggaggggtcaagggaaccctcagatttttactgtaaaagattctgccctctgctgccatagaaacagttagattcctgcaagtgtggccagttattgtatttccctctctctccttcttttttgatatctcatttcctctaacactttgagctaagccaagttcaagaagccttctcccttatactctgtttctccatccattgttactaacaaggaatttagctgtatgtttcagttcagctgtatgtttccatcattttcgggaaatgtgtttttctgaacttttccaaagatctgctacaatttagctcaccttcagctcttcattattttactcttcaatcttgcttgcatgcttctgcaggatcttagctgtttctagtatcctgtgcatgcattttgtactagagggaatacatctatctcctagttttgctcaaaatggaggttttccttttacgatttccaagaggagaaagggagagatgatgatttatgcagcaatgctcatagtgtaaatccacttcgaaatgttttaatttgacttattggaaatattttctgtgggaatcagcttttggttaatatactatacagagatgctcctcgacttacaatggggttacatcccaagaaatccattgtaggttgaaaatacgataagttgaaaatgcctttaaaggataagatggtcaagatggtgaaatgcagaagtcctgactcatgtgcaatggccattactgtttgcagcttcatgccgggaagttatcttgagtttcatctcaagaataattgtcttcttctcatcagaagcaggaaacacagaggagtgtctgtagaaatgaagagatgggaaaacacgatatccaaaaaactgcaggcaatacagtccactgtgcagtattggctgttaccccgatggtcatggggctgcctggaagctgcggctcgctgcccctgcccagcagcaggagggagtattggacagcacgtccccagccccggaaaagatcaaaagtcaaaagtggaagtatggtttctactgaatgtgtatcactttggcagcaccgtaaagtcaaaaaattaagtcaaaccacggtaagtcagggaacatctgtctagctgtaggacaattcttgaagaactaattgcagtgctcccagcatggtgcaaatatgagggtaacattcagtttaattaaatgtcaaatcataggatggaaaatgacagtatctttgtccaaaaagcagatgcagaagcagcataatccacagaaattttcaatttcatttgctacccagcggctcaaatccattatatgttaagtattgttccagggcttcagcctccccggcagatttctcctgtttttgctgttgctgcagggactggccccgtcttctgaggaccaggcctccacggtggctgcacacctctgctttaaatacttttaaagttgcagaaaaggaccttcttgaagcaaaaaagacaccgtcctcttctgcatgggccaatgctcaacatacacatgcatggaaaaaaatttccaggaagtgataaactaagcatggggcaaataaaacaacacatgacctgatttcatctccaagtttgctcttgtgtaggaaaagataagcatttctttcaatgttaagttggggtggtatctaataaatcagaatgaaaactcaggtttcataaaagcagtgatttctcttccagagagggctctgaatacattgttacttacttgaacatgctgtccttcaaggtaggagctgaggcagggcctacacctgtaatcccagcactttgggaggccaaggtgggaggattgcttgagcccaggagtttgaggccagcctgggcaacatagtgagacccagcctctaccaaaaaaaaaaaaaaaaaagaaaaagaaaaattagccagacatggtgatgcttgcctgtagtcccagctaccggagaagctgaggtgggaggatcactggagtccagaaggcagagattgcagtgagccgggatcacgccactgcactctagcctgggcaacagagcgagaccctgtctcaaacaaataaaacaaagtagaagatgatatccaagccatttgtgatttgttctgaccttccaatctatgatttaggtattgatttagaatgcattttattcatcctataaaaatctctgccaattattcttttttttttttttttttttttgagatggagtctggctttgtcatccaggctggagggcagtgatgtgatcttggctcactgcaacctccgcctcctgggttcaagtgattctcctgcctcagcctcccgcgtagctagctgggattacaggtgcccaccactacgcctggctattttgtgtattttagtagagacacagtttcgccatgttggctaggctggtcttgaactcctgacctcaagtgatcctcctgccttggcctcccaaagtgctgggattacaggtgtgagccaccacgccctcacagaacaatgtattccttaactttttatatgctttttttagattgaaaaatttcaaaattataagcaaatttaatgcttgaaattggacatcagcattgagctggagaaaaatcaatggttccttctgatgtgaaaggaagcaacaatatataaatacaggtctatgtcttcatttctccttgtaacaaaaatggggtattcagtgttgaaaatttccttaggcaattccccaaacaactacttaaaaatacccagagttggccacttgttctgtgcctacatcagactccaaaaaaggaacaaacactttcagcaatggtgattgaccctcctataagtttctctcattttaaaacatgggaaaatcatcacttctcactcaatagaagaggttaggtttagggccgtgctatgtttattttattgctactatgtaagccaactttgattctggccagaacgatcagcttatgtttatatcagctttaacaagatccataactgttttccctcttcactagcctggctatatgtgggatacaaacttctgtgcttctcacaaggaaaaaaaaatccaatttcaaagactcaggtctaaccactcaggtgactttaaaatcaaattattctatagaattttacagggtgacagcatatttgttgaatgatatgatattgatgtgtacatgaatttttagttggagactaaaatctgttttagaaatagatccagtgctttttagaaaatacttaaatttttcccattgatcatatagttccctaaagttttagctttttaaaaaatctaaatggcattatgcttttaaagaaaggaaagtggaacgtttgattatgaaatgtagggaatgctaatgttttatagtttatgtcttcaagaatcagtttttaagttttttttttgtttttgtttttttttttaagacacagtctcgttctgtcgcccaggctggagtgcagtggcgcaatctcggctcactgcaagctccgcctcccgggttcaagcgattctcctgcctcagcctcctgagtagctgggactacaggtgtccaccactacgtccggctaatttttgtatttttagtagagacagggtttcaccatgttggccaggatggtcttgaactcctgatctcgtgatctgcccacctaggcctcccaaagtgttgagattacaggcgtgagccaccgtgcctgccccagtttctaacattttttataaccatcatacaattgaaacaaggtgcaactggactcacgaggtcatgggtcaatttcctgtgagtgtgggcttagaccgtccagcttgttctcctgccacccactcttagcatggaaggacgaagcgggtgacaatcagccaacatgtgctcaaatagctagatgttcgatactgagtagaaaaatccttacacatcagctgagtttttccatgtttacccatatattttggcatagaatgaactaaatctgtgatttttcagcatgttatggttgtagagttcatgaactattattccatcttgggaatactttgagaagtaaaagtaaattttattattgcaaaagatgcagtaatatttagtattttgttttaaaagtcaaaacttactcagcaaatgcacggcatacagatggtgaagaggtgattcagtaaagttttggtttcaagaaatcctggcccacctaagtaatctccagcatagcaaggtttatcttaaagataaaaaaggatcaaaaggcccttgagaattaggcagctaccccctctgtctccctctccctcgtgcaagattatctgctccccacctatgactgctctctccctttcctcagagtggattcttccccacagccacttgtactggcctcacatggtcacctgtgccccactttatcatggctcactggcccctcttatcattttctccctcccagattattgacagatgaatgggattttcacagtttaccttttcaatgtggctctgtatccttagcaaacctatggattctctgccagtggcagaatagagacagttgcaaactcttttcttctcccatcaaaagatgaagtctgatttccctctccttaacactggctttgcctttgagatttgcttgatgcatagaatacaagagaagtaactcagaagaagaacttccaaggttaggtcagaaggagcctcgcaacttctatctgggtctctggtagaaccacactcttgcccttggaaccatgagctgccactttgctagaaagactttgtgaaaaggctcttggacaacacagataggagaggagtccagctgagtcttgccttcctatgcccccgccaaggtgccagctacaggagtgaagctatcttggacccttcagaccagatcagctatcagctgaataccatccaccatcctgagtcaatgccacgtgcaacagcatcacccacaggagcactacccaaatctctgacccacagaatgatgaaatttaatacaatggttgttttaagccactaagttttagggtagtttgcgatgcagcagcagatgcaacgcctctgttcacagcggctaagactcaaagggacgcaaaccaagcaacctacgtctaccccagcaaggacagtgggtagaaatttccttacagaaaagactgcatgtcatcaggaatcataactgaaatctctcagttaattcctatcctaaatttccctcgaggatataacaaggagaaacagtattaagttacagctagactctggtgggatttagattaaaaatataaaagtacatctagatgctagatgagactagtgacgtcacgaaccagactgaaacttaatcacattaagaagcaggtaatcatattcaaacgagatttgtacttggtaacttaaggataattacatctcaaagccaaggactatctttgtcaatctcatgttttcatgatcagctgaagcagagaaattaatacattttaatgatgaaacttagcctacatgtattttgtagatattcacttagaagtgaaaaatatgatgtaaaatcagttatgtgtagatatttttggagaaaaaaccttaaaacttagaaaccagttacatagtcattattaacttaaaacagatcatactgatatatttctcatatttcatgcccttccttaaagacaatgattttttctcaaacatcaaacatttcagcctttacatatttctccagaaaccaccacaagcatccatatagtgtgtttactgtcaggtttattctgacttgccttcacaacagttgactctcagtttagcttgttgattcacagaaaaaaaaacctgaatgccaccaagaaatttccaagaattgttaaaaaaaattaaatgtgaaaagaagaacctctgatccttactcaatgtgttctctatttttccctcggactaattaagaaaagcatgttaattataatggattccaaatgtgctaacctccagttagtattttttaaagtattgactattttggccagtccaagattgcctattagattataagctcctctgagacccagaggccatgcctttgttgtcattgaccagaaagggagaaagagtaaatctctgttcattttggggggtgtgataactcccatttcaggtgtgctgaaggtggcagtgatggacatttgctgtttttaccatctagcatctgtttattgcttttttctctcttttttttttttttttttttgagacacagtctcactctgtcactcaggctggagtgcagtggcctgatctcggctcactgcaagctctgcttcctgggttcacgccattctcctgcctcagcctcctgagaggctgggactataggcacctgccaccaagcctggctaatttttttgtatttttttagtagagacggggtttcactgtgttagccaggacggtctcgacctcctgacctcgtgatctgcctgcctcggccccacaaagtgctgggattataggcgtgagccactgtgcctagcctgcttattgcttttttcaaactagcttctccttgaggagaacagccttccctatttcatccatctgatttgggtggacagaagacctacctccaactgcaaggatgagacgtcacgggcttcagttgatcaacacagctcagcacctttgcagacagatttgcttagaaatgtccaaatagtctatagccaaggtggtatgttttagggcttctgaataaataagagcttttattctccggcttgcaggagctcctgaaaagcaatctccttcttctcctgagtgtgatgttgaagatctgtaactacagtcgccagtttgccgccaggtgggaacaccagttgggaacaacacgggcctgcgagggatgccgctgaaagcaggaaagattagtgacacagacagaagctggacgaagtctcacctcaggtgcacatctgggcttcgcaattttatgaacctgtaagttctctgattccaaaggtgagttgtattttggcttatgttttgcagctgaaagatttctaacttcttttccaccacagaatctttgaatgatttagatataaacttcaagctccatttaggtcagtgatttttgtctgtattgttcactgatgaatcccactgccttgagcacagcctggcaatattag

SEQ ID NO: 569 - DNA, 51373 bp, Homo sapiens
ggcctgcttacctgttaggcactgaaaccgttgcactgttaggtttagcaactggcccggaaattgggattccagaaccaagatgttaggtgctgtggatgcatttaatcagacccaatacagatgctgcaattcgctgtggcccccatcaaagtcaacagcagcagagaggctgtggtcctgggccctcaaacccggcagagtcagaccaatgagcttggatttgcttccatgactcctggcactgcgataggttctgtatctgatgcgttgtctgcatggctgaccaaaggaggccaattctttctagctgttacaccaagatcacctcacctcactgagaaagacctcagtcccaaagtagagaggtcggttaaaaggttgcattaaattacctttttggacgtggaggcagtgacagtgacctgcaggtggtgtgcacgctccagagtgcctgtggcttttaccaggtgggaccttctctccaggcggtttctcttcaacagaatgaatattcacggaggttctccaaagggcaagaaggtgttctgggagcagcatgacattgcaaagatgcaaagtctcatttttgccctgacaaaggtgcaatggaaaacaactttcatccataatggcctcagtttccctttactctctcattcagccaacctgcaaggcatcgtcagaataacttttcctatttcctaacccccatatcactcataactccattctgagaagtttttcgaaactgttctccatctcaatgaagctggaatcccaggtccaggcttacctggtggtgctcagaggtcaactgagaaggtgcagggtttacaggggagtcgtaacctggggcaggtaaacagtttgcatctgggctgactgtagagtgacctgagagtcccaagtgcacctgtgcctcatcctgatggcaccgttgctggttgtaatctggccagcaatgaacttggaatgctcagtgaatcacattgtataaaaacaggaagcttctgcgcttttcgattgcatattggatgtgagagcccccatcctatggcaacccttgcaagcagaagatgttagtgtgaaggaaatattaaaatttctgtgactcagctgtcagatgcttggagatcccgatgttattactggacattgggtgttgttactgttaaaccgtcacatactgaatcattctgctagcagcctactcccaacgccgaacacgtcccctcatccaacgggatatcaaaagcagccctgagaaagaaactcaaggtgcggtgtactctgcacaagtctccagttccctccgttgaggttttcttggctctcatgtcacaagatttcggatgattcttaagcccatggaagtcggtaatcatgagacaaaactgggtttcctattgtttgatgagtggcagagtctagcttacatttgggctgactgtggagtgatggaagctctgttctctgtgtgttgactttggggcagttcccgtaggcctagtgggaaggccgcgtggcagcttggctggcctggggtgcagcgagcaatagctcccacggttggccaggaggggtttgtgctgccttcttgttggatggtgtcctcttccctcttatgtcagcagaggcactgggtcagaaaaaggcagcaccggcggcacgagcttgttcacaagagggttggggaacatcacagcacacacagctctgtggaagggaagctcacattcagggtcctctgcatcccgctcctgtgcttctcgtcatcaaagcatccttcacaaccggcttgactccccttctgccctctgcagcaagcctggccctgggctcttggctctcccaaacacttctctgttttgttttgtttttccccttgggtgagatagaatggcccccttcccctggggtgggggtgggggtggtggttaggctctgataaaatcccagcgggctaggcgctgataaaatagttttgtttgaggtctggccttttcatgacagagtattttgggcatattttaagatggttcctttttccctccccctgctgggagtcccaggggtttttctctaatcttatttttctctcatgagtttggggacccctaggaataagcccccctgagactgatctctaaggcttgtccacattgaatctctggcagcttatcaaggaggattaagtcttcctaccctgcgctggttccagtctccacttctgctcatgggttcgtgctcccacaggctgtgacgctgtgtgtctgcctgtctgtctctccacttttgaaagcagcaatttgcctgtgacctcacttctctgagggacccaggagttgctgatttctagtttgtataggtttttatctgagtgcatgggagtgaggatgtccaacatcttttcctgctggaccagaggctggaaatgtcctgcctttcttaaatgtctctaaaatcttgttctcaggggaggatacaaaggtcattcattcactccttctgcctgtctgtgcacattttctgggctcacactggtttttaggcctagagcacacaggagggtgccgtgtggtcttgctcttgtcctggttaagaaggccaggacagacataaaaccaagtccagtgcaatgttgtgtgacgatttagaaggaaggttctgtgtggaagagaagaccatgacctgtattaataaccaagcaaacaccaactgaacaacagaagacagatgcataagtgcatgtttacggggggtgcagttctctcctggggtggattttcaagggaaataagttaacagggacgatggtttgagggtgagataggaggggactcttttccgagacttgtaaagtgccttcagatatgtgacctcctggggccgtgtttcaggaatcctttttggaagtgagtcacctccatgtgcaaaaaatagcagtagaaaatgttttgtcggcagcacagcctgagttttgggtatttgtggcctctttacgcagaaatcaaaatacatccatgtttcttgccttttctgctaaaaactgagaagggtgtattttcaaaataaggataggcctcttagaatgggcatccttgctgggtgcaggttctttgaatggtaaggccagagtctcttaagtgcatggctggtccctttactgttggtttaatttacagtcggcctcttaagtttccaaatctccatttaattgacattttcgggttaccaagattgtgctttgtgttcttgtcaacttttcttaagttttttgccatcatggctatgtagccactttaaaaagtccttttggttattttgagtcactcataagcagatataatgggaactacaatacatgccattaggctactatttagtacttcttatatgttcgcactttcttaattacattaaataattctagcctgtacacactttagtttaattaaaacaagactgtttccttacatctaactttcacctcatggtacaagaagggagctgaaagaccagttgacattaatggtaccatcatgcctctacacagccaagcttgcttgagaaacccaataatggctgatcacagggacttccctgctggctgttggtccagaatggaccacagttgtgtgtttgcatgttgggaacctgctttcatggctcctctgacccacgggaggtgagcttgtgagagtgtgatcacaggcaactcaagtgggaccggtgcctcggcctcaccattttgctatgatggtatttcccttcaattatgctgctaattgtgtacgtatcatacatatcttctgtattatgtataatacacattatgtctgttatgtatagtagacatataatgttgcctctaagggccatcttctttgcatgtcattggataagttggtgatatatttacataaaccatcaacttatccaatgatatgcaaagaagatggcacttcaaagcaaaattacatgtctattatacatggacgacttcagaaataatataaaaaattaccaacaggatctactatgagatgatcaattttttctcaagtctaattttttaaatatattttagcttttcttattggccttttagtcaaaatatggcattggctcatcagacattaaccttctatttacttttcttgaggtatttttaaaaagtatttgtgtaacttttagaaaaaagttaatttttaagattacaaagtgcatcccatcaggatattaataacctgcagggccaccatactggcctcactgagttagctagtgctcagttaaactaatcgtcgatgcattccaggatactagtacagtcacatgtcacttaaacataggtataggttccaagaaatgtgtggttcagtgagttcgtcattgttcgaacattgtagagtgtggttacacaaacctagacagtacagcctacgccaaacctaggctatgtggcatagcctattgctcctgggctacaaacctgtacaggatgagactgtgctcaatactgcaggcaactgtaacacaaaggcaagtatttgtgtctctaaataggactaaacagggccgggcacggtggctcacccctgtaatcccagcactttgggaggccaaggcgggtggatcacctaaggtcaggagttcaagaccagcctgactaacatggtgaaaccccatctctactaaaaaaaaaaaaaaaaaaaaaaaaaattagctcggagtggtggcgggtgcctgtaatttcataatctcagctactcaggagactgaggtgggataatcgcttgaacccgggaggcggaggttgcagtgagccgagatcgcgccattgcactccagcctgggcaacaagagtgaaactccgtctcaaaataataaaaataaaaataaataggtctaaacatagaaaagctttggtaaaaatagacaaagattaaaaaatggtgcccctgtatagggcacttgccatgaatggagctttcaggactagaacttgctctgagtgagtcaatgagtatggagtgaaggtgaaggtccaggacattcctgtacattacactggacacttaggctacactgcatttataaaaagaaataaagtgactgcgttacaaccttacgatggccacatcactaggtgatagaagtttttcagctcttctctaatcttacgggaacattgtggcatatatggtgggtgttatggggtgtatgacaataatgacaacaaggtggcaagctggggacaccatgtgccctgtgagcatccagtaagcggtgctagttccaactgtcattagttgggccgggcaccatggctcatgcctgtaatccaaggcagaggcaggaagatcacttgaacccaggagtttgaaaccagcctgggcaacacagaatctttctctataaaaaaaaaaaattaaattagctgggcatagtattgcatgcctgtagtcccagctattctggaggatgaggtgggagaatcactggatcccgggagttcgaggctgcagggagctgtgatcacaccagtgctctcaagcctggatgacacagcaagactctgtctgaatgaataaacaaacaaacaaacaaatgcaattgcaaccaaacttctaaaatgcaacttacattgtgttaaaaaaaggtacagaacagagcctacaagctatagccatgagacttttaataatgcatttatatttgtgtttttaaagtctatttaatgcagcagaaatctggtcagtggttactggggtgagggcagggcgtggctgaaatggggcacaaagaactttttaggggatgggaatgttctatattttagttgcggtggtgattactgcagtgtataaatttgcccaagctgtgttcttaacaatttttgttaacataatttgcgtataacattttgctttgttatatgcaaattatgtctcaatgatgttgactttttaggaatctcaatatatcattgactttcaaggcttgctgaaagtagttttagaaaagacttccaaaaccctccaaaactgagcataattgaaacccgtgtaagggaaagctttatttagaattgaggagcctgtcaatgaggtctgggcagttacacaaatgacatttagcattttctgcactggctgccccaaaaccagacaagccccagccccagccccaaggaagaaaagaattgcagaaagtgaactatgatgagactatcttctgccaagcctgcaaagacctacattgaagggaccccacagatgtcagaaaaatgtatctccctcctcagatgcagaaaaccagctcgtaaggagatgagtcctaggagggggacctgttatgaggctaaggccggcagccgtggggcactcggtggggagggcagcagcccccacagaggcggatgtgaggctctgggaagtggagttattgaattcagtgcagcaaaacagctctttgcggttcccacaggtactgcctctgttcaagtcctccctacgctgtaggccaagagaagcaaggccccttcatccttgggcttaggcttctgtttcaaagctgcttttctgacattgacacccagcaccagttcaatccctccctggctccagtcctacttaaccttgattgatccctaaaccaaccacgttccccaatccacacatcacttaagtcagctctgtctattcatctcacaccggctaagagctcaaggccctgaaggatctttaggtgtttgtggtgatccacacactcgaaggagcagtgcatcgagacagctcaagcatcctccatcaggtatatctagaaggatggagaaggcgctgcctcctcccacccaagcttgcaaggaagcaggatgaaccctggaccacaccaccctcttcctccacggacttcattgtaacaggccagggcaaatccttccagaacttggagcaacatcaggttttagaagctttcctgtgtagacccatattttgtttgaaactaacatcaaagagctttctgaccgaacatactgagttcatttctaagtcttttctgtcatcctgtttggctgttagctccttgcagacaggatcctatgattttgctcaccacaaaacctcatgattttgtccctaaaacattatgcacacatagtaggtactcaataattatctgttacatgaataaattgcatatacacacacacacacacacacacatctctgttaattaaactgcagtctgtagatagtatctttgtaacaggttcaatccttagggcatcatttttccataccttgattattgactcatataactcagatctgctgttatgacatccagatggaatttctctgctgaaggcttatgttgaagtcgccctcagaaaccaggagtctacccggaaggccaacttcagtggataatgtgtgtgggctgccagcttttccagtgtgatactagtgggggcaggcttccaagccacatatgggtaagtgttttcctgtgtcttcctgctccgtggtcttcctccagattcccagcctgtgcaactccctgttgattgaggtcctcatcctcacggtcacaggcttgctctctgtgactctgttgaccagagggaggtgctgtggtttccacagacccaccctgtgataggtattctcagagccaagacaaccagttctgcgtgagtctgtctgtgcctgagtcagtgtgctgagatccacatttaaaatagtaggccaggcgcagtgactcatacctgcaattccagaactgtgggaggctgaggcaggaagattgcttgaggtcaggattttgagatcagcctggaaaacatagtgagacctcatctctactcaaaacagaaaattagccaggcatggtggtgcacacttgtgcttccagctactcaggaggctgaggcaggaggatcacttgaggcccggagttcgaggctgcagtgagctgtgattgagccactgcactccagcctggccaaaagagtgagaccaagtctcaaaaaaaaaaaagtaaaatgcacactgtctgggtgacaaccactctgttgaatgcagtttggcaagtcctctgtagactgcaggaatatcttttattccagaaacctgtgggtggacgcctgagaggggacactgtgagcacatgcagctcacgatttcagaagcatggacttccgagagctcgcagtcccagcgactcaggagcccgcacgtgtctgcatgtgggactcacacctcctgccctctccatggcccaagtgaccatcttctcaggcttgaactgaacaggtttctaactggactagacaggttttttctccaggtccagaccaggggcagaggggaattccagaatgggactctgagcatttctttcctttgcctaaaaccctctcatatgggtctctactgcccttggagaaaatccagaattctctcttggtcttcaagcggtgctgcgtgatccggcctttgctcaactctctggccccatctcccatccctccccgcttaactgatggtttactgtgggggcctcgctctgggatgcacccgggccaaggtccctcctgccttggggccttgcacatgctctcctccctccctggaggggccaccgcttccccacctcacccagggaggctttctcattcttcaggtctcagtttggatatcagttgtcccagaccaggggaaatcccctcttcctatggccttcactgaaacgctttgcagcatttcacttcattcactgtttccgtgattgcttcacttctgtctttcctgtgtagactccacagcaagcgccctttgtctcaagcccagggataagaatgagctggcttagaatctatcgaatgaaagtctatgatacctcggccaggtgcggtggctcacgcctgtaattccagcactttgggaggccgaggtgggcagatcacgaggtcaggagatccagaccctcctggctaacacggtgaaaccccgtctctactaaaagtacaaaaaaaaaaaaaaattacccaggcgtggtggtgggcgcctgtagtcccagctactcgggaggctgaggcaggagaatggtgtgaacccgggaggcggagctttcagtgacccgagatcgcaccactgcactccagccttggcgactgagcgagactccgtctcaaaaaaaaaaaaaaaaaaagaaagtttatgacacgtcatttgcaagacttaaaatctggctagcctgttagaacattttcagaagttctaatgagtgctttgcaactgtttaagaatgttatcatgtttccggaaaggaaatatttaaagctttgctataataggtggttgaatgcaaagaaaaagacatcatagtcagtctccttgtgctaaaaactaaaatctctccctgttcctttagagctgatctctccatctcagccgctcttgacactggggctgcgttgtctttgtcctggggctgtcctgttgggttgtaggctgtttggtgccattgctgtcctctctcatgagaagccagcagcactggtgtgcagtaggcaataaaaaatgtctggaaggacatggcagtggtccctgaaaggcaacatgggcctaggatgagaacccctgacatgagattttaaccataagcagccagcttcaggctgtaagcatgagatccctcccacctgcgcgacatttgctcatcctcgagtgcccacacaggcttcatacgtactttaaagtgccatccttttgggctttttctgcaatagactccaactaaatattagggctttagacttcctttttcttttgcactggcctttctgaatgctgctaaatctatccagtgtggaagctcagctcctgagtgagccgtaaatattccccgatgcagttagcattgttttacctggaatgacacattatctccatgttagagatgctactgtggctcagggtctcaaggaccctgaaactcttctgtcattcctgttttcactctaatttctcaaaatgactttttgaacattggggaatacttcacgtgtttggaaaggaaggcatttgaggagatactttaaaataataaaagggaggagttggaaaggagacgcagtgaccgtctgggtaggccctaggtgggggccgtgtcagggccgcttgatgaatggaggctccaggggccccctatttgttcagtgctcttgttctgatacaactgcgcacaaaaccggcattgaagtgtctgccatgaaaacataacatcacctgacaacggtcagcccacagggcattgccttgagaaggccatattgttctgcggggccggggccctggcccacggggtcctgagacgtgaagtcgagcgaggcatgcggaagactttccagtacattagaaaggacctggccgcctcccatcaatactgccccagcccgagcctgacagatgagaaaacacggagaaagctctcctctgacttccaagtcctcctttctctccttaaaacccagagaactgtggcccagagccgagcggactcacagccgtgggtctgaaaatccttggggtggacggctgtggctgcctcattttagtgtctgcctgtggctgggcattttacatttccacttttcccgggtttgagactaatcacgacccccacccggaatgtttaccttgcaaaccacaagccattaagcgttcagggccacacccaggccaccaaagcctcaaccaccttctgctaatggttttaaagtgctccttccactcctaaagagaaagaatatttcacgtcaatgctcatacttaattaatttacattttattttaaatacaaataggaaaatcaacattaaattatcacataaaacagccatgaaaggaattttttgtgtggataaataacgcacaaagaccttcatggatttttagcacattttactctacaaacatcttgtgtttgggattatagttggattgtttgaatataccacgagttcattttccgccacttttaacaccaattccacccctcaatgttcttattaatgacccttttgcttttattattatttattttaaattttacattgttgtgcaactatcaccatcgttcctctgcacgtttttttttcttgcaaaactgaaacctttgcccaataaacaatgattttccattccgtttctcttcacccgctggaaaccaccattctgttttctgtcactatgaatttgaccaccttcggcaccttaaataggtggaatcttacaacatgcgtccttccgtgaccagcttattttacgtggcatcatgtcttcaaggtgcaaacatgttgtagcgtgtgtcagaattgtcttcatttctgcgactgagtaatgttccatatggagacgcctcctttggtttatccattcatccatccatgaacagttgggctgcttccccgtcttggctatggtgaatcatgctgctacgagcatgggtgtacgaatatctctctgagaccttgctttcagtttctttagatatttacccagaagtgaaatcgctggggcatatggaattctgtgttgtttctcttttttttcagataggttcccactgtcgaccaggctggagtgcagtggcacaaactcagctcaccgcagcctcaatctctcaggctcaagcaatcctcccacctcagcctcttgagtagctggaacctacatggaacagccatttgccaccatgtttggctaattttatttatttattctttaagacagagtctcacactcacccaggctggagtgcagtggtacgatctcagctcactgcaacctccgcctcctgggctcaagcgattctcttgcttcagcctcccgagtagctgggattacaggcacccaccactgcacccagctaatttttgtatttttagcagagatgggacttcaacatgttggctaggctgctctcgaactcctgacctcacttgatctggcctcctctgcttcccaaagtgctgggattacaggcatgagccaccatgcccagactaattttttattatgtgtagagacagggtctcactgttgacctggcttgtctcgaactcctgggctcaagtgatcctttcacctcagcctcctaaagtgctgagattacaggcatgagccactgcacccagccgtaattctgtttttaatttttgggaatcaccgtattgtttttctctgtggctgcattattttacgttctcaccacagtgcacaagggttccagatgttccacatccttgccaacacaattgtttttgtttttatttgtttgtttttgatagtagccatcctaatggatgtaaggtgtggtggttctttttatacaatttgaagttgcagagttgatatcagtgataacgtgaaaaattacagtaccaatagtgttttgatattttctcagaaaatgcctatttgtttgttttattttagccttcaaatgttctaaaatacatttataatttataaaatttgtaaaaccgaggccccaagaaacacacagttattgagcgcatttgaccacagggaggttctttgctttctggctctaggatgagccccggtgctgatggcaaagcctgtgcttagcccagaatagacgctgcggccccttgtcatgtcagcctgagctgaccaatgcaattttggtactgagaagtggaaggctgttgtcacagatgtctaacaatgtggaagtggctttggaattgggcattagttagcgtgtggaagagatctgaggttcatgttagaaagatctcaggtcactttgaagagatcattggtagaaatatagatgtttaaggccattttggtgaatgctcagaaagaaaagaagagaactgtagagaaagcttccatcaccttagagaacaaaaatatcatcatgaacataatatgggtagaaatatgaacatgaaaggctcttatgatgagatgtcaaatgaacataaacagcatattattggaaaatggaaaaaaggcaatctttgtcataaagtggcagagactttggctgaattttgcttgagtgtttcctagaaattagactttgaaaatgatggcctttgacactgagctgaggagatttctaggcaaagtgttgaaggctcagcctgtttatctttattgcttatagaaaaatgttggggaggagagaaatggaagaagaaatgactcatggccactgagcgttgggttcatggaagttgtgatgaccagaaggcaaggatttggagtcagaaatgcctgtactcatctctgttcctcttcattttttagtgtggttgacacactcctgtgcagattgtccctgatgccaaaaatgcaactcctgttttgcccaaggattactttgggtttccctgagacaaggtctctactacaggcagtttacttgggaggtggtcccaggaaggggaagtaaaggagtggaacggtgattgggaagggaaacctaatgaagtgtgtgtaaataagctggttgactgccatggaccactggtgtcctgagtacctgattgctcacaccttaaaatagtcccactggagtcagtggggctgccctggccccatcccactgactgagggttgctcctttaataaaaataaaaaacatttatttatttatttttttaaatagagatggggtctcactgtgttacccagcctggtcccgaactcctggcctcagtccttctaccaggcctcccaaagggctgagattacaggcatgagctgccacgcctggccgagggtcgctcttgaccatcaatttcacttctcggatgttctctgagtaggatcatacagcatatgttctctgagtaggatcatacagcatatgtcctttgggactgggttttcttcatttggtatgcttctttgctgattctttcaggttgtggtgtgtattaacagttcattcttattattgttgagtagtatttcatgatataaatgagttttttttttttttttctgtagagttagggtctcattttgttgcccaggctggtctcaaactcctggcctcaagagaccctttcacctcagcccctcagaatgctcagatcacatgcatgagccaccatgcctggccacatattttgaaattattacttactgaaaaacatggattctttctagttttttactatagcaattaaagctgctatgaacattttgtaacaggtttttgtgtgaacacaagttttcatttctctggaataagtgaccaggactgctggtttacatggtatttacatgcacggttcttaaagaaactgccaagctatttttcctcttttctaatataaacatttggtgctgtaaatttctctgttagcactgttttaccagcgtcctgcaaactttgatatattgtatttttcttttcattcagttcaatgtacattttatttcctgtgaggtttcttttttgactcatagattatctagacttatgtggtttagtttccaagtctgagagaatttcttcttatgtttctgtaattgattatagtttgactccattgtaattaaagaatgtacgctgtatgactaaaattcttttaaatttgttcaggtttgttttacgactaggatatcattcatgttggcatgtgttttgtgggtgcttaaaaataatgtgtgttctgctgttgatgagtagagtattcaataaatgttgactaaatcttgttgattgattcagttgttgtgctcttctatatccttgttgattttctgtatcagttgtttattcatttggatttttaagttattttattaatacttcctttacttccccttcctgggaccaccttccatgtaaactacctgtagtcgagaccttgtctcagggaaacccaaataataaagacaaataattgtgaatttgtctacttgtcctttcagttctatcaattttggttcacatatttctctgctatgttgtttggtgtatacacatttagaattgctgtgtcttcttgatagatttaccctctatcattgtgtaagttatcattctgtcgctgttaacttttttgctctgaagtctactttacctgatattaatattgtcattcatacttgtttttctttgattattgtttgcatgatacatctgtttttactacttcttctttttttttttttaacctacttatatttttaggattgaaatgagtttcattttttttctttttctttttttttttttagatagtcttattctgttgcccagtgtggtatgcagtggtgtgatctcagctcaccacaacctctgcctcccaggttgaagtgattcttctgcctcagcctcctgagtagctgggattactggcacccgccaccatgcctggataatttttgaattttttaatttttatttatttatttatttatttatttatttatttatttttagtagagatggggtttcatcatattggccaggctggtctagaattccttagctcaagtgatccacatacctcagcctcccaaagggctaggatgacaggtgtgagccaccatgcctggccaaaagtgagtttcttatagatcatatacaatacaatttgatcatgtgtgtgattttttggtttgttcgtttgttttaaatccactctgaaatctctatcctttagttggtgtgtccagaacatttacatttaatgaaattataaatatgttagcacttttcagcaattttactttttgttttttttctgtttgttctctttggtttaatgttctcttttctttttcctgcctttcaatgggttacttaaacactttttggagtatcattttaattcatctgcagtgtttttgagtctatttctttatatagcttgcttacaggttgctctaggtattttattaaatatgcataacttataagcctaatggtgttatcattttaccagttcaaatgagttgtagaaatttaaccttccatctgttctgataccttttcccatttataatacaattattttgcatttctgctatatacatttaaaaccatattcagtgttatattattttgcttaagtcctcaaacatgatttagaaaattctagaggtgaaggaggatatgttgcattattcatatatttacttttctccattgttctttctttcttcttgaggttccaagattcttacttttattattttctggtagtaaactttctttagctattctttttaagtgtagatgctggtaaaaaactttcttaattttattcaactgagaaagctttgatttccttccttcattcacaaaatacgtcttaactggatatgatagttcttttcttttcagcacttgaaaaatacactcctttttttctggcctctgtagtttcatctgagaaattctctatcattcaagtttttcttctgtaggtaaagtgtcatttctgatcactgctttaaattttgtttgtctttaattttcagaagtttgactatgatgtgtgtcttggtcagtctgagctacagtaacaaaaaaaccactgggtggcttaaatattggaaattgatttctcacagttctggaggctggcaagtgtaagatcaaggtgccagttaattcagttcctgatgagggtcatctttgcagtttttctggttaggttctcaaatgtcttttccttggtgtaaacaggcagaaggaaagagagatcttgtgtctcttcctcttctaataaatgcattaatcctatcatgaggctcaacccttatgacctcatctaaacctaattatctcccaaaggctccccttcaaatccatcaaattgagaattaggacgtcaacatatgcattttgaggggacacaaacattcagtcatagcaatgtgtcttggtgtttatttctttggatttattctgtttgagatttgcttagtctcttgaaattgtgtatttatgtgctttgccagatttgaaaagttttcagtcattttttttttttttaggttatgtttttgcccctgctctctttctcctctccttcctgcactccactgacagaaaacttaggtagtttgacatagtccaacatgtctgaggggctttttatatttattttttagtctgtttgctttctgcttttcagattgggtattttgcatttttaaacctttgagttcatgtattaattctcctatcttctctattctgacgtttagcctatctattgttatttttaaaattacactcactgtatttttttccattctgaaatttccaaatggttcttctctatgtatatgattttacttgctgagactttttatttttcccatttgtttgtttccatttgtttcacaaatgtttgtagttgattgatggagcaattttatgatgacggtttaaaaatcttcatcagagaactccgacatctctgccatctcgatatatacacgcctcagtgtctattttctataaaaatcttcatcagagaactccgacacctctgccatctcgatatatacacacctcagtgtctattttctattgatttgtgcacaaccacaggacaatttttaaattcaggaaacgatcatcgatgcaatgcgaaaacttatttctaattcatattaaaagttccatcaattatctaataatgttctttacagcatatttttttttaaacaggacgctcttgagaacgaaagggggtactcgtggaaacagacataaacctgaaacatctgtgcaaacctggacatagcatcactcctgaatcacagcacccaagggagctgcgcttagttaggaggcaggagctcacccataggagcgggaggccgggagccgaggagaggggcctggagggctggtggcagggagacgaaggtgctctcttctgcctgctctcctttgctaagagacgtgaggagcaggccattcacctaggcaggggagaacaagtcaggaggagtgaggggcagggaggaggcagaaatggttgactctagaatggaagccggaattatccagggtgagagggaaggttgtcagcacacctgcctgctggctctggggtcacacctctggcttttcttcctgaaataattacgtagtttaaagcagaactagcattgtaaaataatctccactaatttggcttgtcaggctacacatcaaactacttacttgaattcatttagatttaaaacatttttttgtcctcagtgatccgagagccttgaatgggagacaaactgtgtacgggaatcacgcacaacccacaaagtctagattcatcagaatgcagtgaatccagtgggaagacagtattaagggggtaaggaggtgggggagcactgattaacactttaatcaggccaggcagactgaaaagacagcattggagatgagttcagagggagaggagaggagctgtgggcaggaggagtccacggggagagcactccaggctggaggaccagccatggcaaaacctccaggtaggaacgtggctgcggctgagcctacgagagactctagggaggtatgtgagggggagggaaggggcagaagaagtcagagaggccactgtgggcatttgctgagtgtggtggggaatctggcaccgcgaaggccagggtccggctcctgttttttgagaatcacactggttgctgggtaacaggaggctacatgaggtctcagccccacagggaggccagggcaggtcatcagtggtggctcaatccctgcggcagccatggagattgaagagaaatggtcaaatttaggatatctcagaaataaagctgagagaatgtgctgaagagttgggtggaggttcgtggtttggcctgaaccacaagaagggtgcagttcccatcaactgagatggggaaagccgggggccaggctgggccaggcaggaaaagcagaccttcatttgcaggcaggacattttgagggactgatgagacatccaggtggacctattaacctagtcactggggtagaggagaacgatcggagctgcagatacacctttgagagtcattagcataaagatgacgcttaaaatcaggatgagagggagattctcttgtccttactacttaaaatgtgcacgtccccactcccaaccccccagcagccccagcagccttactcatgtttgttaaaaacacagaatctctgtgtccatgagttctcatcatttagctcccacttataagtgagaacatgtggaatctgggttcctgttcctaagttagtttgctaagaataatgtcctccagcttcatccatcttcctgcaaaggacatgatctggctctttttttatggctgcatagtattccactatctagatgtaccacattttctttattcagtctatcattgaaacaacacacactgtggtctaccagaaggtagagggtgggaggagggaagaggatcaggaaaaatcactaatgggtaacaggcttaatacctgggtgacaaaataccctgtacaacaaaaccctggggtacaagtttacctacacaacaaacctgcacaagagccctgaacttaaaataaaacttaaaaaacatgcagaatctctggtcccaccccgaccttggactcagtcttcattttaataagctccccacaggatctgtagttatcttaggatgtgaggagccctgccctgggagattttatgtggacagcaaagtgaagaagtgagtgctggagccctcagatgttccaagatcagggagaagaacaggcgcttgtgtagcagacagtgaaggaatgcttcctggataaacccaaggcaggctgtgagagcgcagagccctggaagcaatgagccgaggtgtatgcggggacggagggaccagtgccagggatcctctcgcagaaggctcaggacagcaagacttccctttatggaacacatggctagatggagggccttttacagacagcgtgaggagaagaaaaactggagacagtgaggatgaagtatgagacgtatgtgggtgaggcgttggacacagccctgtgaggtcgggagaactttctttatttcctttttgttgttattgttgttgttgttattgagacagggtctggctctgtctcccaggctggagtgcagtgatgcaatcatggttggctgcagcctcaaaatccccggctcaggctatccttccaccttagcttcccaagtagctgggactacagggctgcaccgccacgcctggctaattttgtaactttttgtagagaaggggtcccgttatgttgctcaggctggcctagaactcctggcatcaggcgatcctcacaccttgaccttccaaagtgctgggagccacctaggcttgagccactatgctcagccaagggaagttccttttaaaacatcgtggtgttttttttttatcttacaatgacaaaagcaatgtgtttctaggctgaggcgattgattctgtagagagagaagaacagagtgaggtgcatttctgtatgattcatctttctgttactgccattttgggacccatgtagcatgcccacattccatgggaagcactttgctttactgagcctggaattccttgaagaactccatgtaaaacattcaacaaatatttgcagaaagaagctcaattaaaacagcattgctcttcaagtttgggtatctgaacaagagtgcctggtacagatggcgtttgttggttagaggaccacagcatttgtggagtacaggccaatagcatttagaggtagagctcacagccaggaacaccacacacgggacacttggcctggctgtgcttatgagggtctgcagccgcacgggagcatgtgacgtaggaccgattccatcgagctgtggaataggtaaatttggtctctggcttgcaatgtgatctaagcacacacccagtaatacatcatagggatggcaaagagagttagaaaaatcaacagtttttctgaatcaagttggcatgaagtttgtttaaaattggctacccatgctgggtgagaatttgctgtacttcattgttgctgtgggacagacccacccattcccagtggaacagaggtggtgtttctttgcctttagaagacgtttcttcttcatcctcactggccatgtttacaacaggagcactgtttcccgtggccgacgtgcattgtcggggagttcatgagaaagtcatcagcctcccatcctctcatgctgtcgggcggaatcaagtcataaatagagtcacttgtcaagcaggacatcaatctgtccaggtagcctccacttcctgtctcgggccatatgtgtctgttatttatgtcaagaaaatggcatttgcacaaccactctggctgtttacagaagtttggttcctctggttgagctgtgcgtgctgtgtgctcttagctcactgataagccatgaggttgtgcagtttaaaatgtgcttccacatccctgatagaataaacagggcagagcccacagcaccatctgcccagcccagccaaagcgaggagtgaggggaggggcaggggctccaacagtgttctctgggtccctgggaggttggtgcatttttgctgagagagtgctatggtaagtgatattccttctgaccatttaaattatatgaattttttgtaggcggggcatcaagaagccttaatgtctgaccctgtaaagttctccattcagaagcacctggcccagcgtgttcctttgcaggtttgcattctctgcgcatctgctgttggagtctgtatttggcaatgccaactgggaatcaggggagacttttatggtcagaggttgttcctcaaattcaaaatcagtgactcaaagagaacttggccttgacccggctgtgactattgccttctcaattaaactaacattcctgcttccccgtttatacaactgcaagcacacaaagtgggaaagacatacaggaggctaaatttgttgatctaagattgttgaataagattaggatatcaagagttattttccaattaatagagcatgacaaaaggcagggatttcatgtacttttatgttattaaatgcactcatcacatgcacacacttgcacacacccacatatacagccagcattatccttttcctggtaaccacccagctcttccatggtgatctcacatgaatgcttctatttcatttggtggctcagaaattactttgatctctttgaaaataaaataacttaattcttaagcatcagcactgttcttgatttctctacatagccaaggtttaggcaatttaactatgacattataaaatagaaaaaagtagccatctgattttttaaacggagattcaaacagcttatataattttagtttgtggtatttatcttggtttgacaatgcagtgtagcttcaatttaacatctactgcaagttggaccaaaattgaatatagatcagatcttgaacggattggaacaaatccgtggaacaaattggtctgattatatggtattgcatggtgcatgaattttaaattaaatagtttcttgccctattaaatgttgccaacagtattgttgtggtgagttattttcatttcttgtatattttcatatatacttttttcttttattaatcaatatttctttatttagatgggatcatagttcaggatctcatttctctctccctcctctctctctctgaagggtctatttacatcatgtaaattttgagagtaattctgtatttttccctttaagtgtgtttcatcacatcataccctgtaactctctttgggtttgttagaaggacaaattgtgtctttttactggagaaaatcaacgcggagactttcttttttgaggcccacattaatatttactgtttctgttttgcttctgcgatccagcttcagaccacttcctgtttgccatggtattcccaatgccggtatccattcaggaatttgagattctgagaaaaccagggagaggcctgtgttgctgacggggctgggaaggagactgtgggaggccactgtctcgggagtgtggttgagccctgctccccctgggtggccacccacggcctcagatgccccacgcttgtgcttctcgagccccttactgggcagtgttgtcttgtttccacagaggaaacacagtttggcaaaattatatacggttttgaagtctacccatggaaagtgaaaacagcatagctagagtcagcctcctttcaaaaacatgctttttactgtcattttgcctggttttcactcttttacttgtgcgcagtagtaagtgcttcagttcacaaaagtggccaaagccgccgtcacaacacctcagcgcggtggtgtgtcttttaacccacgtgtttgggtgggaatgcctgtgaggagcactgtttggggctgctctgtcagaccctggcacactctcagggccgccttgcacgaaccagccctgccccctcagggaggagcatcgggaaagctgaggcaagcgcagggtccagttgatcacagtgccgttgcccaccaggcactggctttgcctgtcatgaggctctggactcagcgtctcaggcatccacacatcagccaggaagggtggatggggcactcgaggctatgtggggcttgaagaccatgacagaggcgctggcccagagcgggcacagccagggtgcagcatcctgccctgccatcttcaccgtagcctctgggctcctcatggccagatgccaccttgttgatgagacctctgtctgctccctccagccccgaccttggcagaattggctgcgatcttggttttgctgggtaataacaataacgatggcaatgtgagactgctgtgcctggcacttctgaagtcccctcatatagttgtcatgtaattctccttcaaggtgctgttccactcacacttacaaccctgcagtccctcggtgaggtcacagagaaagccaccaggggcttccaaaagacggaaggacttttcgtttttgctttatccattcttgtgtcatgtcaggcatatgataggaacttaatgagtattcattacattagcatggcgatcaaatgaatgctatatgtggagagagtaggggtttcagtaagagcagattccagaatttctacacaggcatggcttagttcatgtgacccacacctcagtcaagaaaaggagcatttccatcacccagaaatgtctctcatgctctttccaatcaatccctagctcctgaggaccctgctgctctgatttctctcacaccacattagcctttctgttcttggacttcatataaatggactcatacggaattgctctgttgtgcccattctctttaggttaacatgtctgtgagatccatcaatgctgttgtgtgttcagcagccttttccttgttattgaataatgaatgtaccacagtgggtgtgttagtccattctcacactgctagtagacatacctgagactgggtaatttataaagaaagaggtctaattgactcacagttcagcatgactggggaggcctcagaaaacttacaatcacgacagaagaggaagcaaacatgtccttcttcatatggcagcaacaaggagaagcgcagagcagagggggtggggaaacctcttataaaaccataagatctcctgagaactcactcactatcatcagaacagcgtggaggtaactgcccccatgattcaattacctcccacctggtccctcccacgacatgtggggatgatgggaaatacaattcaagatgagatctgggtgaggacatagtcaaatcatatcagtagggttattctttctctaatgattccacaattggagtgcttccagcatagagccatttgtaaataaaggtctgggaacatttttatacaaggtttctgtgtacataaaaacctttttgtgttcatttctctggtaaattactaagagtggaattgctcattcttagagtaagtatatgcttgactttattttcaaaatgccaaaagattttcaaagtgaaatacatgagaatttcaacaatattgaaacttgaattgctccacatgttcaccaacatttggtattctaagtattcttcgttttagttattgctgggtcttagtggtttccccttgtggttttaatttgcactttcctattgacaaatgatgtggaacgccttttcctattctcattggctactcacatatttttctttttcacgtatatcttcaaatagtttgcctgtttttattaggttgcctgtgtttgcattatgaaattgtacagtttgaagccagctttggtagcctgcacctgtaatcatatctaccagagaagctgaagtgtgaggatcgcttgagcttaggaatgtgaggctgtagtgagctataattgcaccactgcactccagccggggcatcagagcaagaccccatctctgaaaaaaattggacagtttgtttagatgtttcagatacaggatctccatcagatgtagatattgtaaacatattttttctgctctgtggcttgcatttttattttcttaatggtgttttcaatagcataattttttaattttggtaaaggccaatttgttcatttcttttctttttacacaggaataaatatattacagaaatatacagaaaatatacagaaaatatattacacagaaatatattacttttaatattttgtttcatatttaagaaatctttaccaattccacatttgtaaagattttttcctatagtttcttctgaatgctgtatggatttagcaattatatagaactctatgatccatctcaaattaatttttgagtgtggtgtgaggtaagggatacattttttttccatatcaataggcagctgtttcaacaacatttgttgaaaagacctttcttcatccactgaattccctcaacaccattgttgaagtcaattttcaccacagatgtgtgagtctatttctaggctctttctatttcattgatctgttagtctgccatcactcctataccacactactttgatcactacagattcatagctaattctgaaaccagaaagtataaactctgcaattctgctctatttcccatttgtttggctattttaggtcctttacatttccatacatattttagaatctgcttataatttctgcataaaacctgttaagttttgcattctgtatataagttaaccttcatattgcaaatattacataatgttattctaatgtaacagaaaaactatatatagcatcaccttatgtatgagccagtccaagactagaattcagtatccttcataatttgtaacctcaagtttgttgttttagagaggtcattctactactttccaaacatgctagtattttctaatatctgtgtttcttcttcctgtcctttattatcatatctcaaatcaaagagtgtttcctctcaagggtggcatctaacctcagccgcattttgcacagcctcctgactgaaagtggtctgccttgcttgggctgacttttctgtgtgtgactggaacatctgtatggcacttggcagcttgatgcctcccactttgcctctctgggcatgcagctccctctgcaatgacattctaaatgacttgagtgaagccgccatgttttgcctttgtgggccaccgagcagcacttctcaaatctgtaaatgacatatcacaggtagaaatgttaaactgtacagagtaaattaaggaggctttagaagaatgtgtgtagagtttagtgaaaattttaccatttaaaaattgtataaaataaaaaataaacttattagatagtatattgcattttgggtttgtgtataacttccaatgaaagtattttctattattggtaataacaatttgttattagtatatttttaaccatcaaatatcttgcatgaaatgactatgcacaacttatttttatgccctggtgattttttttttttttggattgtggacagttattaagttgaaagttgatttgcacaaataagtacaaaattttgaacactgttctttaaagcaaccattgaaaaattcacaattgtattcaaagtgtctggcagctgttctttatccttcatggacgcatgtaaggggctttcttttgagatcacgtgaacagagtcagtattagatggaactcgcttacatgtaggtctccaattgcagagtctgcctgtggctctcagtccactaccaaaagggcacctgtgcactcctaacggaggagcatccaatgtggaccaactgcctggagcgatgctgcccacaggtcctcgtctttccacctgggtcagccacagctttcctggacccatgggcagaagccctgctggcccccagccatcttccgtgatcagcagtgtgctccttgcagaggcctcaagaggataagaccacctgggaggatgggtgcagagtcccagggggttcttctctccctcactcaccaccatcgtgggagcacagttaagccctgataggactagcttcccttgaagagatgcacaggaggttactctgggagagaagcacctgtcctgaggttggagccacaccagggctgcctggggaacctgcagctccttagtagctcatccatccacccaggagccctaccaagtaacgtgtggcccgcagactcatggcgcacgtgtcccctgggagctggctagaaaagtagacccggattggacttgccaattcacagtctgcattttaacagctgctttgggggttgggggatccatgccagagtctgaaaagcccagcccctggtaaatcaaggaaaagctctgtccaggagccccacgccaagtctccctgtaataagtagctgctgatgaatgaatgcacattttacaggttagtaagaagaagaggaggcttcattttgtatcatttggagagtgatgagtttcagacagtgagtcctgaaaatgccatggaattcaaggctgactgcagattgtacactggacacagcctcaagacatctagggtaagaaaacctgcaaactgcatagccaggcagcaagagtgactgcagatgtggggatactcatcacataaataaacaagtcaggggtgtggatctttatctgggtggaggcattgggcagggtggtaaagttggttttagatattctgagtttgagaaactcatggcacttccaagttgcaatgctgattgttccatgattcatgagatagcatgtgaccttggcaaatttcttaactcctcaggaattctcatcctcatctgtgcaatgtgaacattcacatcagaaggtatctacaactattaagtgagacaaagtacaggcatttttcaagcctggcacaaaacaagaacttgacaaatattacctacaataaaggtaaaaacatgaataataaaatacaatgatggggtaaacttcgtgtgtgtgtgtgtgtctgtgtgtgtgtctctctctgtgtgtgtttgtatgtgcgtgtgtttttgtgtgtgtctgtatgtgtttgtatgttgtgtgtatttctctgtgtgtctctgtgtgtgtgtgtctctgtgtgtgtgtctctgtgtgtgtgtttttatgtgtgtgtgtccgtgtgtatgtgtttgtgtgtgtgtctctctctctctgtgtctctgtgtgtgtgtgtgtgttctacacatggaatgagtgcattagtgcagaattgatggggtatattttccaaaggtaagggaagctaggcttttgacgctatgtgtttttttttatatttttaaagatttgtctatagagcacaaccttgccttcactcacggtacactgataactacagacatggtgatgaatagattccttatcttttatagatgtcactgaacacgtgacttctgtctcctgagcaccacgcagagctacagagatgaaagcagaatccattcaatccatagttacggccttggtctgagtcaatcgcctgccattttccagagaaagaatgaatgaagacaactttggatacaagaatactcgtgacagtgattttctcccatcaaccatgccagcactgaggggtattctccgtataatgtgaggatatgccctctcttttagacctgtttccccccaaaatatagaaatatcacagtaacattttacttgtcagaaatccaagccgctaacaaactcactaaattagttaattttcacattgctataaaaaacttccctgagactgggtaattttaaaggaaagaggtttaactgacttacagttccacatggctgggaagacttcaggaaacttataatcatggcggaaggggaagcaggcatcttcttaacaaggcatcaggagggagaagaacaaaggaggaacttctaaacacgcataaaaccatcagatcttgtgaaactcattcactatcatgagaacagcatgggggaaactgccccatgatccaatcccctcccagcctcgacacacaggggttacaatttgagatgagatttgggtggggatacagagccaaactgtatcactgccctataaagaagcctccccgaaacagaaagcgaatgtaagcattttcccacgtgcacttgagggagatctcagcacctgtggaccatcccctgtgcccggctacgcacatcttcttaggctgctgctcctgaagaacacttactccctgcagggtcttcagagcctactaaaccaccttctgacctgctgcagggtagagggtgtaggaaagaagaggtggtccttctgcgggtcgggaagccaccagggtctggtgtgtgcagtgtgaggcagccgagtgcgaggtcggaaggtctgctcaggcctcctcattcccagactcccactgtgatctgttctttcttcctggagtcagacgccacacacaccccaaggatcccagagcttctaccattgctgctgtctcgttggagctccaaacttgcagagccagctgtctttcagccacctcttctcagatgtcacaccaatatcacaaatttgaagcactcaaaccttcactctcagtatccacacattctcccacccctaacatgcgatttctctcccactccctatctggccatccaaagcataaacctctcccccagcacagcaaccactaggtcatggtgacctcatggggagtgtcccccaggttgtccattttcctccatccccaccctggtccggggcccacccatttaacttgggtccctgaacccgcgtctgagttccctctccctgtactgttttactgcttccaatcctttctccatgacagtcagggtgattgtgctcagtggcacatgtgatcctgctgcagctctctctgggtctccttttgttctttgcacagaatcccaaccctaaggggtcacccaaccctcttcatgcattgcctctggctcaccctgcaacctaatgtcctgtcccatatccccccagcccagtgtctgagcatgctcacttcatctggttccttggggttcagcctcccccacacctctgggtttgtctggacatctggacatcttgtcccacattccccatcccgggcctccccagcccagcatatgagcgtgctcatttcatcctattccctagagttcagcctcctccacagcttttggtttgtctggacgtctggacagcttgtcccgcatcccccactccccagcccagcatctgaacatgctgatttcatcttgtttctcggggtttagccttcccccacacctctgggttcgcctggcagcagcagcttttctcctccccacactttctctccactaagaggtacaacatcttttggttcccaagatggctgccccttctttcatgaagatttctgggatcgctgaaatatggaacagacgcaccatgacacaggctttctcggtagcagtgataagcccgctgcccttgttcttatggtacaatattgcagttgcttgttcggtggctttcttctcccttagactgcaggaaaggaaagagaaatgacagtaaccaggcatcctgctaaggacattgcacatactatgtcatttaatccttaaagccttttttaaaaagtaacattattaaccctactttgtggatgagaaactgagattaagaaagagtaagtgatttttccccaagtgatctggtgtgaaggagccaagagtcaagctcagacaatgcaagcgacgcccatcccggcttcactcagcagcaggaccaggccttcccttctcctgtgcttccagggtctccagagcttagaaagtgcacaacaaagtccatgctcaagtttcatggggtgcaagcaaaatgaacagactatgaccaaaaaaacagggagaatgtattactataggggacaaatgggtgccccatggaggaactgggtttagaagggcaggagccagggtggtggtcggttttcagggagctcaagaacagcagtgcagagtgccgcttcctggagggctgtcctcaaacactctccccggagtgcaagtccctgtgaagcgagtgcctggaggtctcactcaattcctgtgacactcccctgtggctgggcatattgaccaacagtgtccccaggactacgtggcctggatcagatgccacaatgacaacaccctcaggccttcagtggcagacagtacagacacggacctattcctgagtctgatgggtctgggtgagcacatctgggctgggtttgactaatctcagctcactggcgcatctgcggttgctgcacgtgtgtgtgttaggcggctctgccgattttggctgggcttgcccaccagctggctgacctagaaccacctgggtgggaccctgggtgacccccctcggggcctgtgccatcctccagtagatcatcccggggaacacgggcatggtggcagagcaccagcagggagaccatctcttctgcaaatggttgagggaactggatcatgcaaaagaatgaaattgcacccttataccagacacaaaaatccactccagatggattaaaggcttaatcataagaccccaaactgcaaaagtcctagaagaaaacatagcgaagcatcttccagacattggtcttggcagtgatttccttgatatgaccccaaagcacaggaaacaaaagcaaaaataggcaagtgacactaagcttgctcaaactaaaaaagctcctgcaagcaaagggcgcaatcaacagaatgaaaaggcagcgtgtaggatggggaaaatatttgcaagttataaatcggattgagttaatatcctaaatatattaggaactgctataactccacagcaaaataataataaaaataataacatgactaaaacatgggtaaattttcacttgtcatttttctataaatgcacttcactgtacgtacatacttcgagaatcagattcacgaaacaagtctactcgtttataaaacgagtgattaatttataagaagtacttaaatagtatccctttaaatatatatagagaactatgacaggcacattgctgttatgtaaactaagctagtttaagcaacttctgtgaaaatcgtgttcactgctaatatatttatagatttaatttttttacagctgaatagaaattttatcttactcccaaggccaatagctaacgttccccaatagaagcctcacaaggctctactttaccacaacatgggctctgcctgtccaagggaaagttaaacaaagaagattaaataagagttcagcatttttaaggtaaaattaaaatttacaggagcttctgctgggagaatgggctctcactgggtgctctgtgttatcactggggcaccaggttctaagcaggcatctgcagctgagcagtgggcttcaagtgggaggatgttttcatgtgtaccaacacagagctgcgaattgtcagaaatacaaaatatttgcatacatcgatgtgatatatgaaccctcaaaaaaaaaaagcaaaaccaacaaaacatagtgtgtgtgatctagcatcatagatatatttctgattctcaggacacacatagaagacaatctgtcctcttattttgtaagggccaacattggtcaactgtatcttggagagaccacaggtggccttggccagtgcatggccaaaaatgtaaacagcctgtgaacgggagtgctgaggagtgaagggaggaaggtggtttctgcactcccgggttccaacaggaaatgcaattctcaaagtctgcaagaccctagactagaaaaattcatttgagtattagaaataattttatttttattggttattttctttataaagaaataaagttttagaacttaactttagaaataaagttaagatagccacctgaaagaggttagattgggatttttcaaaaaaattttttttccaaaagtgttttgttgctgttaaaaataaaattaagaaaatgctgatttaaattgacacttaactatcagagcctactattttcttttctactatgcaactaaaataatcaagatggtgcacaagaagaaagagttaataaaggaaaaataacattaggaattagaatagatcccaattcaggccataagaggccctgagaagtgcattagaaaacgtgcatatcaatctacattcttggtttagatgtgaagtgtggcatctgcccccctctaggtggagaggaagaggtcaactgtgcaccaggccttctgtagtgcatagacaccaggctgcagcctacgcatccgtatttattttcaaaggaaaataaacccagttaagagataaacatgtgtaccctaaactcaactccattgcacagtggatatgcattattatcttgaaaatggagaggaagagcctacttttaagataattcatcaaagggagcagaaggacattttagaaagtgtcccttttccatatttttctatttcccttcagagtggcaaaaagttgctattgattttggggattttttttcttttatgacaaaattaactcaaataatttacgagaagatgtgccatttctgtctttagatacaaattgttgcatgttccagagtcttacaagttaagctgctggaatctgtggaatatgtaaggacggtgcatttagagcccatctggaggggcttgctcagtgttgtgcctggtcacagcgtatcgatccaggaacagtaaccgggatcaggggtgcacgaccatacggcccatctccacagaaagagcacacggagaagacaacttggtggctttggattcaccaccaagatctgtgtgtgtttcacatagaatcttgatgattgtggaatgaactactttggccaacatccccatatttggcaaaatgatttgctgaaactacatgtgaggaatgggttcaaaaaatgtcttggtagacattttttaatgtctcagccttatgaatttcgatggtttgaatgtgtttctccaaacttcatgttgaattgaatctccattatggtggaattaagaggtagggcctggccaggcgtggtggcttacgcctgtaatcccagcactttgggaggcagaggtgggtgggtcacctgaggttgggagtttgagatcagcctgaccaacatgcagaaaccccgtctctactaaaaatacaaaattagctgggcgtggtggcacattcctataatctcagctacttgggaagctgaggcaggagaattgcttgaaccggggaggcagaggttgtggtgagtaccgagattgtgccattgcacttcagcctgggtgacagagcaagactccatctcaaaaaaaagaggtagggcctttggggaactgattgagtcatgaaagtccatcatgtaacaagttggttgatagtgttgttgatggcatttttgtctctttgttctattagttacaagatgactactaaaatctacaaagttatagagatttgtttatttctcccttcagttctgtaagtcagggcttcttatattttgaatcagttatttgctgcttatgtgtttatggttgctttgtcttcctgataatttgtcctctttatcattgccaaatgtccctttaaatccctattaccatttagttttctacatctattttattacctatattgtcactgtagctttttgctcagtgtttgcatgatacatatgatacatatatttctacccttttactctgaaattatgtatttcttttttaaaggggatttctttcttcattctttcctttttgtgtgtgtgttttgagacagggtctcactcttttacccaggctgaagtaaagtagatttttttatagacaacatgtatttgagtattgctctttttttgcaatcttataatccctgtcatttaactaaagatttaggccacttatatttaacataattttctatatgcctacatttaaatacacaatcttgccatttattttctatttattctattctttgttaccattttctttcctgcttttttttcttctcttctacaactttctatcctctactttacaagtaagggtatatatttttctcattctcaatcctactacaatgaacttttctgcaatgtgaagttctctaggaaaacaaacaaaggggcactttgaaatactgtgtcttttacccacttacactaaaaaagaaattataaaagaggtgtgtttgaatgtgtttggcttcctgaagtagcaaggaacagcagacatgatgaacattattttatgatcttgtttattctatgtccatactattgtcaaggatacaatgctcctgaggtccttgctattgaatgaatgtctgtgtctccaaattttatacattgaagtattaatctccaatgtaatggtattagaatgtggggatttggaaggtgattagttttagataaggtctggagggtggaggccccaagatggaattagtacccttacaagaagaggaagaggctgggttcagtggctcacaactgaaatctcagcactttgtgaggtcaaggtgggagaatcacttgaggccaggggttctaaaccagcctgggcaacatagtgagaccctatctctaaaaaaaataaaaaagaaaaaaaaaaagaaaaagaggaagagaccagagcctcttcaccacatgaagatacagcaagaagatggccatctataagccagaaagtgaaccatcaccagacatcaaatctgtcagtgccttgattttggacttcccagcctccagaactatgctgttgaagctacccagtttatagtatttgattagagcaacttgaactaagacagaccttcccatgaaaacatagtcaataaatactgttaaaggttgtggaaccctaattcatcacagcaaaaagcacatggcaaggctttgaaccttgtctattgtctgtctccatctatctgtctgtttatctatgtatctatttacctatcattgatctacatttatttttgccctatttattttatgatttgtaaagtgcatgctctgaaaaatcagtttctctatgccttcattttctccagtcttagcaatgagaatcaatatagcacccaaatccgatgtgtgtctcagttgcactctacatgttatcaaggaagagaaagtaagtttctatattctcttctgacatgtcaataccagaatcacatattggagataaattagcattttctatttatttgatcattgtcattaattatgctaaatgattattgaataatgtaaatttatcgcctaggtcactacaagcacaaaatacttaaaatttctaatttatttgtatattttgcaggaatgtatgatagggtgaccaatttccacaaagtaaataatgagcatacatttcttttttttttttttcgagaaagagtctcactctgttgcccaggctggaatgcagtggtgtgttcttggctcactgcaacctctgtctccccggttcaagcagttcacctgcctcagcctcctgagtagctgggactgcgggtgctcaccaccacactggctaattttgttgtatttttagtagagatgggtttcatcatgtcagtcaggctggtctggaactcctgaccccaagtgatcctccctacttggccacccaaagtgctgggattacagacatgagccactgcacccagccagcatacatttctttagaagtgaaatagaaatatgaattcaagaattaaaagaaacaatgtaatatttatgagatttagacagcttgttcatatattttatcattgatgatattcattatatatttttatttcattaaacatatttaaaaatgtgtgacaatttattttctaatacatatttataatacaacagaaatgacttatttataattgtgtaaacatggcataagattagaaatctgtatctgtaatatgattctacagttctttcaatggataattaaaaaaacccatattattagaaacagaacttctgggtcataggttatatattttatggtcataatcattttattaacagtagctaaaccctggaaacaacccaaatgtctgtcaacaagcaatggacaaatgagttgatgtgttcatgcaatagaatatcactgagtaataaggatgaattaactattcttgcaataaactatatggataaatatcacattcataatgttgagtggaagaagttggattaaaaattacatataatatacatcaatttacacaaaattgtagagcaggcgaaattagtctaaagtgaaaacactcagaacaatttatttagaagaaaataaacagttaagtgaaaaattctgtttggaaatataaaaacccacatttggtaacttatgggttaaagaaatgatgatggaattttttaaaaagctaaaactaagtaatagaaataaaatgtatcaaaagtcatgaaatgcagcaaaacatacctgagaagaaatgtttagctttaaatgcttatatttaaaaaacagaatgactgaaatttctgaagtatgaattctccatcttaaaggtagaacaagatcaataaacacctcacaaataggaagacggtaatttacattttaaagaaattttttttacaaatttatagcctacatctgcaattttgtcacatacatagattgtgtaacggtcaaatcggggctcatagaatacctagtacccaaacaatgtatgttgtacccattaatcaattcttcttcatcctcccttctcccacaccgtccttctcctaaatctccattatttatccttccactgtctatgtcaacgtgaagacatttttcagcccccaattatgagtgaaaacatgcattatttgtctttctgtgcctggcttgttcctcttaagataatggcctccagtttcttctgttttgcggcaaaagacacgatttcattcttttttatgactgagtagtattccaggtacggttgtttttcactttactgtgtattgtgcggttctccaaagtgctgtacttatgtcccttcctactagcattgattgaagctccactcttccgcaaatttgtgaagaaaatgtaattcattgtcattttagtttacattactgtacattacattacattgttaattacttctcattggctagcaagattgaacatctgtgtatgtttgtatgcataagattttctcatctgtcaattgcttacatgtgtccattatatatttgaaaggcttttcatattctctggatacaattctctgttttggtaaaaaaaatatattttttagtatattacttgtattttaatgttgattatactatgttttattatatgagttataaatgataatgtagccatatttatcaaatatttcctttattattcatacaaattttgtcttgtgaaataaattattctccatcccaaggtttgggatgctaggttttgtttgcataaattttattcaggattatatacatatatgagtatataaatattatatatacatatatgtacaaatacacatacatttcatacatattatatatcaatgaagacatgtaatgtactatgcatataaaatattgacaaatattacaataattatataattggtcatttaactcaaataactaaaaaactgacaaattattcccaactctttgtgttgctgttgtcttacatataaaacggagattatttatcttaatgtgttttgtcagtgctttaaacacttataaaagtgaagtgcttagatcagtgcctggtatcttaaaacgcttaataaaaactcggtatcattttgtcatcattattatgttttacacgtttgttttctggcctcggtacaaggctaggctaacgtaataaaatggcatgaacttcattttgtatgattttaaaaaatatctactctatcttacaatctatttcataatacaagtattatgtgaacatgattttttttccttacaaccatttaggttgtttgtacattttatgagtctttaactaaaatgctttttatacatgctctctctcttttatatttaatttatattgattttttaatgctattttaaaatttgtttttcctctatttttccaaatttttaatttgattaataatgttcattccctatccctttgtagattttgaatataaagtagtaacctttcccctaaatattatgttggtgtaccctacaagagctttggttttattctgtttgaaatatcttctaatttcccatagaattttatctttgagtaataaattacttgggtcttagtttttaatttccaaatgctttagtattggtgactattttgtgttactttctcctggtatttttttgttaaaagaaaataatataaacttttttggcttttaaaaacttttctgaatcccactgcatgttaaatttttaaaagttgtatatgcctaaaaagggaactgagagttttgaaatccttgagtataggttcctagggtatttatttgatcaactttgataatttgtgttattcaaattttttattgtaactaattttacttgcttgctttattcattttcagaatattttgttaaaagcacttattacaatgacagatttgcccactttttttgcttatttgtcattgtttatggactctatgttattgtgtacatgaaggatatagtttctttgtttccacaggtgtttctgtttgctaaaaagtctattacatttgttattgacagtttaaccgtcttgttttactagattttttaaatctcttattttcactatttttgcttctttctgtgtttcgagttattcttttaaaatggatgtagatagatttttacttgcttctttctgataatctacaactttgaaaaagatagtttattatttctatctttattttaattgataacatattcggggttatttctgtcactgtatgttaagtttttcatttaccatgtattctcatttctttttttcttagtccacattttttttaaattgcattaaattaggcttatctactcatttcccccttattatcaatttgatacttttatgtcctatctatataaaaacatcaaaatgtttactgatatggtttggaggtttgtcccctccaaatcttgtgttgacctatgttgtccagtgttggatgtggggcctagtaggacatgactggatcatgggggcggatccctcatgaatggttcagcaccatcccctgggtactgtcctggtgatagtgagtgagttctcatgagacctggtcatttaaaagtgtgtgccgcctccctcatccctcttgctccctttcttgccgtaagaggcgttggctcccactttgccttctgccgtgattggaagcttcctgaggcctctccagaggctgaggctgtaccatgcttcttgtacagcttgaagaactgtgagccaattgagtctcttttctttaaaaattgcccagtctcagttattcccttatagaaatgcaaatggactaatacatttgtttattgtataaaaccaatcaatagctttatgtgaagattttaactttttttcaccgataaaattttaatgtttaaccaacattaaaattttattggtgtaaaaatgtttaactctcaaccacttgttcatattcattgacattttgttcagtctattatttttcatattatttttcacctcacacatgactatttttagtaaccatgttttttcaagtttatctgtgtttaccaatattttgcctaacatttttcctatcatactctttatttccgtatttgtatttttaaaattgaagcacaacctttactattctcctggttctgatgggataatgtaaatattctgtcttgattaaataaaaaaacctcttgtgttttatgtttgaatgactattcttaccaactaaaaagaaaaggtcaaaacataattattttatataaaacaacaaaaattgtcttaacagagagcttttaatagacctaggcctggaaagagaatcatttaaaatagaaacaatattcatagaaacaccagatctgtacatttttgcttacgagatttggcaaaacctcaagtaagagatgagaatgatactgtagttggacatgcattttaggtttaaaattattcctacagtatatatcacactacacaatgctttccagattttatagttgctgaaaaactagttattgtcattttgaaagtcttatgtcttttatttgtttgtgttaaagctttcctcttggtgtcttctgtttttgaggtgtagactttttaaaaattgtttttctaagtgtttatgtgctttcaaattggagatttatgtattcctttaattctagcattttttaaatgtagactctcttaaaaaaatcttctttctcatttaaaaatatttactacttctactttttgtcttttttattatagtcttcaatctctcaatctttatttcctatactctatttatttctttttctgggctaccttgtgagtaattttcttccctgtctttcagtttagtaattcttacttatctatatctaattgcctatttaattctttgataacaattttaaaattcaccagcagtttttgtggatgctctaggcatttttcttgttgactttctgaagggtcagagagagataagaggtgcttcttaggagactgttttgagaaagccaagctttaccagagcccttcatcacagcaatgcagcaatgcacctactcattcctctcacaaccaaggacatttgtgtgagagttttgatgggaaatctttaggcatcctccttatgcttctgaattggctccttccaacttcttttcgtttcctaattttaaaatgtctgtaaagggaatccatttttcttcagttaataataataataaaagactgcattgccagggttaaattcccaggaccctcagtcctttagggatggacaaaatgggggcatcatcacttacaaaaatgtcttgaatttgatggtgattatgttgagaaataaagttcatattttttatttttatcttttatttttatttgtatgaacttttaaaagtcccctatattatagtatatctatattctagctgttatctatttatcaatcacctacctatctattatctatcaaccaatctatctgttctgtgtatgtatgtatgtatctatctatctgcctatctatcatatatctattatctatctatctacctatctatgtaatatgtaatttatcaatctattggtctatctatcatctgtctatatctatttatctatcttcctatctgtttatctatcagtctttatctatctgtattctatctacctgtctatctatctacctgtctatatctttctgtctatctatctatttatctacctacctatcatctgtcatcgacctatctatgcctatctctctctgtctgcttgtctatttatctgtccctttgtctatctggttatatctcacttatgctccacctgtggaacaagcagagttgactgtagttaggactgctccgtttccagaagtccctagtctattgtttgtgccttcactctttgcaaaataaccttaaattttcaaaatccaggctcttaagaatccattcttgactttcaggacattttctgcaatgtggctcaaaaaacttgaaatccaaaggaagggaatggtcttggttattccgagtctgctgtggcattcctccttgtgacatggacacagcgggcagcaccaggacagggcaggcagcggcacagcacgacccgcaggggtgtggagccccagaggctacttcgattcctagcctgctctgtgtgctttgcttatctatcttttgttgccatcgaatcagcaataactcacatatttagcatcactgatttaaagccatacttcaagaggaacaaactgacaatacccaccaattaccttgtaattatttagtctaatttatgctaaaactcttaaaatatatggaagtattgaaataaaataacaattagctttagatgcaaagtatgacgttttagggctgttcaaacagtgttaatatgtcaaatccacctcatgtaagcagtgaccaccatttaaataaaaaaattctactttaagaatgaagtgtgaacccagatataatttattattttaatgatacctaagggatattattaagctactaccacttgtccatattttattagccatgcactatcaatacccaatttttaagtgtacagggcccttttctgtattacaatattttatgaattacatatgatagtgctgtaattcagatcaatttgagtagcgggtgacctcctgacactttcttaaatacgtggactccagatctgaaatgtggaagggagtacattaaatcgtaattaaaccagtgatatgtttgccatagaaaacttatttgtggatgacggagattgaaatgataatggttacatgaacaccacagatataccctctgttaaaataagaaatatatgagtataatagatttaataatatatatacagacttttaaataaaggtgatcagactccaggttgttccttggcctttcccactcaattgcctgtccagacaactctaaaaattgctctaagtctctctctaagagatgactgaataaaaccaaaagtttctattggcaacaactaaagatatgtgagccttatttaagaaataaatttttattgaaagataaatgacctgcaatgttctttgtattaatttgaaaataaatggaagcttcaagaggaatacaattgatttttttctgttccattttattggcggcaacttttctaaactcaaaattggtagacatttaaaaatctgtttcatgcttttaaaatacggttttattttaaaaaactaaaaattcttaagaaattaaactcaaaactcaccggcacttgtaattgcttaacgctggggtcatggccattaggggcagccctgtgaagggccagacatgaattctgcatgcaaatcatactattggggaaggaaaacgcgtgatcgatattcaatccaaacaagggacaagaaagtcaccaagcagtcttgctggggccagcatgtgaactacactggaactgcagtgagggtaaaaaagaggaaggggatgcttacaggttcaggaaactgcggggaaaagcgagaactagaaccaggagaagcccgggggctcagctcgtccacagcatgattcatgcaaaggacacaggaaggtggggagggttggggtggggaccatcactaaggctgaggcctgtgtctcaagaggaaagggaaggtctctgagccatggggttggtgaccagggttccactggaggaatttgaatgccgtgttgtgaagaggcaagagggatctcacatgagcgcccaccatttgttaaatatgtgctctgcataatgcctgattcccccagaaaccctgagcaataagtcttactttcttcatctccaaggtggtgaaacggtgaagcaaagcagccttaatccaggcaagaccaaaactcaaaggtgtctggcttaaacctcggggctgtctcgccaccccatgcgcctccccagagactgggcatgatttggttctgttggttaccgtgaaggtggaagaacctaagagagacagggcagggaaagcgggtaggttaggaccctagcagggagggacgggagatagagcgggatcctatggtcgcgcagttcctcctggcaatgtacccggagatgggaaacagctgtcaggtcccagagccatgcccctgtgggtgagaggcttagaagtcccagaaggcaagtgccagctgtggcttccacacgtgctagtgacacgtgcgcctccgtttcctcttctagcacataggcatcaccacgtttccctcacagcttcgcacgtgagatcacaatcgacaatgcagtgaagcgcccgcaatggactgcagatattaagcagtgaagacagtgagttactcagctgatttgttccgtggagagtcaggctacctggtcatcctactcaatatccaggcctgcccgaacctcaagactgggtgggcaccgttcagaggcccccagcccctgcccttctcctgcgagggccgagctcaccgtcaggtccctggggcttggaactaagtagccacttcataaacacatggattttggggtgccccggcccccataaagagatcaaattatgtctcctgcattctgctgtaatgaaatgaatcataaaatatgttttagaagaaaattactataaaaagtttcaaaattgttatttaaaaaggtaagttatagacacctgtaagataatttctggtagaaaagttgattgcctgctgaccctgagtatggggaacagccaatattcagcactcctcactccttattcagcctccagcaactttgtgtggtgctattactgtttgcatggacagttggcaggctcaggaaagtgaaatacctgcccgggtcatgggggcagtacctgggtggaagcttttctattaattgaaacacttaacacctttttgttagcgaaatgagacgtacataggtaaagccatattaattgacagagttggtagattagaagtctgctcagtgaagtcctgaattatccaaaaccatgtcaaacacatagcctagttttgtctgattaacacaaattccttcttcataaagagtcaccaatagatctcattttgccaattatctaaagactgtggttctttgaataagccaactctcaattccagagtgtttgttttataggagtcttcagttttcattccaagtcacaaagaaccacttgttcttcacatgaaaataaatatgtagagagagagagagcaagaaagagagagagagaaggaataattatgtacaaaggataaatcagctaaacaaaagtgatttggaacttaaaaagcaaaaaggggaagagagaatggaggcatttctgtgcacaggaggaaggaaagaagtagtttaaggaaaggtgtgatgtttttcagctatcttctgtctaaaattaaaaactacaagactgtgcctatttttacctttatttttctcttgaaatgtttaaactttcaccatgggtgaatcacaaacccctcaaccgaggcctagtgtcctgatggtgaagcctcctgggtaaccaacaaaatgcttttccaaagcaggtgctaccggaggactcttctgtcgggacagccctggcctgggtctgccctgcttgctcagcaccttaggggttaagaataagcctcatctatgtcttgctttgtggacctgctttaggcacgtggaactggtttgattcttagctggaggaagcaaaacacagaaaataagtcagggacagatgtccttagagccagtgacaatttaggttcccagtcaggagtgggaacttctacaaagcacaaaggtttctagggcaagaagccacccaacagttgaaccaaatcagcccctggctgacacagcactccaccaggaggcggtcccgacccaggctgagttccaacactttccccttgtgagggccagaaggaccttcctgctttcctccctaacctgcaggagacttgtaaggcgtccccattcacagcttctgttggaatctgcaggcctgcaacttccattacagactccgggtaatgttgatggggtttcccgagtaatcctgtgagatttgtttaataactatgctgtttcaaaacagagaagggatgggtgttctgatttaattagaaactcctataatcagtgcctttccctccaaccgcagagtgtgtgatgctcctccaccggtggctaggaagactttcttacatttgctggcaagccactgtgtccgacacattggggggtgtcagcttttaattgtaactgtcttgcagagcggtgttgttttaatatcctgtatagatttttatgtaatacacttacttgcaggcagcccgaagcaagaatcaattctgtgaagggctcttcttttgttaaaagccagtcttgttttaatgatgcatgaagaaatattcgagcattgacatttttctgtcaggtttcttttgaaaaatcaattaagataatactgctttgacctagttatctagttaatgcttattaggaatgtaatatgatttactgtcagcataataatttttgtatcttatcccattagcttgtgcatatttcaaagtgtattacacaatggtcacttcttaaaatgtaatgtagcagaatgcattaattagattgactaggatcattagacagaaactgtctcattggctccttgtatcaaatttgtatacaatctttaccaagataatgcattatttacatgcctagaaacctgcttcttgaccagagagtggacttagccactttctgcatgcccaactattcttttaccaattacaaattacttgattcttttgcttaaaactgattaatttgggatttgtcattatgcctgaaatgtaagcaaaataagtctccaacaaattaagaattgtcctcccagattcagtccttagcaactttccatgctgcgaacattcagatagtataaggtgtgctgggaaatcacataaatatgcaaaattgagcattatttcaaaagggtcctcgcctttctttgttgcctttgtgttaacaactgtcgatggcactgtcaagaagggagcaatggccaagacccttccagggaaattattgatttctgcccgttcgggattctgaagtaaccagcggcactgcaagcttaaccttgttaacgtggaacccaagtgaaatctctcaccgcttccagcgtgaggcgggaccagcagtgcaagttcggctctctcagttaggactcacccttgtcctgggcatctgccggaatgtgacaggcggccaagccacgtgctgtgcctctgagacgatgccggtgaactaaggagtgacacacctttgcaagtcagggctttcggcagcctcccccagctgatcatcatgtatttctgtttctctgataggaccccgccaacacgcatattgacccaaggaatcttcgggatggactctgcttctgatcacatcttcacctgctcgaggatcacctgtggcacgtcgggctctgaatgcaagccccaggacaccccatttcatgcgtctgcattcttaacctcactgcgcattaacatgcatctcaatgcatccaaaataccgcacccccatcacatcagagagcattaaaaataagccagctcaatgcacaaaaatgagggcgacaatcggaaacacaatgatgtttctaaagaatgtccaaccttaactgcagcttttcagtttccaaattctctcttctttatctcgtcatttccctgaatcactggggcccaacaacaccattctcagtcagatgtctgcctgagacacatcatttcaaattcaccggtaaaatgtttgcagttaccagaagtgaccttgttttacacaccaacgtgatgaatttatgtgggtggcttagtggagctgttcatttccagcttggtaatattttaattaattaaaagggaaaaatcaatgaacaaagattctgtttcctatgatattttatattttctacttttattcaaaattaagggttttaacatttttttcggttagtcacaatttttgtctccctccctctccctggttctctctctttctctctattcccccaccctgccccacctctgattctctctctccatcttaaaatgtatatctccaggggcatttagggtgcaaaaggttgccaattgttcttagtgcagagagcatctgaatcctgtagtgtgttgatttgaataaagcaaggaacgctcttcctaccgtgatggcctcttgcagggctgaacgggaaagggacgcggcacagtctggcagtgcgtgggagcaaacgaaacctgcacaaagggaggcggaagaaaacagggagggatctgaacacacactcaatagggatccattgtggaggaagccaagctaagggagaggtgctgcgatgctctcaggcgtgtgcacatttgcatacgggctcgcagaccctgacgcggcgtcgggcttgtcacttttaagcacccaattaattgacttgacggtgcggtgagcttcctcctttcagagagatactactgcggactgcggttttaattatatgaaatattaaccgcggattgaaattggaaacctgaagttattgtttaatgatcattgatcagatgcatagtccaaataaagaaaatgagggtggtggacgtgggcatttggatttgggttttacgttattatctcgttcctaactaggcacttttcctgcgtatctgaactcttttgccttttaactgtgcctgcagttgctatagtgatggcataattttgtaatggtctaaaaatgacactggcatagatactgacagataggaattaattcactaacaagtaattatgtagcgaaatgttgactgccatgcagaacgtgcacagtgacacattttctgtttttcagggatggcagtaacattagcgttggtcattagcggtagacatctcagtacagtgttggatacagacttatatgcagacctatttagttacctgtgtgacaggcttgttcaggacaccagaaacagctgtcccagcctgtatgagccaaaataattaggcctgtcatcttctcgctctgatttccccttcaacctgctccacaaaatgcaaatatttggctttcattgtcacattcaccttgacatggatattgctttggtgcataactggatgagatgactcagaatttgcattgttcattctaataaatttgcttcccctccattgcatggcaggacccatcagataaagtctcccggagtgtcatcaatcaccagccttgacagacggcttttgccttcatttgttacatacgagaacatgcttaattatttgtcctgtaattagttgggaaaatgtcaggaaatgtcaactctctgttcgctgtggaaggactcggcttgaaagccgggatgactgaagtgtcattaatgccacctaactagacgaggatcagctggggagaagggagagcttctaaaaaagtaatcacggtgagttaggggaaacggaaaatcagcccccataacaagatgtgagtcctattagcaaacagttgtgttttttatctgctagtcttcacaataaaatgtgggagagcaaactgaagaacaaatatgttggattgatataatttctgtcacattctccttgtcatctcataagccaatcatgcttaatgtattactatagggggcacctaatatttaatttgcagatttaaagctcatcttaccattcgatcgcacagtgcaaaattcagtgaatatgcaaaggtgaacagttttgcattcatctaatgatgtgatgaattgaatatgtaaaattaaaattgtcattctgctgttagaaccctttactaataaaagcaaattgctgttaatcattacttggcaaaagaagacaaaaacaaaaaaatatgtatatgtaaaaagatgc

SEQ ID NO: 570 - DNA, 20001 bp, Homo sapiens
ctgggactacaggcacatgccaccacgtccggctaattttttgtattttagtagagatggggtttcaccatgttgcccaggctggtctcgaactcctgtgctcgtgatctgcctcggcctcccaaagtgccaggattacaggcatgagccacctcgcccggccttaaaggtaactttttattggaaagtttgcattacgttgactacttctaatgaataaatgaattttaaaaatacaactctagttaggtgagtgttagggtattgatattataaatatgataagcaatatagaatgttagtgcaattttggaagtgggttctatgacaattagttcacatatattaaaattttatttgaagtattaagagaatcacaaaggtctgcagataatggaataaagaactggagtttgggggtggtcaggaatatttaggattggggaaaaaggaagaatttattgggagtggcatctgaactgtgttttgactttagatatgtgtaatggaaaatcgaaaccaaccatggggcataaggaggaacattacataggtcagatttaaagaatgtctctgagggaaaatagtggaaagctctaaaggaaggtaggttagattcagaattgtttacttatatgacacagtaatgaattttaacttcattccctacactatgatataaaactacaaatagattagcctgcacaccacctaccctcccatttatgaatggttatactttaatataaagtctttatttctagcagagatataatgaaagacattcaaacttgaaatctgtgtattagaaaatgtgtctgttatgttcttcaatatttgtatcagataacgaactacattacattttttttgaatttagtgaaatgaaaaatgtctctggaagatcatttataaattatttttcttaaaataaagacaagcatttggcttttcagccatggctgaattcctcttccatctgattctttaaaaaaaaggtttttaataaaaaaggatttttttccattttattgatttcagagagttgttccccaaagcaattattgtgtatgtaaattttttcagatagttgttttctctcaccctatacactgtgcttttaatttttgcatttttcctcctaatgcatgtatataatatataccaaattcatagacttaggaatgaagaagtatgatataacacataaaattccacagaaataattctggctttgtggtttttataattctaaattttgtcttgaggtaaaagatgtagaagaatcatggttattttagttgatttctgctcatgtctggatacaaatagaaaaaaaaatgtactagggaagaggttagaaccattactattggtggatcaattagatgtaccttacaatacaacctagataggtggggatctgagagcagactgtgagttgctcaaaattagaattgaaaaagcaaattcactcataccaccatgtaaaaaattggtgacaatttatttattttttatattgagctgacatgcaataattgtacataattgtgggttacagagtgatattttgaaacaaatatacaatatgtaatgatcaaatcagggtaattagcatatctgtcaacccaagtacttatcatttcttcatgttgttaacattcaaattcttctcttctagcttttggaaaatatacactaaatgattgttaacaatgtttaccttacactgctacaaaacactggaagttttttcttccatctagctgtaactttgtgttcattaaccaaattcgttttataatcccctcccactaacttgcccaacttctaatgaccacaattctattctctatttctatgagctctttaaacaaaaaaaaaaaaaaacaacaacaacaacaacaacaacaacaaaaaactcccatatccaagtgaaaacatgcagtgtattagtccttttaactggggtgtgatgatttctcattgtggtttttattgcatttctctgatgattagtgatgttgagcattttttaatttacttcttggtcatttatataccttttatttttttgaaacgaggtcttgctctgtcccctaggctggagtgcagtggtgcgatctcggctcactgcaagccccgcctcccgggttcacactattctccctcctcagcctcccgagtagctgggactgcaggcacccaccaccacgcctggctactttttgtatttttagtagagacgggctttcaccgtgttagccagtatggtctcgatctcctgacctcgtgatctgcccgccttggcctcccaaagtgctgggattacaggcgtgagccaccgcgcccagcctatatgccttcttttgataaatgtttattagatccttagccaattaaaaaaatctatttttttctctctctttttggctgctaagttgtttgacttacatgtatattctggatattagtcccttgtcaatgaatagattgcttgtattttctcccattttacaggttgtctcttcactctgttgttttctttgctgttcagagctttttagtttgatgtggtctcatttatctattttaagttttgttgcctgagcttttgaagtcttacccacaaaatctttgctcagaccaattttctgaagcatttcctctttgttttctgatagcagataatttcaggtcttatgcttaactctttaatccattttgagttgatttttgtgtcaagatggagatctataatagtttcactcttcagcataggaatatttagtttctgtatcaccatttattgaaaacaatgttccttccccaaatcatgttcttggtacctttgtcaaaaatcagttggttaaaaagcatagatttatttctgggtgctccttacgttttattggcccgtgtgtttgtttttctacaaaaaccatgcttctttggtaaaaataaatttgtagcatattttgaagtcaagtagtatgatgcctccatctttcttctttttgctcagtattgctttgactattcagaatcttttatattctcataggaatttagtattgtttatttctgtggaaaaaaatagatatttcataggtctttcatgtaatctgtagctgctttggatagtgtgttcaatttatcaatattaattcttccagtgcatgagtatgggatgtttttccattttttgtgtgtattcgcttcagttccttttcatcagtgttttgtagtttctgttgtagagatctttcatctccttggttaaatttatttccagtattttattttgttttgtagatatgtaaatgtgattgctttcttgatgattttcattatcggtttacaaaaatgcaaataaattttgtgtgtgattctgtttcaggcaaatttactgaatttgtttatcagttctaagagttttttggtggtctttaggttcttctatgtaaaagattatgatgtatgaagagggaaaatttgaattcttcttttctaatttggatgcttttttatttcttacttttgcctagttgctctggctggcacttccagtactattttgaataacagtggtaaaattgaacatctttgttttgttgcagctcttgaagaaaaggctttcagtttttccccattcagtatgatgttagcttaagttggttatatgtagcctttattatgttgaggtatattccttctataccaaatatattgagagtttttatcatgaagtggtattgaatttaatcaaatgattttttgcatctattgagatgatcatatgctttgtgtcctttattgtattgtgatgaattacatctgatatttatatgttaaaccattcttccattcttgaaataaatcctacttgatcatggtgtattatctttttgatgtgttattggacttagtttgttaatattttgttgaggattttgcagttatgttcttcagggatattaaccttcagtttttgttgttgttctgtctttgtctgatcttagcaatggcagcctcataaaatgagatatggataatttttttaaaatagtttcagaagaattggtgcaagttctactttaaaagttgggtttaatttagcagtaaacccctgtggtcctggcattttccttttggggaaactttttattatgaattcaatctagttactggttattgttctgttcatgttttctatttctttctgacttaatcgtgataggtttcacgtgtacagaaaataattttcccttgggtttttaattttttggcatatagttgttctcactagtgtctaatgatcctttgaatttctgaagtgtcaattgtaatgtcccttttttcacttctgattttatttatttgggtcttctctccttttttcttacttaggcaaaatagcggttggtctattttttttatatatttcaaaaaccaactttttgttacattgatttgttcacattatatgttagtctacattttgtttagttctgctctaatctttattgtttctttccttgtactaattttgagtttggtttattcttccttttctagcttcttaaggtgcattgttcatttatttgaattatttctgcttttttgatgtacattattattgctataaatttcccccttagcactgcttttgctgtatcccataagttttgaaatgttttgtttctactttcattgatttcaatcaatttttttattcttttttgatttcatcattgaaacactgaacatttagggacatattattgaaactttcatgtgtttatacagtttccagagttgttcttgttatattattaatttctagttttttaaaattgtggtttgagaatatacattttattaatttaagtttttaatgtaactgagatttcttttgtggtctaacatatggtctatgtgtgtttatgagaagaatgtgtgttctgcagctattggatgaaatgttctgtacttgttaggttaatttggcctgtagtgcagttgaaatccaatgtttcttcattgattttctgtaaacatgatctgtccaatgctgaaaacggggtgttgcagttccctactattttgtagtttggtctatctctctcgtttgctctaaaaatatttacttcatatatctggatgctccagtcttgggtgcataaattacagttgttatatcttcttcctgagtcatgccctttatcattgcataataaccttctttgtctctttattgtggtttttgccttaaagtctattttgtccaatataagtagagctcctactttatgctgctgttttctgtttgtgtggagtatctttttccactctttactgttgctctgtctgtcctgacatagagagaaataagtttcctgtaagcagcttatagttggttaggtgtttttcatccactgagctgatctatatattttaattgggaatgtcaatcatttaaatttttaattgttatttgtaggtgaagacttactttcatcattgtgttagttggtttctgattttcttttatatcctttattttttcttcctctcttattgtttagtgttgtaatttggtggtatttgtagtgataacatatgattccttcctgttttttatttgtgtatctgctctaagttttatactgtcatgtttacatagtgatagatattgtccttttgctttgagatgtaggattcccataagcactgttttgtaggtcatgataatggtgatgaattatttgttcttgttagtctgagaaaaactttatttcttctttatttctgaagttaatctttgctgtgtatagtatttttagttgacagaggggggttttttttcttttttccacaaatacattatgccattcttgcctggcctgcaaggattttgctgataaaggcagttagtccaatggagattcccttatatgtgatttgatactttgttctttgctgtctttagaattctttttgactttgaaagattgattataatgtgcctcacagaggaactttttgagttaaatccatttgtaagtctttcatccgtattagtcaaaagctgcattagcccctaacaagagagttagcttatcctttgaagtttgaagttaggtattcacttctcaagctatgaaagttctagatggcatcttcttccaataaaaggctgttttgtctacattgaaaatctgttgctagtgtaactactttcatcacttatcttagccagatagactttcaggataacttgttgtagcttctacatcagcatctgctactttaccttgaacttttatattatgaaatgtttttttccttgaattttatttaccaatctttgctagcttcaactttgtgtttgcagattcatcacctccctcagcattcggagaatccaagagaatctgttttagccttctacatgccttcctcactgagcttaattatttctaccttttgattttaaaatgagagatgttttaatttaaaaatgagagatgttctttgtttcacttgaacacttagaggccatcgcagggttattattcggcataattttaatttttttgtgtctcagcgaataggaagttttgaagagaggaagatataggggaattgctagtcagtggagcagtcagaatacacacactcttttttcaattaagttcaccaccttatatgagtatgattcatactgcccccaaacaataacaatagtaacatcaaagacactaatcatagattcccacaaaatatataataataatacagaagtttgaaataatgtgagaattactaaactgtggcactgggaaaccaagtgagcacatacagttggaaaagtggcaatgataaactcactcaatgtggggttgccataaacattcactttggaaaaaattaaataactccatggtgcaataaatgaagcacaataaaacaaggtatggctgtaccagctaactgtggtctatagtttagtaagttgggtgataaaatctttgagaagccatgcttttcattggaactacaacctactccagacagagaaagaagataataaacttctacaaaatacagatacagccaaccacttatgctgaagaggatgacatagaaaaaaaggcagatggggaattaaaagtttttgtttattttaatctttccttgttcatcagtaaatcaaatgtagaagatactggtagaatgtgcatatgtcaagaaatgaaataaaaacagttgagatagttgcagcatccccactgttcttgtagttagctcattggatctgatattgcatgatacaaatgaatgataaaatccttggtaataattctaatttaaattttctttacttacaattatattaaatagctaaaaaaattaccattataaggttaagaaagagagaccaggatatacatttaaaggttctatattttagtatatttaatgtactttttctgcttttctggctttttaaagagatctcaatttttagttagctttggtccctccaaattgtataatgaacttagtgtcacatgaatatgtatttcaaaagatgagaaaaatatttgtctttttgatctttaattttatgtgccaactggattgagtcaagtaacttcagagtaaacattatttccggatgtgtccataagggagtttcccagtgagattagcatttgaatcagtggactaaataaaggtagcctccctgttgttggtgggtattttttttttttttgagacggagtttagcttttgttgcccaggctggagtgcaatggcgcagtcttggctcactgcaacttccgcctcccaggttcaagcaattctcctgcctcagcctcccaagtagccatgattacaggcactcgccaccatgcctggctaatttttgtatttttaatagagacagggtttcaccatgttggccaggcttgtcttgacctcctgacctcaagtgatcctcccgcctcgacctcccaaagtgctgggattacaggcatgagccaccatgcccagtcagtggttatttttaaggatctgaatataacaaaagacagaggaaggaaaactttgcacttttctcctgcgtaattgcttgaactgagttatctcacctaagatttacatcatttgttcctttgtttctcaggcctttgagcttatactgaattataccaccagctttcctaggtcttgaagcttacagacagcagatcttgggacttctcaggcaccataatcaatcatgtgagtcaattcttcataatacagttgacctttgagccattcaggagttaggagcagtgacccccagcacagtaaaaaatctgcataataattttgactcccccaaaacttaactactaatatcctactgattaccaggagccttactgataacataaacaaccagctcatattttgcatgttatatatctattatataccatattcttacaatgaagtgagctagagaaaaggaaatgttattaaaaagtatgaaaaagagaaaacatatttactatttattaagtggaagtggatcatcacaaaggccttcatcctcatatttttcacattgagtaggccgaggacgaggataaagaggaaggatttctcttgctgtactaggggtggcagaggtagaaaaaaaattgcatataggtggacccatgctgttaaactcgtgttattcaagggccaactgtacatcaataatgtatatgtataggtattatatataatgttatatatgataaactatttgtgtgtgtgtgtgtgtgttctgtttttctaatggacagtgacaatacagatttttggtttggtttctctggaaaaccctgactaatatagtccaaatatgaaatatatatttctaattaacaaaaactttatttcagcaaacagagaaaccatatttcagcaaaaccaagggaattgattttcctatgaaattataatataatggcttaggatagaacttttgtaagaattacctagaaaacacagaggtaataaaattgcagtggtatatttacctgtacttttaaaaattgccattctttcaagcagcaatccccactttacattatatttcattaatctctttctaaaaagaacttgaaatacatcaattgctttagcagaatgttatacatggaatctagaggattatttgaatattattcatataaatttgttcatatatttatgtttttgtcaacaattggtaataaaatgaataagcaatcttatattagtatcccagttgtaacaatcaaatcaaagtaatagatgtggttcatatcacttcaattaagatagtaacatagagtattgttcgcatactaagacttcattgccaaggtaaggaaataagataccttgatattgtttttgaattttacccaacacatatacaattttctcatgtcctagataaagaaaaatcaaagtaagagacctattcgagatttacagaggaagacaatcttttcttctcaccttggtaccaaatagacagtaaaagtctgcataaagatgtttccattaagtctattgaaatcaattttgttttaaagtttaatgtgttttcttatgtgataaggttgttgaccagtgataagattttctggcagagtaaagttttaagaaaaacagttattgactttcaaagacttttcctggctgtcttctattgtatgagtatcttcatatagaatctcaaagataagaagaaaagaagcaattattgaagatatagtagatttttttaactagctaacaagctgtgcaagtagtggaatatcttgaaactaacaatgagaagaggaagtcattatctcagatagctaatcaaagtgaccacacttctaaactgaccacgcttaattagttatggaaagcatatttttcaacccgctatgttaacttttacagaaaaaatatcattcagttaggaccctgtggcacataagaatattttttacaacagttaaacaaagcatctagtaaaagtaaaattgcataaattttgtaggttttattactgagggatagcaggataatgcagttataatgtgaatttgttacaagagggcaaatgtaaaattgttgaatatatacagaaataaacgatttaattatcatcttcactttttgttttaatttgtatttcatatgtcttttctaacagagataaatgatccaatgattcggaacttgaaaagtggtagctttatgaattctccttaagaagaaacctgtgccctgatcttgcctactcacccaaaggcactgtgaggtaaagaacaggagtgtggatggaaaataaatggaaagtgaaaagtatggaaattataaaacctcaaacacatttaggaaaaatactaagtaaagggatatgggtatttggtctagggacacagacatgtaatttatttcaatattaaaaaattcactttcccatgcatgatgtatagtgaccaccatatgagttttttaaaatgtgcaggatttttttttcttggcttgatatacagaagaaaagaaaacaaaaattatgataacctcctgatgctaattgactgttaatgataagcttgtatatcaggaaattcattccactctttttgtgcttagaaacacaggaaaaccacattcccaacacttctttgaagtcagtttgcaggccatgcaaccaagttctggacaatggaatataaagaaaagtgaagcaagtcacttccagttgggcctttagaaaattctgtgtgctacctccgttccctttcccccttcaaagcttccttggaagcactgagttagatggtaaagttacaagaaggaagaagtcacagaatcatcatttaatggagaaagctgtggaaagctgtgaagtgatcaacaaataaaacattaatgagcaaagacacagggatttagcagtttattgccacaggatagtttagaatattctgatcatgaaataactttatataggagtgaggtgctacatcattaaaaatctaacttacattgcaaaacattattttcatgtctcatataggaaggcagcaattataaaagggactgcaagtcaagacatataagagactgacaaatataaagacaacctactgtaaattgggaggcagatgacatacttacaaaacagagaattaagaaaaatgatagtatgtatttgtagccattggtgaatttttaaatatatgagaagaaatattagagagactcaagaaattcaaggccttccaagagtaagagagaatatgtctgacataagattttatacaaaataggccagtaaaagaatcttggtctagtaaagtgaaccccagtgaaagatcaagttaatgatggccctcctatctttttttttttttttttttcagatagcatcaaaggaacagctagtaagagacacagagccagaaatcagggaagtaaaatacacttgacatctacgttcggaaagaaattttaggaggcagaagcaaatggatcagaagctgcttatatttttgcaagattaccaaagaaaccattggtggagaaagttctgtgaccaacttgtctgagtctagtaagattgaacgctcacacacaagtttcatgaagtgggtttgatacttacagataagcagcaaggaccaacagaagctgatgatctatggtgaactttttcccaaggctccggaaagctgcctaaagtagatggagtcttctctgtgtgtgccccactggtcctgcagttgaaggatccggtaaagcagcctgcccttggttttatactccagaggaacgtgattcgctggactaaagcattgaagtgcatcctgtttccggggggcactggaacagagcctggtctgttctagccagtccctttctatctcaggataacattctacagttattcttgagaactataatcaaataagcagggagaactgggtaagtccaaggcttatctatacaagcctttaaatattcaagaccaaaaaaaaaaaaaaaaaaaaaaaaaaaagccttggttcttatctttctttcaggaaagcagaggctcattgtggaaccctcaaggagcatggggtcgtcttcatccctcagtttataaatggccaaggagagtaatgcaacaaaaacttctcagagttaaaagccagagttcctaaagaaccgtggacaaagggttctgtctagtgggcagaattcatccagcgaaggtgcttactgcactcccagcatgtgcttgggaactttattaaaattccttcctattgagatttaaattgctgtccagaattatacaatataatgaatgggggcattcattatgtgtattctatgccttctccatcattgcatattcagtcctcgtgctagagagaggcagataatctaccttttaaattgataggtctcctaactacagagggtcacatctggatctgatggcacctacagaacttggactctgagcgacaatcagtgaccaggtgtgactttatattatctctgtcagggaagggtgagagttttcaatgtgtgaacatagaataaaatggtctggtgaccaaaaggctctattaaagataatatgagatgttcaaaacactggctattttcttgggaacaaaagttgaacttctaaatctttctcacagattgtagaccaaaggaatgaattctgattggcagaatataagcctacgtaatataaaaaagacttccaggtttggccctctgagtcttgactcattacacaccatctcacagccttattttgcctttcaacaggaaatttggaacccaggttttcccaacctacatctacaaaatggaatgggtctgattcgcaagttttcagagaaagaagccaaccttaatcagactgtgatatgatgaggaaataaaacttgctgtgctaatcaactgatactgggaagcatgtttattataataacatagtctatgcttaacttttctaagaaactaatgatctggaatatcgataaaaagaaaaaagaaagaaagcaaaaggacagaaagttttagtgagaatatgtcactaaaagaaaaatgcaaaaatctccaggtaattgttcttgtctgtcactataatcaaagtggtatttcacccccatctgttgtccctgctttgatgagtgagaatagaagagcagttcatggttacatgttggcaacaggagcatataaatatcaaattgccttaagcactggcaaaggcttaagagtccatcctaaattgagggattatccagtaccctgtttagaatggaaataaatccttgcacagtactttcaactcaataactgaaaaaatgcagagagcaaattcaacaatttgtattaccaacagccagctgagtccaacttcctaaatccataggaaaacagaaaagcagaaaagcagaaaaacaggcatcagtaactgtcctaaaaagtgaaggactcaggaggctgaggcagcagaatcacttgaacccaggaggcagaggttgcagtgagccgagatggtgccactgcactccagcctgggtgacagagcgagactgtctcaaaaaaaaaaaaaaatgtgaaggactgagggaaagaaacagaatagaccataatgagtcagatgcgagataagagaagcagggcccggaacatatgccctcagatagaataagaacaatatcaaagatgaaaatccaagaaaacaccttgaggaaaataagatgatagtaatactaaatatatatgttaaaggactaattttaatgagatacattcacataggtaggaagaaaaataaattcaatgtgcagatattccttatgtatataccaatgaaagtaaagagacagataaaataagtcaggcaaatgctaacgtaagaaaatagagtcacattatttattttgtaatttgatatctgaatattaaaaacttacactttctaatgttctataataaattctaaagtgcagatataactcccatgaatgttgacacactaagtaacagtaaaatacattaagcaaattagaactgtaagaaaaaggaaagcaacacagaataaaaacaagactcagtaggtgatctttatctagaatcagaacaattaaaataaaataatgactggagaaaaactgaggtaagtactatgtttaatgcctgtaagcaaatatacgtattttgaattgtgacatgattaaaagagaatgtatgattttcaagtgttcatacaacacattgaaaaattaagcataaactccccgaaattcttatacctaaatgtcataaaataagtaccaatcataccaactacttttctgaacataatgcaatgaaatctataaaacaactgatattttgtggctgttttttactgcatcaaaagaagactaataaagcaatgtatttaccctgtgaatgtatatgttcaaataatttatatagactgtacgcataatattcttttaattttctttatatttcttcttatatatccattttctaaaatagtgagttatgcttttattcactagattttttctgtttaaatttgtttaggtattatatttgatattttattaatttccgtattgatgtttatcatttacttcttccagttttcaaatattttatgattaaaattatagatcattgttttaagaccatcttatgtaaatagcaaaggtttgatttgtaatgattttataaatatacatattttaatgtaatcaaattgttaatatgctggtctacacatttgcctttagtttccatttttacccaagatatgctagacaaatattttcatgttattctaaagattagaatttttattttgctatcaatagctctttaatctctttcatatgttctatctgcctatatctctgtgtgatctttgttaaacccatattctgaggtttagatttcccagccacccaatactggtggaaattctgatagtttttgaaaccatgtctcaagacttgtcccatggaacataaagggaatctctattctgtcattggctgggaactgctctagggtgtttacatccctggcaatttttatttttctcatgttgagcctgaaagaaagtcactgatcatgaaatgtgagcatggacagggacaattagtccaaagggaaaaattagagacactgactgttccattatacataactatatacctagtcactcaatataatgaagagtttcataattagtcaaaataaagttgaaccatattaattctacatggaacaattcagaatgaatttagtctgggtatagatggtaaagagaaaaagtgaatttaattagaacacaatttcaatcaaattaagtctttgcatgagttatcaaggacacaataaataattgaacaattccaaagtgttactttcatagtaatttcaaataatgctctaattatctcgaatatgtgtgtgccagataaaaaaaccttcagttttctagaggaagagttgaaaattgtgagaagaaatattcagaaaaaaataaatgttgatttatttgccttaacaatttaagcttacataaataagtatggacataaaaatagagtaccacactggccatacacagcatgcttgagatcaatccataaggataaatatatacatgtactgtattcctttcattgctacatgttactttttgcatcacctcattttatgtatttaaattcattagcccctatgaagttaatgtataaaataactatttttttatttctctaaaaatactttattgaataatttataatttccccttatatttatagtgaaaccactgttatttgaagtttgtatatgactataattctcctctgattatatctgtttttcactttttaatttttaattattcttgtatccctcaatgaacctcatttagtcattatgcattcttcttttttttttttctttttttttctgagatggagtttcgctctttttgtccatgctggagtgcaatggcgctatctcagcaccctgaaacctctgcctcctgggtccaagtgattctcctgcctcagcctcccaggtacctgggattacaggcatgcgtcaccacgcccagctaatttttgtatttttagtagaggcagggtttcccccagtggcttttactgattctgacacaggccaactctaagcttgagacagcagtggaagggtttctgtgggtgaaacaggcgtgtctcaggcttgtcagccaggtatgacaaaatatgtcttaggtttgattctcatatgcatgatgactacaaatatttttgcaaatgtcagtattttaacttcatatataaacataaaatcttcaaaacactaacacaaattagagtgcttctatcaatgctcatagctaaacataccagagtaaagattttgcatcagcctccttttttgagtaagaagaaaaacaatcaaacaagcaaatacatctcaatcatcaataaaatgagaagtcaaccatgaccactagccacaaactatgaagaaagactcactagtgcagtgaaaattaagtgttgaagtaaagcatggtctcatacttgtacagacctacagcagtgcaagtgttctccaaaggtaggctatgcattatgaggagtcaaatttaaaaagtctcttccttcctatgccaggtagatgtctattaaagacttttgctaacataagcagcactgaatgagagcaacaggcaaacaaacattctttatagctacagctatgataaagagaggacacagagattatggtcaacagtgctgcaccaactaaacttagtcaactgaactaaatttactgttaattcacaaaagtaatgctgaaatatgtatttgctggaagaaaaaagacttcttatccagagcaaaaccagattatataggctgaggtagggtgttggtggagaagctttggtccataattaattctcagtgtgatcactagaaaattatctgcagagaacctaggtgaattcatagcttgaaaatgatatgaagaaaaatttggataacaaagatgaaagtgttcaaaagaggttaattataccacaaactatataaatattaacatacatttctgcaagctatcaaagaaataaaggaacattttggctttttaaacatagaataaaaaatgatgtgaaaatggcattaaaaatgtgaaatggcaacatcaaggaagaaatagaagatatccataaaactattacagaaagaaaaagtctaagtaaaacagcagattgtcatgaataaggaggtaaataaggagaaaaaaaatgagtgcaatgaaattataaaaagatgaacacgtttaaaacaagatcccctagtgttatcatacatatgtataatatgagacttggatgaagcgaatagaagaaatgtctactaatggggaaaggagggctaatagtgcagacttcttaaatacatttgtagaccagaggagtaaactgaatacaccactactgagtgactgagcttctaatgtgagattttattatttttaacatttttgcaagtaaccaaaaatgttttgcttggttcacatgaaagtttgatatatgtgtggttagtaagctccatattccaacatttgtgttcaagcacaagatcaaataaattaatataaataaatacagtgtgaattcattaacctgtgtagatgcctgactgattattgtgcaaaataattcaaatggatgttcatttttgaaagaatgaatatgctagaatttgttatggaattactgatgtttttactactgattatattttatttctaggctggaatccaatcaatagcatgcctttcactgcctgattcagaacatcacaagaataaaacaggagttaagcaaaaggaagattaaattaacattctaatgttgataaaggagatagtgtgtaatacggcaataatgagattcccatgacagcacgtcaatattgaatataaatccaaccacagccattggcatcacttaccaaccccacagcaggccaccttccctgaggcagagactgtaatagcttttgaggcacagaaagtgtgactccagcaatcgagcaggtttagcaaaagagaataggattcctacattctcagttcatctctacaaactcacgtattaaaacaatcattcagttctgggacaaggtccacctgtattcatttagtgaagtccctccacatatttgctgttacaatattaattttaaagaatgaagttatatttacatgtgtttttcaaacatttagctaatggtgatagatgtgttttcactgagatcatcaatatatatcttaaatacattgccccaaataaagcattattttacagaaaatatagagatgttttcatgtaaataaatgcaagtcacaacttatataattatatattttgtttaataattaaaccattgggaatttatggatcacataattcaaattcctctgcatggtcaggagaagctgtgtcctgtccttccttaccttggttttttctattctgccgcatgccaaatgcactactcctgactcaaggctttataagtcttttcctggaatagcccagccatagtcacatgcctcatctttcccttcattgtaggcctgaattactgcctttactgcacctatttaaaatattctcttgttattctctatctacttacctgagtttatttttcttgatgacatttttaagatcagacattatacactattttattatttgttttttattaatcattagattaataatccacaaaggcaggaaacttgttttgtttgcctttctatccccagaatttatatagcagctactattgtaaagtagatgcataatagcataaatgaatgaataagtagttgaatgcatgaacaaaggaatgagaaaaaaaattctagttaacattttattaatgctatcttctgaatgtgggtgtgtgtgtatgcatatttcttgttttccgggcattatttcgtcatgcagtcaggacatatgtaaaatactccactttgtttagggtgatatagtgcttcagagtgttaattaaatttagatagacccatgttcaaacttcagccatacaacttattatcaatcacatgatattggctgagaaatagtctccaaatttacttatgtctttaatgatgagaaaaggctcaatagacattctcttttatcagtgttattgtgaataaagagacttgaccatagaaatgtacctactttagagaaatggaatctatcactaattttttcttgaagacagctgatgaagcttactctgtaattaaatagaaggcagtgtattttaacatttaacttttcctcactctaattttttggatagaaccatatgttgatattcattcttaaactcattgtaatttaaattctaatatccctggcttaaatataagaaatgattcaagacattataattttgttatagagacaataaaaatatctgcaatagtaattcgttgtatgtatatgtaataatttttatttaccatcataatatccagtgttttgcctcatgacatagtgcaggcttggctttttttattaatagattttttttagactggttgtagttcacaacaaaatttacccaaagctgtgtaaaatacccataaattaccctgcctagacaaatacatagccttttctatctcccactagagtggtacattttgttacaatttttgaacttgcatttactcatcattatcagacaaatttcacgtttccaaactgcatttaaacaaatgtagctctcattttagtttcatgcggagtagattcactgcgctaaaaatcctctgtgctctgcctatttatccctc

SEQ ID NO: 571 - DNA, 62609 bp, Homo sapiens
agagagtacactgaatagcttaaaccaagtagaaggtgatttcttgcttacatatcagtttaccgttaagtaattttggctaaagacgcatctttcctgcaaaaaataattcaagttaatgaaggatctactattaccaaattgtatcttcccagattactttgtatatatcaccattccagaagacaaaagactactcatgaaatacaatttgcacacttctttatatatgaaaaattcacttctcttcactgtgtaaacaacttaaagttttgcccagttactgcctacaacttaagagttcaggatgtttcatgacgtgcagttctctcccttaggccactatatgacttaacgaggactagtgtcctataaagtcaaaacacaaattatctgtaaaatctaagttaccatggtgaagctcctatcagaagacaaagaagtctgcatagcactgacaaaaatatttctgagcaatacaaatatttattcgatgaaaccataaacatgtcctgtggaaataactttaaggtccattgtccctgtggctcatagatttactttctgaggtaatttacattttctcttattctccatgcctccatcttaaaattagaacaatgagtgttttctcagcatgactaatcaattgcactgattagtgcaatttgggatgcttgaggatattttaagccttaattttttttctcacaataggcttattatacctttgcccagtagttatgtggaaaacatttatttatttattgcatctagtttataaccaaacatacagttctttcctaggtataattctaaagtctgcctcatttccttcttttttctcctccccaacacacatatgcttctctgactgtaaagatgaccactttaaggtcatttgaaatcatagacttgaaagagaaaacaacttccctgattagttctttgcttcagggctgggttccttgttttttatgaacacagtaggatttaatttctgagcagctttttcaacctaatcagaaaaacctgagcttttctgtcactggataattccaccattactagactttttgttcacaagtggtttccaacaaggaatgattttgtttccacagaacacttgtcagtgtctggagacattttgaattataatgattaggtggtgatgctactggtatgtggtggtatagcctagagatactattaatatcctacaatgcaaagaataacctcccacagaatgcaggaatatcaggcataaaatgtcaataatgctaaggtttagcaactcaactctatccactttctttccactctaaagacaggatatttctttttctttttttttttttttttttgcctgtgtttatctatttcttggattatggaacagaacaaacacgaacacattaccttttgcctttcctcatttcccacactctttcctagaggtaatattaagcttccaattaattttagatggtagtttcaataattttttttcactgggtattacaagtcttcatttcaaccctctgagtttggtttacttgtccatttaatactaatttagtggatatgttttaggtgctgttatagcagacccaactcaagctggtgatttctatattacttggaatagtgctagttgctttgacaactacactcaacaacatataatatcttaaacagaacagaagtttcattcatataaactgtttttttaagataggaaaagcattgctcctttatgtccgcattcaagaacataggctactaaggtatttaatctgcagtatgttgcttccaagactactgtagaattggccactccagtcaagcatactgaaaaacgtatacagaagagtgcatgttgggattttggagactaagttggatataaaatatgttatttctactaattttccactattttgactttaatcccatgccctaatataaagtatataagaatgagaaatatagtttatgtatctatcaaaatagaacataaatgtttgtgaacatttgaatctgtcagcttctcttgctcacgtgcctgtagtgcctgtactcgggatgctgaggcaggagaatcgcttgaacccaggaggtggaggttgcagtgagctgaggtcacatcactgcactccagcctgggcaacagagcgagactccatctcaaaaaaaaaagaagaagaaaaagaagtgactcaactgattgatgtgtaaaacctcattgtaaaataatgttctataaatgagacattaatacagttaaatttttggattaaaaaagtctgccactttgtgaatatgttttatttaggcttgatttagttaattttcttttttcttttttctttttttttttttttttttttttgaggagtttcactgttgctgcccaggctgtagcgcagtggtgggatctcggttcactgcatcctccaccccgccaggttcaagtgattctcctgccttagcctcctgagtagctgggattacaggcacccaccaccatacccagccaattttttgtgtttttagtacacatggggtttcaccgtgttggccaggatggtcttgaacttcagacctcaggtgatccgcccaccttggcctcccaaagtgctgggattacaggcatgagccaccgcacccagccagttaatttttctattaactaagacctaattaagattgaggcagaagaaatgggtccttgggatttgaaaagtagtattcaatttggaagtttaatttgcaacatagattgtttgttattaaattactagatatagtatcacaaaggcggaaagaaaggttgcttagttaaagatctaagttactagtcatggtgtcagatatagagaatgattgaaggttattagagtcacacaccagatgagtaaattgttgttttcaaggaagaggttacataaaggtaagcggagtaatattttagcatttttgttaattaaaaatttgtaaagttatttccatttcaaggaaattactctcagtaattttacgggtaaaatgacaaattccaagtttaattttcacacgtaacaccctccttgagcacttatttttataaagctattagtctattttggtctcaatttacctttctttaaagagatgttaaaattttctgaaagaagttgagatctggaagtgtagctgtgctatttttcaatttttaattacatatttaattatcctttaattacttaaggttattctcaaaagtgaagagatagctgggatcacactgcataagattttactcctgaatgtaatattcaaaaatgttacaaagtctatcaaagaggttttcattctgcgacaatagatggtcaatttgacatggtcaggaagcaccacccccactgagagataccaaattatggagtaaaccaccataatttaggcagatcttgagagagaaaatgctgagtggatggagaggcctgaagcaatgaagctgagctgaagagggaggaagcctgtgcagggaacccaaacactacagctagttccccagaatggctcctaggaaagggcctctgcctgagagagacctgtggcctagaacacctaacacaagaaacacagtgattgcaggagactcccccagggcccaggagcagatctggtgatggaggcatctctcccacccccactatagagcacacctgcaaacaaaaggaagtataaaacagccaagccactgggtattaggctagccactggccatcactcttaagcaccatgcattggatcacatcccaaactacaacatcaaaatttatcctgctacatatacacctgtgaaaccaaacacaagaattactcatacataaaaatcctggacagagacagccctgaccctttgaaagcatccagaaacaaaaccaattgcctatactcaacatacactacagttaaaggaacactaaccctaccagaagagaaaaaatcagtgcaagaactctggcaattcaaaaagctagagtgtcctcttacctcaaaattagcccactagctaccaagcaatggttcttaatcagtctaaaataattgcaacagacatagaatacagaacctcgatggcagggaagctcatgaacattaaggagaaagttgaaacccaatccaagtaatccagtaaagcaatctaagtaagtgctgaaagatgaaactgccattttaaaaaacagccacactgaatttctagagcagaaaaaattcagtataagaattttataatacaataagaaatattaacagaaggtaggccaagctaaggaaagaatctcagagctcaaagactggttcgttcaatcaactgagtcaaaagaaaattttaaaaaagaattaaaaaaagaaaatgaaccaaagctttaagaaatatggaattatataaagagaccaaatctacgactcattgtcattcctagaagagaaagaaagagaaaaggcaacttggaaaatagatttgagaatagagtctatgaaaattttcctaacctcgctagagagagtgacatgtaaatccaaaaaatacagcaaacccagctaggtactataaaaggtgactatccctaaggtacatagtcatcatattcaccaaagtaaatacaaaagaaaaaaaaatcttaaaggcagctagagagaaaggtcatgttttcatacagcaagaactccactaggctagtagtaaatatctcagcaaaaaccttacaagccagaagagattaagagcctatgtccaacatcattaatgaaaataaattccaggcaagaatttcatatttcactaaactaaacttcctaagtgaagaagaaacaaatttcttctcagataagcaaatactgagggagtcaatttcaacttgaccagccttatgaaaggtccttaagggagtgctatacattgagtaaaaagaatgacacctgctaccacaaaaacccacttaagtacatagctcacaggcactataaagtatctacacaatcaagtctacctaaaaaccagctacaaacgtgatgataggatcaaaatctcatgtatcaacattaaccataaatgtaaataggctaaacaccccacttaaatgacgtacaatggcaaactggataaaaatgcaaggctcaccatctgtagtcttcaagagactcatctcatatgtaatgacagccactggcccaaaataaggggacggagaaaatctgccatgcaaatgataacaaaaaagcaggagtaactattcttatatcagataaaacagactttaatcaaaattaaaaagaacaattgaagaatgaagagcattacgtcatgagaaagtatatgatcaaacaagaatacttaagtaccctaaatataaatgcacccaacatggagcacccagattcataaaacaagttctttttggactacaaaaagacagacgaccacccaataattgtaggagacttcaacacccccgctggcagcattggatcatcaaagcagataactaagaaagaaactgtgtacttaaacttcacacttgaccatttggacctaataagacatctacagaacactccactcaataaccacagaatatacattcttctcatctgcacagggaacatattctaacattgaccacatgcttggtcataaagcaagtctggataaattttaaaaaatgaaatcatatcaagcacactcttagatctcaatgtaatcaaaatataaataaatatcaacatctctcaacactacacaaatagatgaaaagaaaatcaaacaactttctcctgaataacttctgtgtgaaaatcaaaattaagggagaaattttaagaaagtgaaattaatgaaaatgggaacacaaattaccaaaatctctgggatgcagctaaatcagtgttaagaggaacgtttaaatgcctttatcataaagttagaaatatttcaaattaacaatctaacactacacctaaaggaactagggaaaaaaaaaaagaacaaccctacatcaacgctaggaatgaaaagaaacaactaaaatagagaagatctgaatgaaattgagatgcaaaaatcctacaaaagattaatgaaacccagagttgatttaaaaaaagagattgatagacctttagctagataaacaaagaaaaaaaagagaagatctaaatatataaatcagaatgacaaaaacgacattaaaaatggtcccacagacatacaaaataatcctcagagaatactaggaataactctagacacaaaaattagaaaatctagaggaaatggataaatttctgaaaacaggcaatcttccaagattgaatcaggaagatactgaaatactgaagagaccaatatgaagctctgaaattgaataagtaataaaaaatctaccaagccaaaaagccctggactatatggattcacagcaaaattctaccggaagtataaagaagaactactacaattctactgaaactattccagaaaagttgaagagaacgtactccttcctaactcatgctgtgaagccagaatcagcttaataccaaaacctggcagagacgcaaaaaaaaagaacattcaggtgaccactgttgacgaacatagactcaaaaattctcaacaaagtactagcaaactgaatccatcagcagcgtatcaaaaaattaatctactatgacaatacaggctttattcctgggatgcatggctggttcaacatatgcaaatcaataaatgtgattcaccagataaacagaattaaatcaaaaaccatatgatcatctcaatggatgccggaaaagctttcaattaaatccagtgccccttcatgaaaaaacaaaacaaaaaaaaaaccctcaacagttgaggcttcaaataagcatacttcaaaataaaaaagagctatctacaacaaacccacagccaatataatactcaatgggcaaaagctgaaagcattctcctctagaaatgaaacaagccaaggacatccactcttaccactcctattcaacatagtaccagaaatcctagtcagagcaatctcgcaacagaaaaagagaaaagcacccaaataggaagtaaagattaaggcaaactatctgtcttcacccaacaatatcattctatacctaaaaaaccttaaagacttcaacaaaagtctactagaaatgataaaggattttagcaaggtttcaggatacaaaatcaatgtacaacaattagtagcatttctatacaacaacaacatccaggttgagagttaaattaagaacacaatcatatttacaacacctaggatgaaaataaaatccctgcaaatacaactaacctaagatgtgaacgatctccacaaggagaattacaaaacacagctgaaatctgaagctggatgcagtggttcatgcctttgggaggccgaggcaggtatatcgcttggacccaggagtttgagaccaacctgggcaacatagtggaacctcatctatacaaatttttttttttttttaaatagcgaggcatggtggcacatgcctgtagtcctaactaccctgacggcttgaggccaggagttcaagcctgcagtgagctatagtaactccactgcattccagcctgggtgaaagggtgaggccctgtctcaaaaaaggaaggaaataagaaaaggaaggaaggatggacggaagggaggaagggagggagggaaggaaggaaggaaggaaggaaggaaggaaggaaggaaggaaggaaggaaggaaattttgataacacaaataaatggaataacattccatgtttacagattaaaagaatcaatattgttaaaatggccatactgcccaaagcaatttgtagattcaaggctatctccatgaaactaccaatatctttcttcacagaattagaaaaaaactactctaaatttatatggaacacccccaaaagccagaatggccaaagcaattctgagcaaaaataataaagccagagaggcatcatactacccaatttccagctatactataagtgtacactaaccatgatactgttacaaaagcagacacttaagccaatggaacagaatagaacactcaaaaacaaagctgcacacttaccaccatctggatcgtggacaaggccaacaaaaacaaacaatggggaaaaggcaccctattcaataaatggtgctgggataattcgctagccataagcagaagagtgaaactggatgcttaccttccaccatacacataaattaattcaagatggattaaaggttaaaatgtaagacttcaaattatgaaaactctaaaacaaaacctaggaaatatttttctcgacattggccttggcaaataatttttggctaagtttctaaaaacaattgcaacaaaaacgaaattgacaagtgaaagtcaatcaaactaaaaagcttctgcacagcaatagaaactatccacagagtaaacagacaacttacagaatgggagaaaatatttgcaaactatgcatctgataacgatctaatataacaaatccataaggaagaaaaaatgacaagcataaaacaaccccagttaaaaagggcaaagctaatacaggagcagaaaatcaaactccgcatcttctcacttataagtgggagctgaacaatgggaacacatggacacagggaggggaacaacacacaatggggaacaacacacaacacacactataattttctgtagggggttgaggagagggagagcatcaggaaaaatagctaatgcatgctaggcttaatacctaggtgatgggttgacaggtgcagcaaaccaccaccacacacgtttatctatgtaacaaaactgcgcttcctgcacatgtaccccagaacttaaaatttaaatcaagaaaaggcaaaggacacgaacagatattttctcaaaagaagacactcaagtatatgaaaaaacactcatcctcactaatcagcaaataaataaatgcaagcaaaaaccacagtaagatgccatctcacatcagtcacaatagctataattaaaaagtaaaaaaattagatgttggccaggctgcagagtaaagggaatgcttatacactactgttggtggaaatgtaaactggttcaggtactgtggaaagtattttggagatttctctaagaacttaaaacagagatacccttcgacccagcattcccattactgggtatatattcaaaggaaaataaattattctaccagaaaaatatatatgcactcgtatgttcatcagcatgttattcacaatagcacagacacggaatgaacctaggtgcccatcaacggtggactggataaagaaaatgtggtacatatacactatggaatactatgcctccataaaaaagaatgaaattatgtcctttgcagcaacatggatggagctaaggacataatcctaagcaaattagtgctggaaaagaaaaccagataccacacattctcacttataagtggaacctaaacattgagcacacaggaacattaacatgggaacaagacatgctgcaggctatgggggtgggggagagaggggagcatgggctgaataactacctactgggtactatgctcactaccagggtgcactgtacaaaagtaacaaatctgcatatgcactatctgtgtctgaaaaaaactgaaattataaaaaccaagagaatatgtttctaatgaaggtagactttatttgatggactggattagaatataatattttttaagggggaaggcattgggggatgcacaatgtctacaggtttctaaatctctctggtttctcacctaattcatagtctcttatgtcattttcatagttttcatattctgcctttccacctcttctttttaacaagtaaaattcctcatagcatacaaaaaaccaattttataaaaaacccatattatcgatcagggacctgtggattatgtgctattagaaccatacaaaatgtctctatatagttttctgtatctttggaatatctttgggtgaagctgcagaccttcttggtgagtgttacagctctgcgcagagccaaacagtgagcagcagcaagattgcaaagagcaaaagaacaaagcctccacactgtggaaagggaccctagcacgttgctgttgctggctctggcagccgcttttcttcccttatctcaccccacccacatcctgatgattggtccatttcatagagagctgatgggttcattttacagagagctgcttggtctgtttacaatcctttagctagacacaaaagttctccaagtccccaccagattagctagacacagagcactgattagtgcgttcacataccttgagctagacacagcatgctgattggtgcatttacaatcctccagctagacgtagtaagttctccaagtacccaccggactcaggagcccagctggctttgcctagtgcatcccggccgcgggcggagctgcccgccagtctctggcgcgctgccgcactcctcagccgttgggcggttgacgggaccggatgccgcgtagcaggaggtggcgcccgtcccctcggggtggcgcgcgggagcccgcggttggggggcggggggcaggggacgggggcggggagcagggtgagggctccagcatggcaggctgcaggttccgagccctgcccccttgccccgcggggaggtggctgaggcccagcgaaaattcgagcgcggcgccggcgggccatcactgttggaggacccagtgcaccctccgcagctgctggcccgggtgctaagcctctcactgcccagggccggcggcgccagccgaccgctcagagtgcggggcgcgccgagcccgcgcccacccggaagtcgcgctggacctgcgagcaccgcaggcagcccaggttccggcccgcgcctctccctccacacctccccgccagcagagggagcccgctcaggcctcagccagcacagagaggggctcccacggtgcagctgcgggctgaaaggctcctcaagcgcggtcagagtgggctgaggccgaagaggcgccgagagccagcgagggatgccagcaagctgtcacctctcagaaatacaggaagaacatcaataatgttcgaagttataaagtaggtttctatcaagaataaaacataaacgatcaaagaattccttataaaaacattttttatttctaggaatcaaaacataaatataaaatttgagagtccaccaaaaaaaattagatgccagatttcactataattatcagggaagcgcccaaacgggttgtttacggcgcctcggggaaactttctgtttcgtgttaagggtcttgaaccatgatgtttagaaaaccatgggctgatgctttcagaacctctgtgattgttgcctctgacactgcatccaatagactagcatgttgattagggaaagctaaattcaataaaatacgactgtaagtggggtcaccaccttgaggggttatgttagaaaagtagatgataaggtggtattgatagagtattgaagtctgggctcaaatggttgcccggggcctttcaagaccaatgactgacaagaataggtaatgttcaggacatagagtttaggattgggggacactgtgagttaagggccatgacagaagtcttcataagtaaactgttactggcacaagctgctacctgcccaggtgagcaatctgttggcccagaggagagttgcttactgacataaattgatttgcagaaatttcctgaagcaaacaataagttatttataggtttgcagccttactttcctggaaaaatacttttctggaatgaattgtgaaatcatgttgacacagatggcctcaggtttcagttcggataattaagctgtgtaaatatagaaagtctaaggtttctgtgtgctgttgattcacagtatgcaacaatgatcatattacttttatttactatgagcttcagctgaaagtccaaaagaaactttaatttcagatatttaatgaaatcattatagctgtggtaatttcctttagctgggtgtgagtgtgtgatgtgagcgtgtgatgtgtgtgtgtgtgtgtgtactctggcagcatattccaaataatttctgtaaaatttcagtttgaaattaatagaagacatattaagttgtttaaactctttgttatttaaattctatattactttagttgattactctgtattattacggcaaagctttgatatgttgccctgaatttaaatgaaaaggctgttcggcataaaaacaggaatattttattaccaaaaagaattaactaccatatgtcatttacagaaaagagtaaattcttcagggcatagaaaatacacatttccttctgtttgtgtggaaataagcaaaatacctgttataatagattcctcacagaattttgtgaagcttcaggtaaacttgaaagagaaaaattaaaattctagagtttcataattacaaattgggatataaaaatagaataattatttgaattttgtatttctctccaggggatcaaaagtaatatataaacttttaataaatattgatatagcttcacgttgactccatatgtgagcaatttgctttctgttaaattcacaattgcataatttttttcaggctggaatgcacttggatgccagagattttgatttcttaatgtgaaataaggtgataatacattccaaagtatatattttttcaactttgaatatatctggtgtatttggagtaatatctgagtaaatacacttatatgtaagagaatcaaaggaacaagatattattttatatccaaggaaattaaaacacttagaacataaatacgtattgcattacttcatattaaagaaatgttttacaaaagaaaataaaagagcttattttatagccccatttccacaaataatagcaaaggtacatatatctgatgttttacacactcattattgtttctcttaaaatttgttgcttatactattttaaaaagcaagcctatagattgttgtgtgtatatacatatacacacaacatatatatatgtgtatatatatatatatatatatatatagcagcaagcaagagaatgggcctcttcctactgaggtttaacatttgcatgcatatgtatattttgattcacatagacttattgttctttaattacgtgaacagtgattcctggttacattattggaaaatggaagcaatgctcaaagagcatcacctaaatttccatcatattttgctctcaatatattttgtacatccaaatatattgtgattaatctgcatacatttttgctgttctaggtgacgctgatatgaggctaggtaatacacgaccttagtctgcatgttgtacttgtgtaacacacataattttacagtgctaacaggtgctataataactaactatagttaatgatgaatgaaagaaggaagatgttaagatgttagggaaggactcaaaagatgcagtgcttgagttagaattttaagggagattatgcaaaagcagtcacttaaggtgggttgggataatctagaatgtgggaatgatgtatgcaaagtcacacaggagagatacagcatgcatgtttagaaaattgttgattacatatggaaagtttgcaggacttgcatcctagaatgtcaggattttaagctaagtagggttcaaattaaatttttcacatacttcgctgcattataataactagtttatatttaactcatccactaaactaagttatttgaaaagagatgccagtgttcactcaatctagttgtctgtcattaataatttaaaaataattgagattttaattttggtctgctaagcctgtttaattaaaatttgacattaaataagattttacagggcctgtaattttttttttcagtcatcacagtttgaatattaaacattactacttttatctccctcagtcagcataaaacatactacttatggttttaataatcaaattcaatgagcaccaacaaaatttgatgtaactattaactttgaaattttattgaaatagaactatgccttgggtatcattcaaagcatttaattgttgcaataaaaaactttgagataaattgaaatgatggacaatatgggtcgaaagcaacattggcttgagggaataggctaatgtttgagaacggaattgttaaggacaagattggatgtttatattattttaggaaagatacactctaatggagtttaattctaaaatgtttaatattatgaaaatattatatattatatgatcattatagaaaattaaatatataagaacatcagaagcaaaatagtcaaagtctacctaaacccaattagaagtgaatactattaatcttgatttgcatgtttctaatcttattattatcaaattaataaacagctttcagatattctgcttctccctgttactagatcaggataatgtcatttatgtacaggcatctcctgcttactcagttcagcattgatcaataaatattttagacttccattcaaaacacttccatttttcttttgcccatattctttttattcagtgctacctattttcaaatacacaacactttgtcaaacaaattccaacattagattggatctagttggtatcaaagtagtaatacacattgccattcctaatcctcaatgcattgatcctgaaaattatttgtaagaatagaaaaatactggatatttcaaaataagtctcattttgttgcttacacatgaaagactggaattaaccaacataaccattacaaggtgattgagcaaatgaatagatggaaaatattatagaaactttactgcagttcatcaaccattgtggtcgttaggccataggaaaatacagtgtgatagtacccttgtcttcttttccatttgttaagtctcatatccaaataacagtggatagaccttatgagaatacaaagtgagataaaaataatttttggcttttcaatgtatcttatttgatctaagaggtatttccccgactttgatgcaataattattgtcacaaaatttgactttattaaagaccattttaaggatctttgcagctgacagcagtgacttttttacctcctacaaagtttcaactgacagtcttattgtctctgactttcccaaattaatgacataattagtcaccagggctttggctgctcaatagggatttagtaagcaatgagtcatatgttggggaacacttcaacaaacaaaatgttggcagagaaagatgtatgaatcagctaggaagaaacactattctatcattgaggatctttctaatattagatatcacagaaaaattttcatatagattaccatataagtgagccaaaatctctaggaacaaaaaagctttgtataattataactccttgccatgatttaacttaaaatttctttacttatttagcaattctataaacaagaatcatttctgttaaggatactaaggagactgttcctattgaatcagaacatttaaaagaaataattgaggaactcacacatgtaaaacgtcattaaccaaactaaaataaaatgtgagggcataaacttaaccagaaatgtttaaaacctatataaaaaaaaaactagaaaacacttctgaatggcacaaatttggacttgagcacggggaaagaaattccatgctcttgaaaaagccttaaaatcataaatgtgccagttctttaaataaacttatatcttctgtgtcataacaaacaatattttctagaatttctttttccagatttagaaaaatagacaaatttacttggaggaataaagaagcaagaatagctagaaatagcctataaaatcaatggaatttggagtcaatacaaaatattaagcaattcttaaagcttctatgattaaaatgagttataaatacagatagatgaagatcatatagaaaatcaagacattgacagatatggaaaggtggtatataatgaaaacatttcagatcaatgagggggaaatgttaactggaaaagaatattaaaaaggcaatgaactcaataagacaacaagaagcaaaccacagaaaaataactggactggattaaaaagaaaatattttagacacttcaaaaataaaatattcaaataaccaatgaacttattaaaaggttttcatttatattggttatctgaaaaaaaaattcaaaccacaatgagatgtaagtacttgtcattcagaatcctgaatttgaaaggaatattttagaattctaagttgaagagaaaatgcaaagttttgatgagaatgttgactagttagaacactcaaattgatgttattggcatagcttagttcaaataatttggataaagatatgtattaggccccaaaattctacttgtaaagatggtttctccagaaatgcatgcatatatatagctaaaaaaaaatgtgtactcatgaaaacacttttcagaataacaccaaaataaccccaaactgtgggccaaaagtggactaaaatacttataaagagtacagtaaacaaataagttgtaatatgatcacctaataaaatattagagaaataaatgtaaatagtttcatttgcaggtcatataatcaattagtctcacaaataaaatattaagcaaaaaaatgtggttcaaaacactacacacactatttgattccttactggtaaaagttagaatagtgttatgttaggagggatgggtggaaatcaggtgtgtgactattacattttcttattctggatgatcatagtattttaaaactcactaagctttaaacttatgtgcatttacccatgtgtatacaatactttaatagaagcttcaaatcaatgagaaaacataaaactgtctgatggaaaaatagcttgaggaaatgaacaggtatagcagaaaagaagggctgcatatagtttaaaaacttgaagagatgtttaatctctttgcaaatagaaaaactacgcatttaaattgaaataccattttcatgttccaaaattaaaattattagaaatatgatggtatacagtgatggtaatatgggagaaaggaaacgtcctaggcaatttggataagcttttctgagaaagatttaggcaatatgccattaagatttaatgtgaacaaatatgccattaagatttaatttgcccacataaatttcccatttggaaatatttggaaagatattctatttttcaaaatttaatctgggccgggcgcggtgcctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaatttaatctgaaaatacctaagcccctgatatttttctaaaaactggaatgtccctgtggtcattgggttttagagacataattttcactgtgatggtcataattttaaaaggttgcatcatccatttttagttaacatatattgtactaacatcacatatctatgtaatagaaaaatagagtcaattcatttagggacagacatgaaaatgacaaatacatatagagatagaaaggtatcttgtgcattatactgagaaagacaatagaaataaacaatttacatgggttgatttattttgattaagatatataagtggttagataaatgttaaataggtcagtatgtaattacagaaaatgacaaattgttatgtatggtacatttgcaggcataacacagacattacattttggaaaattgtgttctatgcaacagtgccaagtctaatgaaagtaagaggaagaggaattcagccaaagtaccaacccctgttatccattccttaagaaaggaactcctttatacactcaaaagaggggattctttttaaatctgtttccagaggggcatctgcatacacatacacatacacacacacacacacacatttacattatatttaaatgtgtgtgcatgatatatacatgtatttatttatttaatatatatgtgttatccgggtcctatataggaacacacacacacacacattttgaatcaaacactctttcgtataattttggtgacaaatgtatgcaataaatgagaatactttaactttccaaaaagctattcaaaagtataattttcaaataaaatatatgtttgtatgacaacaaatgattttttataaataatatattctgcattatcaatctgccactggtttttattaaataaaaaaacccgtaagtttgtatgctcttaaaatacatataacatttgtaagaatagtttttatgtaaaaataattatagttcactataactatgttaaaaatagacatagccaggcaagtcgctcatgcctgtaacccagcactttggtaggctgaggcgggcagatcacttgaggccaggagttcaagaccagtctggccaacatagcgaaaccccatctctaataaaaatacaaaaattagccgggcatggtggcccataccttgtaatcccagctactcaggaagctgtggcaggaagattgctggaacccgggaggcggagtctgcagtgagacaagatcatgccactgcactccaacctgggtaacagaatgagactctgtctcaaaaaaaaaaaaaagaaaagaaaagaaaagaaaaaaatagacacagatgaagggtgtctttgattatgcaaatagattacccatcttgtactcactgtgtttatttcaataaatgatccacagaatatgctacttttgatttatagttttcttctccttcaccgctgtggactgggaaaatatttcttattatttctgctgcagagtagcaaaaaattatgagccagaaggaagaccactacaacaagcaaaatctctgagtaatcataaaatgaagaactatttcctgttgggattcattgtgacgaatttgattttaaattcttggtgttggcattttatttttaaaatttagctttcttgcctattctgaaattgtcaaaaattcagaaaaacaatcatcatcatttgcttgctgatcaatggagacctaatgatttttaggctgtgagactacagtaataaataaataaataaaaaagttgatacttccttctatcgagggaaattgagcatttttctcatagtcctaagtcaccagatcaagggatatatgtaatacttgagtgttgacattttattaatttttatatttaactagagctgtaaagttgaaacaaatgggtcaatgcaatagcccataaaatattttaaaaacacataaaagaaatatcactaaaatttaaacataaaaaaaatacaaaaaaaccctgagctataggaagggaagtatcctctaaatgcccaagttgaaggtagtcctcttagaaaggcacagaaagaagcagtgtttgatgggaacgtgatttttcaagtattttgaattttcaaactcaccacattaactgagtaaaatgaaaaaaatatataaacttcctctgaggcagaaaaaacatttggcattttcaagatagaattataataaaaatatctcgccccaatagaatacaaagaagcatccttaagcaaatagaaggcatctacggaaatatcacactgaagtttgaactaataaattattcatttaagatccagaagaagacaaagtgtcctctttcactattgttctctctactgtatgggaggaattaaccagtgagacaaatcaaataaataagtaaaacatacacagttaagaaatgaaaaatacaattctaaatttttaaacaactccattacctatacataaacttctagtgactgtaaaaatcagctgctggaataaactagtaattttagccacatcatagaaaaaataagtcaacccattaacttatttctatatatttccaatgagtaattaatgataaaaatcaaattcatgtaaaatactaataaaaatatgtatatatgattttaacaaattacatgcaagatctctctaaataggaaactagccaaagtgttgggagatgtaggaaagttctaaataaatggagtcacatacaataattgatggttttgatgtgtgtccctgcccaaatctgatatgatgtaatctccaatgttagaggtgaggcctagtgggaggtgattggatcatggggtggatttctcatgagtggttcagcatcatccctcttgatattgttctcataatagcgagtgagtgagttttcatgagatctggtcatttaaaagtgtgtagcaccttcccctttcactctcttgctgttctggccatatgacgtgcctgtccccctttgctttctgccatgattgtatgtttcctgagtcttcccagaagctaagtagatgccagcatcatccttcctgtatagcctgcagaacagtggggcaattaaacctcttttcttcataaattgttgaatcttctgtatttctttatagcaatgccagaacaaactaatacaataatcatggcttgaaagttcagtgaattttagtgtgtaaaaggttttggtttttccaaattaatcattctagaaatccgcaccataatcacaaaagatatttttatataaattgacacactgatttaaaaatgtacatcaagagagcaaaaacaaattataaaaagctgaaaaaaaagctggaatactcacacttcctaacaccatgcaataacttaaagctatagtcatcaagagaatgtgttattagtatatgtataaacaattagagtaatggaatggaatagagttcacaaatagatccatgcttatatgaataatataatatcaaaaatactgcagttattcaaaggggaaagataattttatttaacaaagtgtgcagaactacgagataaatgtgaagaaaacaaacctcaagtccttcctcacaacaaaagcatgaatgagttcaaaattaaatgagtccaaaatatattatggaacaatgtgtaaaagtgaaagcataggcttcaaatataaagcacagaaaatgtcttagtaaactacatgaaagcatttctttttatccaaaccgtggagaaatttctttttattcagaaagcaataattatataatgataaactacagaaatgtataaatatatttatactttaatgtttatgtttaattccgcaattatatatactatttattatgaataagagcaagaatatataaatataatgtacaacatagaaacaagagaactataagaactaacagatgctacacaaaaatgatataatagcaaataagcaaatgaaaaatttcttaatatcgttagtaataaaaaataaaatgagataattatacacatctactagaaaagctactattttaaaaattgtgttaccaatatttggcatagatgtcaagaaaccagaatctagagtttgcatacattgacggtgggagtgtaacacagtacagctactttggataactaaatctaccttacatgtaccaattctacccctaggcatttatcctaggggggagaaaagcttaagtctataaaaaggcttgcacaagtacctttattcattattgtcaaaaacagacaccatgcaactgtccaccaggagcggcgttctcaagttcagcactgttagctgttgaagtggcttaattctttgttgtggggagctacaaaactcaaccataaaaaaagcaaataatttgatgcaaaagtgggccaaagaccttaacagacacttcaccaaagaagatacgcagatggaaaataacatatgaaaagatgttctatatcttatgtcatcagggaaatgcaaattaaaacaatgtgagactactacacacatattagaactgtccaatttcagaacactgacaataccaaaagctgttaaggatgtggaaataccaaatgctgtcaagtatgtggaaatacaggaaactatgttcattactggtgggaatgaaaaatggtacagcaatttaggaagatattttgtttggcaatttcttacaaaactaaacatcctttgtcttagtctgttttgtgttgctataaagaaataccgaaggctaggtaatttaccaagatcaagtttatttgcattatgtttctgatgtctgaaaaagttcaagattaggtatcttgtaagagcctccagctgcttccactcatggtagaaggcaaagaggaactggaatgtgcagagattacacggtgagaaaggaagcaagagagagaaagaggataaggtgccagtttcttgtttgacaatcagctctcctgggaactaagagtaagaactcacgcctgaaggagggcattaatctattcatgaggaatctgccactgtcactcaaatgctgcccatttagccgacctctaacattggaatcaaattttagcatgagatttggtgggtacaaacagtatattcaaactatagcacttaccatatggttctgcaatcgtgctacttggtatttacccaaaggagctaaaaacttatgtccacataaaaagctgcaaaaggatgtttatagcagttttattcataatgaccaaaacttggaagcaaccaagatgttcctcagtaggtgaatggatacataaactgaggaatatccaaacaatggaatattatatagagctaaaaagaaatgagctataaagacatggcagaaacttaaatgcttgttactaagtgaacagaaaatccactgtatgattccaaccatatgacattctcaaaaaggccatatgatggggcagtaaaaagatgaatggttgccaaatgttagagagagggagggataaataggcagagcacagaggatttttagcgcagtgaatctactctgcatgaaactaaaatgagagctacatttgtttaaatgcagtttggaaacgtgaagtttgtctgataatgatgagtaaatgcaagttcaaaaattgtaacaaaatgtaccactctagtgggagatggaaaaggctatgtatttgtctaggcagggtaatttatgggtattttacacagctttgggtaaattttgttgtgaactaaaaccagtctaaaaaaaatctattaataaaaaaagccaagcctgcactatgtcatgaggcaaaacactggatattatgatggtaaataaaaattattacatatgcatacaacgaattagtattgcagatatttttattgtctctataacaaaattataatgtcttgaatcatttcttatatttaagccagggatattggaatttaaattacaatgagtttaagaatgaatatcaacataggttctatccaaaaaattagagtgaggaaaagttaaatgttaaaatacactgccttctatttaattacagagtaagcttcatcagctgtcttcaagaaaaaattagtgatagattccatttctctaaagtaggtacatttctatggtcaagtctctttattcacgataacactgataaaagagaatgtctattgagccttttctcatcattaaagacataagcaaatttggagactatttctcagccaatatcatgtgattgataataagttgtaaaagtgttcctatttctccacatcctctccagcagcatgtaccctaaaacttaaagtataataaaaaaaaaaaaaagaaaagaaaaaaataaataagttgtatggctgaagtttgaacatgggtctatctaaatttaattaaccctctgaagcactatatcaccctaaacaaagtggagtattttacatatatcctgattgcatgatgaaataatgcccggaaaacaagaaatatgcatacacacacacccacattcagaagttagcattaataaaatgttaactagaatttttttttctcattcctttgttcatgcattcaactacttattcattcatttatgctattatgcatctactttacaatagtagctgctatataaattctggggatagaaaggcaaacaaaacaagtttcctgcctttgtggattattattctaatgattaatacaaaacaaataataaaatagtgtataatgtctgatcttaaaaatgtcataaagaaaaataaactcaggtaagtagatagagaataacaagagaatattttaaataggtgcagtaaaggcagtaattgaggcctacactgaagggaaagatgaggcatgtgactatggctgggctattccaggaaaagacttataaagccttgagtcaggagtagtgcatttggcatgtggcagaatagaaaaaaccaaggtaaggaaggacaggacacagcttctcctgaccatgcagaggaatttgaattatgtgatccataaattcccaatggtttaattattaaacaaaaatatataattatataagttgtgacttgcatttatttacatgaaaacatctctatattttctgtaaaataatgctttatttggggcaatgtatttaagatatatattgatgatctccgtgaaaacacatctatcaccattatctaaatgtttgaaaaacacatgtaaatataacttcattctttaaaattaatattgtaacagcaaatatgtggaggggcttcactaaatgaatacaggtggaccttgtcccagaactgaatgattgttttaatacgtgagtttgtggagatgaactgagaatgtaggaatcctattcttttttgccgaacctgctcgattgctggagacacactctctgtgtctcaaaagctattacagtctctgcctcagggaaggtggcctgctgtggggttggtaagtgatgccaatggctgtggttggatttatattcaatattgacgtgccgtcatgggaacctcattattgtcgtattacacactatctcctttatcaacattagaatgttaatttaatcttccttttgcttaactcctgtttttttcttgtgatgttctgaatcaggcagtgaaagacatgctattgattggattccagcctagaaacaaaatataatcagaagtaaaaacatcagtaattccataacaaattctagcatattcattctttcaaaaatgaacatccatttgaattattttgcacaataatcagtcaggcatctacacagattaatgaattcacactgtatttatttatattaatttatttgatcttgtgcttgaacacaaatgttggaatatggagcttactaaccacacatatatcaaactttcatgtgaaccaagcaaaacatttttggttacttgcaaaaatgttaaaaataataaaatctcacattagaagctcagtcactcagtagtggtgtattcagtttactcctctggtctacaaacgtatttaagaagaagtctgcactattagccctcctttccccattagtagacatttcttctattctcttcatccaagtctcatattatacatatgtatgataacactaggggatcttgttttaaacgtgttcatctttttataatttcattgcactcatttttttttctccttatttacctccttattcatgacaatctgctgttttacttagactttttctttctgtgatagttttatggatatcttctatttcttccttgatgttgccatttcacatttttaacgccactttcacatcattttttattctatgtttaaaaagccaaaatgttcctttatttctttgatagcttgcagaaatgtatgttaatatttatatagtttgtggtataattaacctcttttgaacattttcatctttgttatccaaatttttcttcatatcattttcaagctatgaattcacctaggttctctgcagataattttctagtgatcacactgagaattaattatggaccaaagcttctccaccaacaccgtacctcagcctgtataatctggttttgctctggataagaagtcttttttcttccagcaaatacatatttcagcattacttttgtgaattaacagtaaatttagttcagttgactaagtttagttggtgcagcactgttgaccataatctctgtatcctctctttatcatagctgtatctataaagaatgtttgtttgcctgttgctctcattcagtgctgcttatgttagcaaaagtctttaatagacatctacctggcataggaaggaagagattttttaaatttgactcctcataatgcatagcctacctttggagagcacttgcactgctgtaggtctgtacaagtatgagaccatgctttacttcaacacttaattttcactgcactagtgagtctttcttcatagtttgtggctagtggtcatggttgacttctcattttattgatgattgagatgtatttgcttgtttgattgtttttcttcttactcaaaaaaggaggctgatgcaaaatctttactctggtatgtttagctatgagcattgatagaagaactctaatttgtgttagtgttttgaagattttatgtttatatatgaagttaaaatactgacatttgcaaaaatatttgtagtcatcatgcatatgagaatcaaacctaagacatattttgtcatacctggctgacaagcctgagacacgcctgtttcacccacagaaacccttccactgctgtctcaagcttagagttggcctgtgtcagaatcagtaaaagccactgggggaaaccctgcctctactaaaaatacaaaattagctgggcgtggtgacgcatgcctgtaatcccaggtacctgggaggctgaggcaggagaatcacttggacccaggaggcagaggtttcagggagctgagatagcgccattgcactccagcatggacaaaaagagcgaaactccatctcagaaaaaaaaaaaaaaaaaaaaaaaaaaaaagaagaatgcataatgactaaatgaggttcattgagggatacaagaataattaaaaattaaaaagtgaaaaccagatataatcagaggagaattatagtcatatacaaacttcaaataacagtggtttcactataaatataaggggaaattataaattattcaataaagtatttttagagaaataaaaaattagttattttatacattaacttcataggggctaatgaatttaaatacataaaatgaggtgatgcaaaaagtaacatatagcaatgaaaggaatacagtacatgtatatatttatccttatggattgatctcaagcatgctgtgtatggccagtgtggtactctatttttatgtccatacttatttatgtaagcttaaattgttaaggcaaataaatcaacattttttttttctgaatatttcttctcacaattttcaactcttcctctagaaaattgaaggtttttttttatctggcacacacatattcgagataattagagcattatttgaaattactatgaaagtaactctttggaattgttcagttatttattgtgtccttgataactcatgcaaagacttaatttgattgaaattgtgttctaattaaattcactttttctctttaccatctatacccagactaaattcattttgaattgttccatgtagaattaatatggttcaatttcattttgactaattatgaaactcttcattatattgagtgactaggtatatagttacgtataatggaacagtcagtgtctctaatttttccctttggactaattgtccctgtccatgctcgcatttcatgatcggtgactttctttcaggctcaacatgagaaaaataaaaattgccagggatgtaaacaccctagagcagttcccagccaatgacagaatagagatttcctttattttccatgggacaagtcttgagacatggtttcaaaaactatcagaatttccaccagtattgggtggttgggaaatctaaacctcagaatatgggtttaacaaagatcacacagagatataggtagatagaacatatgaaagatattaaagagctattgacagcaaaataaaaattctaatctttagaataacatgaaaatatttgtctagcgtatcttgggtaaaaatggaaactaaaggcaaatgtgtagaccagcatattaacaatttgattatattaaaatatgtatatttataaaatcattacaaatcaaacctttgctatttacataagatggtcttaaaacaatgatctataattttaatcataaaatatttgaaaactggaagaagtaaatgataaacatcaatacagaaattaataaaatatcaaatataatacctaaacaaatttaaacagaaaaaaatctagtgaataaaagcataactcactattttagaaaatggatatataagaagaaatataaagaaaattaaaagaatattatgtgtacagtctatataaattatttgaacatatacattcacagggtaaatacattgctttattagtcttcttttgatgcggtaaacaacagccacaaaatatcagttgttttatagatctcactgcattatgttcagaaaagtagttggtatgattggtacttattttatgacatttaggtataagaatttcggggagtttatgcttaatttttcaatgtgttatatgaacacttgaaaatcatatgttcttttttaatcatgtcacaattcaaaatacgtatatttgcttacaggcattaaacatagtacttacttcagtttttctccagtcattattttattttaattgttctgattctagataaagatcacctactgagtcttgtttttattctgtgttgctttcctttttcttacagttctaattggcttaatgtattttactgttacttagtgtgtcaacattcatgggagttatatctgcactttgaaggtgtaagtttttaatattcagatatcaaattacaaaataaataatgtgactctattttcttatgttagcatttgcctgacttattttatctgtctctttactttcattggtatatacataaggaatatctgcacattgaatttatttttcttcctacctatgtgaaggtatctcattaaaattagtcctttaacatatatatttagtattactatcatcttattttcctcaaggtgttttcttggattttcatctttgatattgttcttattctatctgagggcatatgttccgggccctgtttctcttatctcgcatctgactcattatggtctattctgtttctttccctcagtccttcacattttttttttttttttatttttgagacggtctcgctctgtcgccgaggctggagtgcagtggcaccatctcggctcactgcaacctctgcctcctgggttcaagtgattctgctgcctcagcctcctgagtccttcactttttaggacagttactgatgcctgtttttctgcttttctgcttttctgttttccaatggatttagaaagttggactcagctggctgttggtaatacaaattgttgaatttgctctctgcattttttcagttattgagttgaaagtactgtgcaaggatttatttccattctaaacagggtactggataatccctcaatttaggatggactcttaagcctttgccagtgcttaaggcaatttgatatttataccctcctgttgccaacatgtaaccaggaactgctcttctattctcactcatcaaagcagggacaacagatggggggtgaaataccactttgattatagtgacagacaagaacaattacctggagatttttgtatttttcttttagtgacatattctcactaaaactttctgtccttttgctttctttcttttttctttttatcgatattccagatcattagtttcttcgaaaagttaagcatagactatgttattataataaacatgcttcccagtatcagttgattagcacagcaatttttatttcctcatcatatcacagtctgattaaggttggcttctttctctgaaaacttgtgaatcagacccattccattttgtagatgtaggttgggaaaacctaggttccaaatttcctgctgaaaggcaaaataaggctgtgagatggtgtgtaatgagtcaagactcagagggccaaacctggaagtcttttttatattacgtaggcttatattctgccaatcagaattcattcctttggtctacaatctgtgagaaagatttagaagttcaacttttgttcccaagaaaatagccagtgctttgaacatctcatattatctttaatagagccttttggtcaccagaccattttattctatgttcacacactgaacactctcacccttccctgacagagataatataaagtcacacctggtcactgattgtcgctcagagtccaagttctgtaggtaccatcagatccagatgtgaccctctgtagttaggagacctataaatttaaaaggtagattatctgcctctctctagcacgaggactgaatatgcaatgatggagaaggcatagaatacacataatgaatgcccccattcattatattgtataattctggacagcaatttaaatctcaataggaaggaattttaataaagttcccaagcacatgctgggagtgcagtaagcaccttcgctggatgaattctgcccactagacagaaccctttgtccacggttctttaggaactctggctcttaagtctgagaagtttttgttgcattactctccttggccatttataaactgagggatgaagacgaccacatgctccttgagggttccacgatgagcctctgctttcctgaaagaaagataagaaccaaggctttttttttttttttttttttttttggtcttgaatatttaaaggcttgtatagataagccttggacttacccagttctccctgcttatttgattatagttctcaagaataactgtagaatgtactgggaatgcaacatcctgagatagaaagggactggctagaacagaccaggctctgttccagtgccccccggaaacaggatgcacttcaatgctttagtccagcgaatcacgttcctctggagtgtaaaacccagggcaggctgctttaccggatccttcaactgcaggaccagtggggcacacacagagaagactccatctactttaggcagctttccggagccttgggaaaaagttcaccatagatcatcagcttctgttggtccttgctgcttatctgtaagtatcaaacccacttcatgaaacttgtgtgtgagcgttcagtcttactagactcagacaagttggtcacagaactttctccaccaatggtttctttggtaatcttgcaaaaatataagcagcttctgatccatttgcttctgcctcctaaaatttctttccgaatgtagatgtcaagtgtattttacttccctgatttctggctctgtgtctcttactagctgttcctttgatgctatctggaaaaaaaaaaagatagaagggccatcattaacttgatctttcattgggggtcactttactagaccaagattcttttactggcctattttgtataaaatcttatgtcagacatattctctcttactcttggaaggccttgaatttctggagtctctctaatatttcttctcatatatttaaaaattcaccaatggctacaaatacatactatcatttttcttaattctctgttttgtaagtatgtcatctgcctcccaatttacagtaggttgtctttatatttgtcagtctcttacatgtcttgacttgcagtcccttttataattgctgccttcctatatgagacatgaaaataatgttttgcaatgtaagttagatttttcatggtgtagcacctcactcctgtataaagttatttcctgatcagaatattctaaactatcctgtggcaataaactgctaaatccctgtgtctttgctcattaatgttttatttgttgatcacttcacagctttccacagttttctccattaaacgatgattctgtgacttcttccttcttgtaactttaccatctaactcagtgcttccaaggaagctttgaagggggaaagggaacggaggtagcacacagaattttctaaaggcccaactggaagtgacttgcttcactttctttatattccattgtccagaacttggttgcatggcctgcaaactgacttcaaagaagtgttgggaatgtggttttcctgtgtttctaagcacaaaaagagtggaatgaatttcctgatatacaagcttattattaacagtcaattagcatcagaaggttatcataatttttgttttcttttcttctgtatatcaagccaagaaaaaaaaatcctgcacctttttaaaaactcatatggcggtcactatacatcatgcatgggaaagtgaattttttaatattgaaataaattacatgtctgtgtccctagaccaaatacccatattcctttacttagtatttttcttaaatgtgtttgaggttttataatttccatacttttcactttccattgattttccatccacactcctgttgtttacctcacagtgcctttgggtgagtaggcaagatcggggcacaggtttcttcttaaggagaattcataaagctaccacttttcaagttccgaatcattggatcatttatctctgttagaaaagacatatgaaatacaaattaaaacaaaaagtgaagatgataattaaatcgtttatttctgtatatattcaacaattttacatttgccctcttgtaacaaattcacattataactgcattatcctgctatccctcagtaataaaacctacaaaatttatgcaattttacttttactagatgctttgtttaactgttgtaaaaaatattcttatgtgccatagggtcctaactcaatgacattttttctgtaaaagttaacatagcgggttgaaaaatatgctttccataactaattaagcgtggtcagtttagaagtgtggtcactttgattagctatctcagataatgacttcctcttctcattgttagtttcaagatattccactacttgcacagcttgttagctagttaaaaaaatctactatatcttcaataattgcttcttttcttcttatctttgagattctacgtgaagatactcatacaatagaagacagccaggaagagtctttgaaagtcaatacctgtttttcttaaaactttactctgctagaaaatcttatcactggtcaacaatcttatcacataagaaaacacattaaactttaaaacaaaattgatttcaatagacttaatggaaacatctttatgcagacttttactgtctatttggtaccaaggtgagaagaaaagattgtcttcctctgtaaatctcgaatgggtctgttactttgacttttctttatctaggacatgagaaaattgtatatcttttgggtaaaattcaaaaacaatatcaaggtatcttatttccttaccttggcaatgaagtcttagtatgcgaacaatactctatgttactatcttaattgaagtgatatgaaccacatctattaatttgatttgattgttacaactgggatactaatataagattgcttattcattttattaccaattgttgacaaaaacataaatatatgaacaaatttatatgaatatattcaaataatcctctagattccatgtataatattctgctaaagcaattgacgtatttcaagttctttttagaaagagattaatgaaatataatgtaaagtgggggacttttgctgcttgaaagaatggcaatttttaaaagtacaggtaaatataccaccgcaattttattacctctgtgttttctaggtaattcttacagaagttctatcctaagccattatattataatttcataggaaaatcagttcccttggttttgctgaaatatggtttctctgtttgctgaaataaagtttttgttaattagaaatatatatttcatatttggactatattagtcagggtttttcagagaaaccaaaccaaaaatctgtattgtcactgtccattagaaaaacagaacacacacacacacacacacgcacaaatagtttatcatatataacattatatataatacctatacatatacattattgatgtacagttggcccttgaataacatgagtttaacagcatgggtccacttatatgcaattttttttctacctctgccacccctagtacagcaagagaaatccttcctctttatcctcgtcctcggcctactcaatgtgaaaaatatgaggatgaaggcctttatgatgatccacttccacttaataagtagtaaatatattttctctttttcataatttttaataacatttccttttctctagctcacttcattgtaagaatatggtatataatagatatataacatgcaaaatatgagttagttgtttatgttatcagtaaggcttctggtaatcagtaggatattagtagttaagatttgggggagtcaaaattattatgcagattttttactgtgctgggggtcagtgctcctaactcctgaatggttcaaaggtcaactgtattatgaagaattgactcacatgattgattatggtgcctgagaagtcccaagatctgctgtctgtaagcttcaagacctaggaaagctggtggtataattcagtataagctcaaaggcctgagaaacaaaggaacaaatgatgtaaatcttagatgagataactcagttcaagcaattacgcaggagaaaagtgcaaagttttccttcctctgtcttttgttatattcagatccttaaaaataaccactgactgggcatggtggctcatgcctgtaatcccagcactttgggaggtcgaggcgggaggatcacttgaggtcaggaggtcaagacaagcctggccaacatggtgaaaccctgtctctattaaaaatacaaaaattagccaggcatggtggcgagtgcctgtaatcatggctacttgggaggctgaggcaggagaattgcttgaacctgggaggcggaagttgcagtgagccaagactgcgccattgcactccagcctgggcaacaaaagctaaactccgtctcaaaaaaaaaaaaaaaaaaaatacccaccaacaacagggaggccacctttatttagtccactgattcaaatgctactctcactgggaaactcccttatggacacatccggaaataatgtttactctgaagttacttgactcaatccaattggcacataaaattaaagatcaaaaagacaaatatttttctcatcttttaaaatacacattcatgtgacactaagttcattatacaatttggagggaccaaagctaactaaaaattgagatctctttaaaaagccagaaaagcagaaaaagtacattaaatatactaaaatatgaaacctttaaatgtatatcctggtctctctttcttaaccttataatggtaattttttagctatttaatataattgtaagtaaagaaaatttaaattagaattattaccaaggattttatcattcatttgtatcatgcaatatcagatccaatgagctaactacaagaacaggggggatgctgcaactatctcaactgtttttatttcatttcttgacatatgcacattctaccagtatcttctacatttgatttactgatgaacaaggaaagattaaaataaacaaaaacttttaattccccatctgcctttttttctatgtcatcctcttcagcataagtggttggctgtatctgtattttgtagaagtttattatcttctttctctgtctggagtaggttgtagttccaatggaaagcatggcttctcaaagattttatcacccaacttactaaactatagaccacagttagctggtgcagccatacctcgttttattgtgcttcatttattgcaccatggagttatttaattttttccaaagtgaatgtttatggcaaccccacactgagtgagtttatcattgccacttttccagctgtatgtgctcacttggtgtcccagtgccacagtttagtaattctcacattatttcaaacttctgtattattattatatattttgtgggaatctatgattagcgtctttgatgttaccattgttattgtttgggggcagtatgaatcatactcatataaggtggtgaacttaattgaaaaaagagtgtgtgtattctgactgctccactgactagcaattcccctatatcttcctctcttcaaaacttcctattcactgagacacaaaaaaattaaaattatgctgaataataaccctgcgatggcctctaagtgttcaagtgaaacaaagaacatctctcattttttaaattaaaacatctctcatttttaaatcaaaaggtagaaataattaagctcagtgaggaaggcatgtagaaggctaaaacagattctcttagattctctgaatgctgagggaggtgatgaatctgcaaacacaaagttgaagctagcaaagattggtaaataaaattcaaggaaaaaaacatttcataatataaaagttcaaggtaaagtagcagatgctgatgtagaagctacaacaagttatcctgaaagtctatctggctaagataagtgatgaaagtagttacactagcaacagattttcaacgtagacaaaacggccttttattggaagaagatgccatctagaactttcatagctagagaagtgaatacctaacttcaaacttcaaaggataagctaactctcttgttaggggctagtgcagcttttgactaatacggatgaaagacttacaaatggatttaactcaaaaagttcctctgtgaggcacattataatcaatctttcaaagtcaaagagaattctaaagacagcaaagaacaaagtatcaaatcacatataagggaatctccattagactaacagcctttatcagcaaaatccttgcaggccaggcaagaatggcataatgtatttgtggaaaaaagaaaaaaaaaaaaaaaaaccccctctgtcaactaaaaatactatacacagcaaagattaacttcagaaataaagaagaaataaagtttttctcagactaacaagaacaaagaattcatcaccattatcatgacgtacaaaacaatgcttatgggaatcctacatctcaaagcaaaaggacaatatctatcactgtgtaaacatgacagtgtaaaacttagagcagatacacaaataaaaaacaggaaggaatcatgttatcactacaaataccaccaaattacaacactaaacaataagagaggaagaaaaaataaaggatataaaagaaaatcagaaaccaactaacacaatgatgaaagtaagtcttcacctacaaataacaattgaaaatttaaatgattgacattcccaattaaaatatatagattggctcagtggatgaaaaacaccgaaccaactataagctgcttacaggacacttatttctctctatgtaaggacagacagagcaacagtaaagaatggaaaaagatactccacacaaacagaaaacagcagcataaagtaggagctctacttatattggacaaaatagactttaaggcaaaaaccacaataaagagacaaagaaggttattatgcaatgataaagggcatgactcaggaagaagatataacaactgtaatttatgcacccaagactgaagcatccagatatatgaagtaaatatttttagagcaaacgagagagatagaccaaactacaaaatagtagagaactgcaacaccccgttttcagcattggacagatcatgtttacagaaaatcaatgaagaaacattggatttcaactgcactataggccaaattaacctaacaagtacagaacatttcatccaatagctgcagaacacacattcttctcataaacacacatagaccatatgttagaccacaaaagaaatctcaattacattaaaaacttaaactaataaaatgtatattctcaaaccacaattttaaaaaactagaaattaataacataacaagaacaactctggaaactgtataaacacatgaaagtttcaataatatgtccctaaatgttcagtgtttcaatgatgaaatcaaaaaagaataaaaaaatggattgaaatcaatgaaagtagaaacaaaacatttcaaaacttatgggatacagcaaaagcagtgctaagggggaagtttatagcaataaaaatgtacatcaaaaaagcagaaataattcaaataagtgaacaatgcaccttaagaagctagaaaaggaagaataaaccaaactcaaaattagtacaaggaaagaaacaataaagattagagcagaactaaacaaaatgtagactaacatataatgtgaacaaatcaatgtaacaaaaagttggtttttgaaatatataaaaaaagacaaaccgctattttgactaagaaaaaaggagagaagacccaaataaataaaatcagaagtgaaaaaagggacattacaattgatacttcagaaattcaaaggatcattagacactagtgagaacaactatatgccaaaaaattaaaaacccaagagaaaattattttctgtacacgtgaaacctatcaagattaaatcagaaagaaatagaaaacatgaacagaacaataaccagtaactagattgaattcataataaaaagtttccccaaaaggaaaatgccaggaccacatgggtttactgctaaattaaacccaacttttaaggtagaacttgcaccaattcttctgaaactattttaaaaaaattatccatatctcattttatgaggctgccattgctaagatcagacaaagacagaacaacaacaacaaaaactgaaggctaatatccctgaagaacataactgcaaaatcctcaacaaaatattaacaaactaagtccaataacacatcaaaaagataatacaccatgatcaagtaggatttatttcaagaatggaagaatggtttaacatataaatatcagatgtaattcatcacaatacaataaaggacacaaagcatatgatcatttcaatagatgcaaaaaatcatttgattaaattcaataccacttcatgataaaaactctcaatatatttggtatagaaggaatatacctcaacataataaaggctacatataaccaacttaagctaacatcatactgaatggggaaaaactgaaagccttttcttcaagagctgcaacaaaacaaagatgttcaattttaccactgttattcaaaatagtactggaagtgctagccagagcaactaggcaaaagtaagaaataaaaaagcatccaaattagaaaagaagaattcaaattttccctcttcatacatcatacttttacatagaacctaaagaccagcaaaaaactcttagaactgataaacaaattcagtaaatttgcctgaaacagaatcacatacaaaatttatttgcatttttgtaaaccaataatgaaaatcatcaagaaagcaatcacatttacaatatctacaaaacaaaataaaatactggaaataaatttaaccaaggagatgaaagatctctacaacagaaactacaaaacactgatgaaaaggaactgaagcgaatacacacaaaaaatgggaaaacatcccatactcatgcactggaagaactaatattgataaattgaacacactatccaaagcaactacagattacatgaaagacctatgaaatatctatttttttccacagaaataaacaatactaaattcctatgagaacataaaagattctgaatagccaaagcaatactgagcaaaaagaagaaagatggaggcatcatactacttgacttcaaaatatgctacaaatttattgttaccaaagaagcacggtttttgtagaaaaacaaacacacaggccaataaaacgtaaggagcacccagaaataaatctatgctttttaaccaactgatttttgacaaaggtaccaagaacatgatttggggaaggaacattgttttcaataaatggtggtacagaaactaaatattcctatgctgaagagtgaaactattatagatctccatctcaacacaaaaatcaactcaaaatggattaaagagttaagcataagacctgaaattatctggtatcagaaaacaaagaggaaatgcttcagaaaattggtctaagcaaagattttatgggtaagacttcaaaagctcaggcaacaaaacttaaaatagataaatgagaccacatcaaactaaaaagctctgaacagcaaagaaaacaacagagtgaagagacaacctgtaaaatgggagaaaacacaagcaatctattcattgacaagggactaatatccagaatgtacatgtaagtcaaacaacttagccaaaaaaagagagaaaaaaaatagatttttttaattggctaagaatctaataaacatttatcaaaagaaggcatataggctgggcacagtggctcaagcctgtaatcccagcactttgggaggccaaggcgggcagatcacgaggtcaggagatcgagaccatactggctaacacagtgaaagcccgtctctactaaaaatacaaaaagtagctgggcgtggtggcgggcgcctgtagtcccagctactcgggaggctgaggagggagaatagtgtgaacccgggaggcggggcttgcagtgagccgagatcgcaccactgcactccagcctaggggacagagcaagaccccgtttcaaaaaaatagaaggtatataaatgaccaagaagtaaattaaaaatgctcaacatcactaatcatcagagaaatgcaataaaaaccacaatgagaaatcatcacaccccagttaaaaggactaatacactgcatgttttcacttggatatgggagtctttttgttgttgttgttgttgttgttttaaagagctcatagaaatagagaatagaattgtggtcattagaagttgggcaagttagtgggaggggattataagacgaatttggttaatgaacacaaagttacagctagatggaagaaaaaacttccagtgttttgtagcagtgtaaggtaaacattgttaacaatcatttactgtatattttccaaaagctagaagagaggaatttgaatgttaacaacatgaagaaatgataagtacttgggttgacagatatgctaattaccttgatttgatcattacatattgtatatttgtttcaaaatatcactctgtaacccacaattatgtacaattattgcatgtcagctcaatataaaaaataaataaattgtcaccaattttttacatggtggtatgagtgaatttgctttttcaattctaattttgagcaactcacagtctgctctcagatccccacctatctaggttgtattgtaaggtacatctaattgatccaccaatagtaatggttctaacctcttccctagtacattttttttttctatttgtatccagacatgagcagaaatcagctaaaataaccatgactcttctacatcttttacctcaagacaaaatttagaattataaaaaccacaaagccagaattatttctgtggaattttctgtgttatatcatacttcttcattcctaagtctatgaatttggtatatattatctacatgcattaggaggaaaaatgcataaattaaaagcacagtgtatagggtgagagaaaacaactatctgaaaaatttacatacacaataattgctttggggaacaactctctgaaatcaataaaatgaaaaaaaaaaagatccttttttattaaaaaccttttttttaaagaatcagatggaagaggaattcagccatggctgaaaagccaaacgcttgtctttattttaagaaaaataatttataaatgatcttccagagacatttttcatttcactaaattcaaaaaaaatgtaatgtagttcattatctgatacaaatattgaagaacataacagacacattttctaatacacagatttcaagtttgaatgtctttcattatatctctgctagaaataaagactttatattaaagtataaccattcataaatgggagggtaggtggtgtacaggctaatgtatttgtagttttatatcatagtgtagggaatgaagttaaaattcattactgtgtcatttaagtaaacaattctgaatctaacctaccttcctttagaactttccactattttccctcagagacattctttaaatctgacctatgtaatattcctccttatgccccatgattggtttcgattttccattacacatacctaaagtcaaaacacagttcagatgccactcccaataaattcttccttattccccaatcctaaatattcctgaccacccccaaactccagttctttattccattatctgcagacctttgtgattctcttaatacttcaaataaaattttaatatatgtgaactaattgtcataaaacccacttccaaaattgcactaacattctatattgcttatcatatttataatatcaataccctaacactcacctaactagagttgtattttaaaaattaatttattcattagaagtagtcaacgtaatgcaaactttccaataaaaagttacctttaaggccgggcgtggtggctcatgcctgtaatcctggcactttgggaggccgaggcagatcacgagctcaggagttcaagaccagcctgggcaacatggtgaaaccctgtctctactaaaatacaaaaaattagccggacgtggtggcatgtgcctgtagtcccagctacttgggaggctgaggcaggcgaaacgttgaacctaggaggcagagcttgcagtcagcagagattgcgccactgcactccagcctgggtgacagcgtgagactctgtctcaaaaaaaaaaaaaaaaaaagtgacctataataacttttgtattaatacacacatattttgtgctcatgctcccatgtctttctgtttcttttactctccctagtagcttctctggctaccactgtgcattagataaagtaagaacctccatcagagactcagatttaaactgtgaaaggaattaagggatatcatccatctcagcaacaaaccattgtagttattttaactgtttccaggtcatcatcctatattttctcccatttacttctttcaacatgttgggataaattagaatcaatttattctttaattcacaagaagttcttagagtggtttcttctcttcatgttattgagctacagacatcaaatttaactgctgtctttgctgttcttttctctcttcaatctgtttctattgatgtaaccactgagctatcttctttgacctgcttatttctcaagatttctcacacaactgtggaaacgccctgtttcttactgaatgaacttcataaaacaatgaacctcataccatagaactactcaggaagacttgatatggagcccataaaaatgtcagggtttatttattagttgtttcatcacagtaatctcaagaggaataggaaaaacatgaaagaaaaaaggaataagccactgatacagtgggcttaagctttgatgtgcaatgtggaatgcttactgtgatatttattctctgtcccaatgaactgggaaatggggatggagtccataaatctacgtggttttaaaccacctcaaaggtgagagataatttaaggtgagattactggattgccttgtggttacttttgtgctgcctcatgtaagcaaaatactaaagagagctatgggcaaatgtggaaagttattccagagaagtatttgaagctgttataacataaatttacttgggaaaaaaatgtgtggaagagttaagcaaagcatatttgaaggaattaatgtcatcttgttaccggtgtaggagatctgagttaccctgagttactgactccaaattcctatgggtctgcagcaatttcagttctcgtctcctcagaagaaagaattcgaccgaggggcataaagcagagagaccaaggcaagtttcagagcagaagtggaaggttatgtaaaaagctttagaataggaaagaaaggaagatttacttggaagagatccaagagggcacctgaaggtcaaagaaagaaaaggggcatttaaccttgatcctagggcttttataggcttgcctctttaccatgattcttcccttaaggtgggcttccctcatgcgcagtgtccttcctacctttgggaattgaacacacacagtatgtttagaaatttgtgtgcatgcctatctgaggctttcttcatttttttttttttctagtggagtgtccctggaaggtcatatgtcaccatcttgtctcctagtgcacatacccaggaagtttcttctccctggaatctgcattcaatcaataatttagtgttaacagctgtggagcatcaggagattgtttctccctggctttgaagaagtagtgtgataattgtcaaaccatcacctgatgtacctagtgggtggggtcctgccatgctcatgccatctaactacctgtaataatctgtgtccactctacaacttgattggaaacattacttttctatcaaatgaaggctcccaacattctctttctacctctctagcataatttttttatttggatgtacaaaatcatttagttgtataagaaatatattattcctttggaagattaagtgtaattggtttataatataaataggttccacctataacttaccatgctatccccactgttaactttattcaattgtaaatacaatcaaagtattatttttacctagagtatcgtaagtgccagcttcttagctgaatcctagaattttctgaagattcatcttattttcatgtagtttacctaattttaaactacacattctaccctgtgtcatcttgatttcaccgaagaaggcctataacttcccacggtttatcacttgtgttttcaaaatgatactatttcagccttctctagaaatgtcttatgtccttttaaggataaaataacatattttttcccaggttaaaacgcttttgatttctgataaattttggctctgcaaatctcatctcgaattgtaattccaacgtgttcctattgtgggagggacttgtaatcttcacgtgtcaagggagagaggtgattagatcatggggctgcttacccccgagctgttctcgtgatagtgaatgagttatcactagatccggtgcttttataactctgtggaaattcctcttttgtccttctctctctcctgctaccttgtgaagaaggtgcctgcttccccttccaccatgattgtaagtttcctgaggcctccccagccatgcagaactgtgagtcaattaaacctgtttcctttataaattacccagtctcaaggaagttctttatagcagtgtgaaaacaactaatacaatctccttgttatttcatccccaactatcttccttctttttcactataaatacttcaacagtaccataagttttcaatgtcaaaaaaaaaatgagataaccctacaattaggtgactaatcttaattatttttcactcaagtgattttcatctccattcccttttagttatttttacaatgtttctcactaaaaatcttataaccacccaagggttttctacttcagtatgttaaatttaaaaccctctctctctgtcatctcagctattatctttcaaagtgtctcacattttctataacaacatttcctgcccctttaggttcagaaccacaggttctaatttgaacttctctgtcaccggtttttgtctaatctcttatactctaatctaccctcacagaaagcctcttcagattgatatttaaatgcagaatccctgtttatacacctagaaactggaagaattggatagaaaaggccactccaggtctataacatgggaaactacaaagtcatgatctccaaaataacttgaaccattgacattccccttttagactttgcttaccattttgttcaaatgtctgaagaaaaacaaatgcaaaatgtcacccctgacttcaagattcctctatctctctacaacttcaccctcaataagtgctcctgattccaacctgatcaagaaaattaaacaggcatctcttccctaaattctcataggactccataggcacaaaatgttatcttgaagaagttttccctaattttcttctaaagcttgacttaaatatggattgttctgggatataaaacctggacaaactacatctcaatccacattatccaaaaaattaaaaagctatatctttgtcaaatgtttatgaatgtttgagattattaatttaacttcaagggtattcttatataaggacataataatcacagaaaagttttaggaagttatcttgaactaatttgatgactgaatttattggtaactttaagaataaatcacctagaagtttccttgatttagcaagtgtaataattttatgtaataatctgaaattgaaagttttcttgtagattataaaatgatttatataaaataatgaagtttatgcagatcatcatggcttctgatgttacattatctgaatacatcatccagagagtgttgttttcctgtttctaaagtgaaaaaataaaataagcagtaaaaagtgaataaatacaaatagtaaaatacataactgaatcaatagacactgagaaaaaatgattatcttatctgctttatatatattcttattaaaattatttcaattataaaaatgggaagataaagttaaaacctgtaaaattgtctaaataccacccaaaaatatgtaaacaggttatctggacaaataagtggcagagggacatttttttaccatagatacttttctacatgatatgggattttagctaaggttcatggatttagcacaaaaaagagcatttggtctttgcatttatctgcttttctaagattataatttaggttaactattcattaaaagtatagccaagcaaaaagatgaaattagcaaagattggattggcagaattattttcttcttccacatttaaatcataggcatcaattatgcagcactctgcccaggtttactaaataataagcagcatttttttggtcatcattgttttccttctaatttctcattcccatgctgtcaaaagctataaagaatcttttcttgccaatttttcctatgactatgaattccatctattctatgtcccggaattcctcctgtaaagaaaatattattaaaatgtttgcaacattaaaacaaatttttttctattcacaaagcaacagcaagagaaagtggaacagtgcagaaggcaataaatattctgagtctttcctgaaaatagctctttgtgctttcagccttcagttggtgcacctatgttaaagttatgttctaattaattactgaaattaaaaagtgagaatatgagacaagagatcaagtatttggaaaggtgttgtatttatggacctgccttcatgatgtcctctaggtttcattgtatgcatctgtgaagtaaggggtcctgtgtaccataaaaccttcaaatgaccttcaaataccattgttgcaaaaacctgattaataactagaccaaaaagcttctccaaaatttgtgaatgtctgtctctgtaaaattcactgaatcatcttttactttctcagattttgctttacaaaattttgacttaactgatgatctatgtggtttgtttgtttgtttgtgatggagtctcactctgtcgcccaggctggagtacagtggcgtgacctcggctcactgcaacctctgcctcctaggttcacgccattctcccgcctcagcctcccaagtagctgggactacaggtgcccaccaccacacccggctaattttgtttttgtatttttagtagagacggggtttcaccgtgttacccaggatggtctcgatctcttgacctcatgatccgcccacctccgcctcccaaagtactgggattacaggcgtgagccaccacccggccaatctatgtctttttaaaaattatcatcagtaaaacagtgcatttaaactctgtacaacatgagttttacctgcaagtgtccacttaaatgcaaattttcttctgcctctgccatccctgagtcagcaaaaccaatccttcctcttcttcctcctcagcctactcattatgaaggctgaaggataaagacctttatgatgatccacttctatttaatgaatactacatgtattttctcttccttatttattttttcataacattttcttttctctggcctactttattgtgagaatacagtagaatttttatatatcatacaaactatatgctaattaactatgtatgtcattgataaggcttatgattaactgtaagctattagtaatttaatctttggggaatcaaatgttatacatggatttttgactgtgctggggtcagtgttcccaacccctacactgttcaaaggtaaaatgtattttaaaagattttgtaaatacggttgttggaaaagttttccactatttgtaatttctttaaaaagaacacatgtaaaaaatgatctgcagcttatttttattttattttataacttgttcattttgaaatagagactatcaaacattttcagaaataacagaacacgtttttatataccttcattcaccttccccaattgttttaacatcctgcataagcatagaattcttagccaataaataaaataatattgtatcaagttaaagtaattgattagtaacagatattattaactattaactaatcaacacatttcagccatactgtactagttgtttgctagtctacttttcttacttttactaacattttcatgcaagatttcacattgcattcaattgttatgtgttcttaatctgctcccatggggaacaattttttgtcatgtgagaaaatgttcagtttctctttatctttcacgatgacacttgagaagtactggtcagcaattttctcccccgtcttaaaactggcttatagtcattgagagtaaaaagattgaaaaaaataagaaacattatgaaaatctgtcacattaagattaagaatcttcttcaggtaaaatgtgcattatcttgttcttatgctatgggttacccgtgaactcctcttttattctcccatttatgttatgtgagtaaagcacatttgacagatagagacttttcccttagttttttgttttgttttttacttttaaaaatatctacttgttctcatgctctttttctaaacaaaagaaaaagtaatgaaagttgtagcaaaagatggagaattgtatatccctaaagaattgtatatatctacattatttcattttgttattgcaaacataatattttgatagtttagttgttaatatatataaacatgaaatttgattgtcgggttgcttcatttaatatttgttaactttgaaatatagggtttgggtttcatgaacactaaagacactttcctttctaactctactaagcctttgtctacttagaaataattcctatgatgttagagttaatcctcgatcccaaaatggaaagtcatcaatatactatccaaatatataaccaacaaatttaatgataacattgattatcctattccttcactttagcattttaatatttttcttctgaacaataaaaatagtcaataaattggacactttagaaaatagaaatggtgtcaaccaaaataaaatcagaataggtaagatagataagtgttttgataaataggaaattagaaagaactttacacagtctccatataactgagaatttattttgggctcagaaacctgtgactggcataggcactttatgaaacaatattacatctgcaattcattaaaataacttgtgtttgtggctgggtacagtggctcatgcctgtaatctcaatactttgggaggtcgaggcagatggatcacaaggtcaggagattgagaccatcctggccaacatggtgaaaccctgtctctactgaaaatacaaaaataagccaaacgtggtagcacacgcctgtagtcccagctactcaggaggctgaggaaggagaatcacttgaacctgggagacagaggctgcagtgagccgagatcacaccactgcactccaggctgggcaacagagcaagactccatctcaaaataaataaataaataaatatcttttgtttgaatctagaagcagcatagggcaaatggtgtttagatctcgtaatgctgtttaatcttagtataaaagacaagttacaataaattataggcaaaataatattaatattataatagagattattcaattctacactgcaaaccattcctttttttttaagtgtcttaatttttttcttaaatacttctgttcaaagttttaagcaactatgttaattaaaattctacttcaatgattgtacttttccacattttcccaaaactatccttttgtctggaacatatgaagcaagttttatataaatcacatttatttgtttatattttatatgcaagaagctgtatcagtttaaagaatgatgggttagttttgactgtttatatgcctatgaacacattgccacaataaagatacaaaattttgctatcacccacaaaggttctctttgtcccccatgcagtttatattcttccctgtccccaaggtcaaggagtcaccaaaatgttatttcattataaagtgtgtttgctacggtctgcatgtttctgtatttctaaaatgtatatgttgaaacccattccccattgtgaggttatttggaggtagagcctctgggaggtaattaggtcattggagtgaagtgctcacaaatgagattagtgcctttaaaaaagagctcccagagagctgctgtgacagttaatattaagtgtcaacttgcttggattgaaggatgcaaagtattctttctggatatatctgggtgtttctgggtgttgccagaagagattaacttttgagtcagtggactgtgagaggaagactctttaggaagacctattcacaatgtgtaaggcatcataaaattggctaccagcacagctagaaaaaacaggcagaagcaggtggaaagagctattgacttgctgagtattccagccttcatttttctccctttctcccatgctgggtacttcctgcccttgaacatcagactccatgttctccagcttttggacccttggacttacacccatggtatgccaggggctcttgggcctttggccacagactgaaggctgcactgtgagcttccctgcatttgaggttttgggactcagactggcttgcttgctactcggcttgaagatggcttatcgtgggacctcactttgtgagtcaattctcctaataaactccccttctatgtacatctatcctattagttctgtccttctagaggctcatgactaatacagcggctttgccctttcctctaggtaatgacacagtgaaaaggcaccattaaggaaccagaaagcaggccttcatcagacctacagtctgtcggcaccttgattttggacttcccagcctccaaaactatgagaaataaatttatgttgtttataatctacctagtttatgatattttgttacagagccaaagcaggctaagactgcagtttctagaattttataaaaatggaatattatagtatatattcctttgtgtctgatttttctaacttagcataataatttttaaaatctttcatgcttttgtatgtgtcattggtgtattacttgtattactgagtacacttctattcacccgttggttggatttgattcaaattcccgtctactgtaaatcaagttctgatgaataaccggctccaaatctacgtgggaatatatgatctcctctgtcttggtggaatacttaggcatggaatgtcaaagttagagtgtatatttatatttgaatctttaatgaactgctgcatacttttccagagtggtgtaattccattttacaatctcgcctcagctgtgtaggaattacggttgttcttcattgttgttaacacttgatattgtcatgtttttgttgttctttttggcacttttgaagggcataaaaatggcatcctattgttttctcttaaattttaataattaatgatgttttcacataggcttagttatccattagtcttattttataaaatactattttgtgaattttttggggtagtagagtattatatataagatttttaaacatattctgaatacaataacttattcagatgtaagtggtgctacatgtttgctaattctgtggtttgccttattttcttaactatgtattttttagagttttaattagaaaaagcatattttttaaatttttattttattgtttattttttgttttcatgaaattgtctgataatgaaaactgtgaaaaaaaatatttgttttttaagctatccagtgagtggtattttacgatggcagcttctactaaagtaatttaatatattttaaagttatttgtgtatatcttgtttttttaattgatcaaaataatcagtgcttctttagtactgtttgttttgttaatcatagagtttactattagggtcaatgaatgttagcaggaaaagaaattaggattattattttatgtttaaattaaaattaatatgtttaatatgtttaaatgcctaacattcaagaaatagataccaatcaacttaaaatttaacaaggcacattaatttcccttggctggggaaaggctcatttaatgtgctaggggacaatcataatgagtcataagttatcttcagtaattaagatcataggtaacaacaaagataataaccttataatatttaatagaaagtatgcaagcattggctttttattctctatcatgtcattcattaacaggaaccacttacttattttttcttagtggtatatcctagatgtttgcattttgtattgcatattcaagtaaatgatattatttatagtgtagacttttgtttatgattgccccatttgagaacacacatttttagtaaaatatgaaacaaatttgtttaaaccacttgaagcctgggaatttcttcagctctggaatcagaaaaccaaatgtaacattctagagagactttagtgtatttatttgtaagagttatatagccaattgatatggtttagctctgtgtccccacccaaatcttatctcaaattgtaatccccatgatccccacatgtgaagggagggactaggtgagaagtggttggatcatgggggcagattcccccatgttgttcttatgatagtgagttcttataagatttgatggttatttaaggcagttttccctgctcttgcttgctgtctttcgtctgccaccatgtaagatgtgcctctttagccttcggccatgattgtaagtttcctgaggtctcctcagccatgcggaactataagataattaaaccttctttgtttataatctttatagtagtgtgagaatggactaatacaccaattaaacgatattacaaacaatagtccaagttatataatattgtgttgtttgtgacaaaacagtttttggggatcgatatttcatgttctttataaaatggttttataagttatcattctttttctatgcctggaaatagttaatagcactgcgattatcatattttaaaagatttaatagaatttccatgtgagacaaccttgctgaaagtaatatttgtgggagatttttcattgtgttctctatttaatgtattatgtatagttggcttaaattatttctcaagttagcttagtgttttgaatttttaaaatttgtaaaaacataaaattctcttacttgagctttacaaatgtatttacaaagaggtgtgtaaaattcattcctattttgtgcaattttgtgttctttgttctcgattaattatctagtatatgtcattatgtttgatttttcaaataactagttttttacaagtattttctagttatgctcttttttattccctgaattcactagtgggcactggtataagtcccaaagtccaaacacctgagacccaggagctcctatgtctttgtgtaggagaaggtggatttcccagctcaagaagagtgagagaacttgcctttccttcacctttttgttctcttagaggccccaaaagtctagatgatgaccacccatattggtgacaacagatctcctttactcgtcctactgatacacatgctaatctcttctggaaacaccctgatggacacacctaaaaataatgctttaccaggcatctgagcatcccttaacccactcagattgatgcataaaattaactattgcaggtatgctcaagaatcaaaagattaaacaaaataaggaataaacatctaatgaaagattgccaataaaaaagaatgaactactcatgcatatggcaacatgaatgaatctcaaaattattacacttaatgaaatagtcagaaaaatagagtactttctgtttcaaaaaatataaagtaatgtaagtggaagccaatttattgtgacatcagtggttcctaggtcaagaattggagagagggagggatgcactacagaggacatcaggaattttgggaggtgttgaaaattttctgtatcttgactggataactagctacaacatgtgaagctcaactctctactgcatacctaatttaatgtgacttttgaaattataatgagccattactattaggaaggatcctcgtttctgttgaataggtattgcacgtgctttacatgccacacatgcaagagtccgagtaagctgttctcattgccctgaaatggaggcatactgctcctttcttcctataattttgctaaacaggtgacacttttatgtatacacattcacttcagaaatattcctagcattctggtataatagatttcaacttaattttttcagatcctattggaatcagctctagatgatgagataatatgagtgataattgtaatctttctagttttactacttccaagagttaacacgaacatattaattttacagttacagaaaaataatatataatggctgatcacagttaggaatgtgaactacttttggatcctttcaatgtgagcggccgaggaggtttctttttaggcacagattactcttaatgtgtcattgatgagactctggtttctgagtctaaggtggtggcatcataataaggtctctggttatttcatgatgtagtatacataatgttcatattgatttggtagctcagtgagtatgagttttcaggtggattgattagtgatctcagttacagagaacttgagaaagttgagtcacatataataaagcagggttctagagggaaaatcccaggatagccatagcaatatttggtgttagatgaaggtgaatgtatcatgtgtgtttctgccttattccaccatctcagactcaaatacctactggtacctacagggatcaagcagtaaaaataaatatatgaatgaactagctgtaacataatagagagctgtatggcctgtggtgaaccagagaaatgatactttttaaatgacattcaaatttattgtttctatcaagactgtgtagatagaatttaatccacggtatgtcaatttacaagcccctgttacactgccataaaaaggagtcaaacaatgtaattctgtcacacatgtacaattcattgactactcagtgccttctcctacatgcccataagtacttatagtaaagaactgtctctctttgagctcattgtgtcctcattataaaagttagcataattatttattattatcagttttaattttcatcaatcaactttatctatatagttatttacttattacaaaataactgatctgataggagatcaaaggaagaaaaattgagagtagattttatgcctagcagtcatttcctcaactcctattttataaccaattgcaatacatgtagctctgagctctctgttccattgaaactgctctttctaaaagaatgtatcacttttgaatggaaacataatgtctctatgaatacactgatcttctagacttctctgatgcaagtgaaaataatgatcactttcacttttgaattcccaacttcttgtcatttggattttggttcagcctccaacatctaagcattacgtatcccaggttccctactgagacacttctggttctccatatttaaaatttggaggtttgatttcttctgagatcccaactactattaatatccacactcatgactcttagacacttgcatcttaatatgtcaaaaatgtaatggcttcacttctgcacatctgtttacatttatatcacctgtctctatgcaaagtggtaaaaccccatataatttaactgaagtcaaaagtaacagggtaaactatgatctcacctgcttgaactgatttcacattttaatttcatgtatatttttgttggttagctattcatataagtatatatttcacatcttatcttgaaaaactacatctatagaactatatttgatatctctgattttaaaaatagtcaatattttttattatcccatatgcattttaaaatctcacatatttgtttattactagccttaatgcaatactttcaaaatattcagggctttgcatatccaatatatttttaaaaccttgtttgtttttttcattttatagattatattacatcttttaacgagaatagttataataatttaaaacctactgatgaactacatcacctttaattctctaaacttttaagctaaagtgtaagagtttaatatcagttaaattctttttcctgactttggaataactaactttcataggtatggaaaaagcaaagaaaactaggttaataaaaatactacaggactgtttctatcttaaaccacttgtgatattcatcgtccttttgtcctaagaaatggagtaaccgctcaaacttcaaagtacatgtgtcaataaagaagacatttccaagtaagatagaaactgctccttacctacgtttgatctcacctactcacacacaggtcttagaagccaaatgtgaatgttaaaaatcacccatcacagatttatgcatgaaaataaatttgaaatcagacagccttgcccactgcttatatgtggatgtctgactttgatatacaataaactccttacaatatttccatacattttctattgtaaaccaattctatacagcagaaaaataacttttaaagctccacagcttatgaggcatttctaaaatagaaaatgaagatctagaaatgtttcaaaacactacactgaaaacaatgaaccctaggtatcaaatttacatagttgatgtcaaggtgtatagaccttggaagatatttttgcatgaggtcagagataagatcaatcagggaatgtagagttaagcaaaaatgtgcttctgagaaaagaaccataaagctagttaagaagcctgagtagaaaattattcctacagttatttgaaccatgttatgacaccagtgcaactaaagactacaaggagatctgctcttttgggcacctcgaagtttttaatgcttggaaatatgatgcaacaacagcccacttcagatgtgttctgggtgtgatgtgaatgagcagagacggctggtggaaaacattagaaaaccaatggtcatgtcgctgtgctgtggaaatgtcttgtgggtaaacatggaaagaatgagtaatcaccagtccttgtaaattatggacttattagcaagaacacaaaataatatgctaatatctgccaaaaataagtggatacaaagtctatgaaataaagggaatagactaagtatgtttttcagagatattcattgctttcttggtaacagcaaaatcttggaaaccaaaatcttcattaaaagaagagtggttaggttaatgatgagttaataaagagactattctccattgccagtttaaaaaaaatgtaccttggtatgaaacactctttaatatatgttttaagtaaaaaattaatttataaagctttacaaaaatcacatttatatatatgtgggtgtgtgtatgtgtgtgtatctatctctctatctctctatctatctatctatctatctggcatatgtattgatatagattggatagttgtcccttaccaaatcgcatgttgaattgtaatccccagtcctggaggtggggtctggtgggaggtgtttgggtaacagggtgtattagtttgttttcttttttttttttttttgagacggagtcttgctttgttgcccaggctggagtgcagtggtgtgatcttggctcactgcaagctctgcctcccaggttcacgccattctcctgcctcagcctcccgagcagctgggactacaggcacccgccaccacgccaggctaatttttttgtatttttagtagagacggggtttcattgtggtctcgatctcctgatcttgcgatccgctcacctcggcctcccaaagtgctgggattacaggtgtgagccaccgcaccaccgggtctagtttgttttcatactgctgataaagacaaaccccagactgggcaatttaccaaagaaagaggtttaatggacttacggttccacatggctggggaggcctcacaatcaagacagaaggcaaggaggagaaagtcacatcttacatggatgtcaggcaaagagaaagcttgtgcgggggaattcctctttttaaaaacgtcagctctcatgaggtttattcactaccatgaaaacagcacaggaaagacccgcccccatgattcaattatctccccctggatccttcccacaacacttgggaattatgggagctacaagatgagatttgtggagagaaacagagccaaactatatcattccacccctagccccttctaaatctcaggtcttcacacatcaaaaccaattgtgccttcccaacagttccccaaagtcttaactcatttcagcattaactcaaaagtccgcaatccaatgtctcatctgagacaaggcaagtttcttacacctatgagcctgtaaaatcaaaagcaagttagttacttcctagatacaatggaggcataagcattgggtaaatacagccattccaaatgggagaaattggccaaaacaaaggggctacaggctccataaaaatccagtacccagaggtacagtaaaatcttaaagctccaaaatgatctcctttgactccatgtctggcatccaggttacactgatgcaagaggtgggttccatggtcttgagcatctttgcccctgtggctttgcgaaatacagccttcccccacactggctgctttcacaagctagggttgagtatctgcagcttttccaggtgcacggtgcaagctgtcagtggatctaccattctggtgtctgaaggaccatggccctcttctcacagctccactaggcagtgccccagtggggactctgtgtgggggctccaatctcacaattcccttctgcactgccctagcagaggttcctcatgagtgcctgactcctgcagcaaacttctgcctggacatccaggcatttccatacatgctctgaagcctaggtggagattcccaaacctccattctgcccacaaaaccacttttacctcctaggccctgggcctatggttctgggtaggggctgctgtgaagtcctctgacagtccctggagatattttccccattgtcttgggaatcaaaattcagctcctccttacttatgcaaatttctgcagttgacttgaatttctcatcagaaaatgggattttttttctaccatattgtcaggctgcaaattttccaaacttttacactctgcttcccttataaaactcaatgcctttaacagcacccaagtcaccatttgaatgctttgctgcttagaaatttctttcaccaaataccctccatcatctctctcaagttcaaagttccacagatctctagggcaggggcaaaatgccatcagtctttttgctaaaacataacaagagtcatctttgctccagtttccaacaagtcccttatctccatctgagaccacctcagcctggatttcattgttcatatcattgtcaacattttggccaaaacccttcaacagcagtttctcaattgttccaaaattggaactctagggagttccaaactttcccacattttcctgtcttcttctgagccctctgaactgttcaaacctctgcctgttatccaattccaaagttgcttccacatttttgggtatcttttcagcaatgctccattctactggtaccaatttcctgtattagtttgttttcacactgctaataaagacatacctgagactgggtaatttatacaggaaaaaaggtttaatgggctatcattccatacggctggggtggtctcaaaatcacggcagaagatgagtagaaagtcacatgttacatcaatggcagcaggcaaagagagagcttgtgcagcagaactcctctttttaaaactatcagatcttgtgagacttactcactatcatgagaaagcccaggaaagaccagctcccacgattcaattatctctcactgggtccctcccacagcacatgagaattactggagctacaagatgagatttgagtggcgacacagagccaaaccacatcagggtggatctctaatgcctcagtgctgtctttgcaatagagtgttcttgtgaaatctggtcgtttaacagtgtgtggcaccccctcccattctctctctcacttgtccctgttttcaccatatggcatgcctgcaccctcttcaccttttgccatgattataagcttcccgaggcctctctagaggaggagcagatgccagcactacgttttctgtaaagtctgcggaactgtcaaccagttaaaactttttttctttttaaattgcccaatcttggatatttctttatagcaatgcaggaatgtcctaatacagaaaatcttatcaaggattggggcattgcaataatggtatttgacaatgtggaagcaactttggaacgggttgaaagagttttgagaactcagaagaagataggaagatgagggaaagttaaatggttgtaaccaaaatgttaattatgatatggacagtaaagtcccagttgatgaggtctcaaatggaaatgaggaacttattgggaactggagccaacatcacacgtgttatgccttagtaaaaaatgtggctgtattgtgtcaatgccctagagatctgtgacagtttgaacttgggagtgctggcctagggtatctggtgaaataaagttcttttattatttttaattttaattttaatttttttttgagatggagtctcactctgttgcccaggctagagggcaatggtgcaatctcggctcactgcaagctccgcctcccgagttcatgccattctcctgcctcagcctcccaagtaagtgggactacagggcctgccaccatgcccagctaatttttttgtatttttagtagagacagggtttcactgtgttagccaggatggtctcaatctcctgatctcgtgatccgcccacctcagcctcccaaagtactgggattacaggcatgagccactgcgcctggccagaaatttctaagcagcaaagtgttagtgttcaagatgtgtcatggctgcttctaacaacctaaatccagatgccggagcaaagaaataacttaaaattaaaatttatactcaacatataaagagtataaaagtttggaatattcgtagcctagccatgtagcagaagaaaaaaaaaaatcttttttgcaagaagaattcaagcaggctatggagcaaccacttgc

SEQ ID NO: 572 - DNA, 95403 bp, Homo sapiens
cagtgccatgcttgtatggcctgcagaagcatgagccaattaaacctcctttgtttataaattacccagtctcagttatccctttatagcaatgcaaggatggcctactgcaatgaaggccattcttccattgctatatgtataccttattagaataagaagctatagataagataactagccagaagacagaagcagataagcccacgtactcatagaggagggaggaagtctggtttcacagtgagtgatggtataaagcccaccttcatccattccaaggcagaagactgccatggtgtctggcagagaagggcccatgaaacacctggaaaaaacctgatgagggacatgttcttagtttgggactgagtgtagggtgttctatccaactttgcctgggctcaaggagcagcagctttctcaacaaaaggagatgtgtttaccaacacatactcttcagcaagattaactgttctgcagggaatgcatagcactgatgatcacattcctcattcttccaggaaatagggctaaaagtatatgtgtgtaggactgtgaggtgaagctgaaattcaagcactgaccccagaaaaaaaaacttcagtggattagcagggttccctccatactgtcattgtttctttcccgggatgatgatctagaaccaaggttggagtcctgaagcattttcaaccactggcttctgctccttttctctccattcaatctccattctcataccaaggagacaagaaagtcattcagtatggataaacatctcctctagaatacatttctgggttgttaagagaagttatgaagctttaagtgactttgaaaaaatgcaaaatattatacagatcttagttaatttttccacttcacagcttaatagaaggtttttccttctcttttaaattggtcatggagtcagtctgtaaaaagttcactgatcattttatagagaaataggagagcaaactggttaatgactcgctcacggtcttacacagagataagggtagaatcgaagtctcttgatttctgaaccacttttttgtgccctactcaatatttggctgccaatattataattgctaatatctccataacactggagcatcagcttatacctgtacgagaagcttcagtggtcttctgcctccaggcaaattgctatcaaatcttcttaagatcttaaaatctttatagaggctctgaaagaaaggtaacctgatataatggaatggccacaaatttcagtcaggcagctatttagaatccaagctgtcactcactaactctgtgtctcagagcaaataactaagcttctgggatcctcagttttttatttataaaatgaggatagtaatacaccaaagacttggatttcttaaattaacattatttctaattgaaacattaaaattgaatatatttaatgggatactatttgatattttgctatatgtatacactgtgtaatgattcaatgaagccagttaacatatctatcactttgcttacctatcattttttatggtgagacatttgaaatttatttttttcattgtgtttgttagtttgtttttttgagacagagtcttgctctgtcgcccaggctggagtgcagtggagcagtggtgcaatctcggctcactgcaagctccgcctcccgggttcacgccattctcctgcctcagcctcccgagtagctgggactgcaggggcccaccaccacgcccggctaattttttgtatttttagtagagacgggctttcactgtgttagccaggatggtctcaatctcctgccctcctgatccgccagcctcggcctcccaaagtgctgggattacaggcgtgagccaccgtgcctggccttttcattgtttcaaaatatacattattacacgatagtcatcctgccatgcaatagttcccaaagcttatttttcctgtccatctgagactttgtatcctttgatcagccactccctatcccctccctccctattgcccctcctcccagcctctggtaaccattattctattttctacttctgtgaattcaactttttaatatttcacatgagtgagatcattcagcatttgtctttctgtgcctggtttgtttcacttagcctaatgtcttccaggtcattaatgttgtctacaaaatgacaggaatttcttctttttaaaggcttagtacattgtgtatatgtaccacattttctttattcatttatcactgatagatgctgcaatggacatggaagagcagatatccttttaatatattaatttcagttgccatggatatgtattcacaagtaggattactggatcatatggcaacttgatttttaatttttggagaaacctgcgtactgttttccataatggctgtactcatttacattcccactaacaatgtaccatagttcccttttctcttcattcttctcaacacttttcttttgtctttttgataaaggccatactaacaggtgtgagttcagatcttattgctgcattgctttgataattggtggtgctgagcatttttttcatgtacctgctataccatttgtatgctttcctttgagaaatgtctgttcagtttctttacccattttttaattgggttatttgttttcttactattgagttgtttgaattatctgttttgaatattaaccatttatcagatgtatggtttgcaaatattttctcccattctgtggattatctctttattttgttaatcatttcctttgctgtgcagaaggcttttagtttgatgccatgccatttttctactgttgttctgttgcctgtgcttttggagtcatattgaaaatgtccttgtccagactaacattgtggagctgtcctcttacgctttcttctggtagctttacagtttcaggtgttatatgtaagtctttaattaattttgaattgtatttctgtatatggcatgagataagaatccaattttattattctgcatgtggatgtccagtttttcaacaccacttattgaagagaccatccattccccattgtgtgttcttggcacctttttcaaaaatcacttgacctttaatgatcttacatataagaaaaccctgacgactctaccagaggactgttagaactgataaaccagaggacctttagaactaataaacaaattcagtaaatgtacaggatacaaaatcaatcaacataacaaaaattagtagcatttctatatattaataataaagtatccaaataggaaatctcatttaccatagcatcaataacaaaaatacttaggtataaatttaaccaaggagatgaaagacctatatactgaaaactataaacattcatgaaaaaaattgaagaaaacacaaataaatgaaaatatatcccatgttcattgattagaagaaaatgttgaaactaccaaagtgatctacatattcaatacaatcccaatctaaattgtaatgtcatttttcacagaaatagaaaaaaatccttaaatatatatgtaaccacaaagacagacctcaataaccaaagtaatgttaagcagaaagaataaagctggacggtttatactctttaatttcacactgtctgatttcaattctaatcaaaacagtatggtactggcataaaaacagacatttcaactaatggaacaggatagaaagcccagaaataaaccaaagccttgttttgataattaattatgatgctgtatatagagtgtaagaggtagagaataaataactgctgattaataattattattattatcaaaagaaagttgcaaaatgaagtggcacttaagttgataaagaggtaagatgaagttatgaactgaaaggttaaaaaacaaacaaaaccctggatacaaatagatatgtatatttgatagtgaatgggtaactggaggctactttggctaaaatagttggcaaaaccaagttttgccattgaaagtaatagcaaaaaccgcaattacttttgcaccaaactaatacaaccttgaatcttttttcatgtcttattttgatgtggtatttttagtagatagtaccaaaaattttgaaaatttgtcttcaataagttagaaaatgataaagagtagaaggaggagaaagatcaagttagggaaaggaggtgtagattgtactcagtatatggagatatatgagcccctcagaacaacttgtacataagacttttgaaatttaaaatgaaatacagaaatactgtcatgacagtgtccatagcattacctttttgtcttctcgtcctcgtagaaaatatgtctgcaaatcagtgcccttgtgtaaaggaggatcttagggagatcattggaagatcccagataataccctggccaggtacactcactcccggagtccaacactctcatccctattccacctatgggaaagctgaagcaaagaatgacttcccaccaccatatggtcagaatgtggagtaaccaaagaataagtcttcagatccatcatggtccatgctccacatgcaacatttgaccacagtaaactttcaaaagctcgtgaatactatttccaaatgaacaaagacacttttggtaaaggggccactcaggcagtggttttcttctaactcctttttgaagtttcctttccatccaattcatgctccttccagtaaaagacaaatctagggtttgccttgaatggctacaatctccatcaagtatgtgatactgttttcctccactgcagcacagttggccttgctaatgagaccctagagggagagttcatggttaccggtgcctctctcaccctggttgtttattacaacccgactttaaagcttcagagagtttattaccatatgttccatttccctttttagcactgtttgggctctgtgtacagagaaaaagtacttcctacagtcaggctgtggcaatttttagatgacgacaagctatgaaaagaactctgagcttttttaaagacactgtctagaggagatcattctcatttacatgaatagctatgttccagtacacacagatatatacatgttaaaaggtctgtcagctagactgggcagactcacactgtcagcctcaataatattaaggcaacctgcctgggttttggttgaaggaacctctcagatggtcataatgttttcttgcagctggagaaaagaaatagatgctgcaaattaacttcttgtttgtttttcctggagataattttacagtagaactgacattagcaaagaatttctcctgcaaatcctattctctgatgtgaaagaaaggtttgtagaaccaaaatccttcaaatgttatcccttaaagcaccaataattttatttatagcctgttttatgaaatgtttcacaagagtgactcgtgtttatatttcaatatgctgaccacctccacatgccatgtaacatgatcaaacttactataaaaggcttacatagaaatatttataccacaggcagaaaaagactacagaagcttataaaaattaacttgccagtgtagaaataaaattaaataacagcttacatatagttattctaaaactcataataatgcttttttccagtttgtagtcatgagtctcaaaggaaaatcccaaagtttccccagtttccttagcaacagaatcaggtataaattgtgctcctatatttccaaacatctgtatctaagcaacacattaaaatgtgcttccaactgatgtatgtacagtctgtaggtgagcttgactttacagaaagaagttaaaagtaaggaaatcaagaggcataaaaaggaaaagcaaaataaaatcatgaggaaaagcattacagtttcccagcttgtttgttactcttattttctgttcaattaaaaaaatgatgggcaggctactattgtttaataaattactaatttttaggggaatttatagatctgggttaagtgacatactttactagactattccatggctagctcttctattctgaaaggaaattcaagaaagtttcctggtagtcatccgaaggctattcttggcaagtaaaagataattataaaggcccaaagcactgattgtgagtaagaaagactgtgaaatagtgaactcattaggcaggtctataagagtaatgtgttaactgttctaaaagaaactcttgtattctgatctcagatctacttacactctcagcccaatctttcttcaacaaatccaggagcttaaggcattgatgggaaattctgcctagaaattcatatgcactgcagattaagcacttccaggccatggctagaccccaaacttgagggcacgtaccagctctgtgcccttagacaatgtttttatattctctaagacttagctgccttatctttaaaacaggaataatagggaggaggaagaataggtagtaattgtttaataggcatagaatttcatttgggaagataaagaaaaaatatggaaatagaagatcatcctacagtgttaatgtacataagaatgccacttaaaatgaataaaattgcatatattatgttatgtatattttatgacagttttttagaaaaaacacaagaataaggatattatcacataggattgttttgagaattacatggaagaatgaacaatttgcatggtgcctggcacacagtatgtccttaataagtggtcattattactgttataatctacattagcattaataaaaatggactcttgggcccctacaagagtcacaaccattatcagtacctaccatttgcaatttcaccactttctcctttccactgcaccagtcaccttcacgccttgttcctagtccatcttttcactatgtccctattctaagtgtgtactctctcagaccttctaatatcaggcacagtcatcatagaagtccaaaagatgtgtaggactgtcaagcccttttactaaaattgcatataaaagcaatcctaaaaggaattttaagttcagctgccagttaaaaacaaatctttactgtgactctaaagctctaatagttgcaaggccagccataggtaaaacagcaaaatgaaatttgatttcggtttcctcctgtcctttctcagatgagaatagtgccaaggagcacttcagggtttagagtgattgtcacaggtgtcgattcattcatttcatcctcctaaggtgatagcccaggaatagtcactccaagactgttatttctgaccctataacttgatggtatcctgtggcctttttacacccttgctgcctagtaggatccatcctctaagtcctctgcctttctccaaacacttacaaatataaattgttagagccagaaagaatattggaatgtttttcagtccatgccctcattttacaaataaaaacttgaagcccaacatggttaagaaaatgtttgcctggtcactgtctttggccacagcccctctatttacaacttattattcaacttctcagttcaccagttacccctattttctcactatccattagccttctgttatcttcaagtcctcttcttttagggttagatttcaggaccaacatactagccaatatttccagtgttctaaactcccatgccttatatactgcagggaaaacttcaaacttgaatgagtccaaccatctgatgtccctaaacctcatccagacgactggaataaagccatttaagaataaaatagtgatctcactcaaggtttggggtctctcatctcactagacctttaacactgcccagaaatcttgctcttcctctgatcagctcaatctcccttcttcaattcttgtctcagtcttcgtatgtcctccataaaccttcacccctctcacattgccagcaaatgtccttgcctcctacttttcagagaagataaaagccatcagacaaaatacccactcatttgcatactctaaaattcatgcaacaagcaagtatctgcatccatgctgtcttccattcctctgcagcactagaagggccatctctcctatccaagcctgccttccacacatctgccctagatcccaacatctccagtcttcttagagaacttgcactgtcaattattccctctcttctgtaactgcatttttgcctcacaacttattatttctaatttgcatttatttatgttcaaatgtctcccacctttaaaaatgaatttctccctctatccatgcctcccttcaattcttagtctgtttcctctcacagtccaaattctcaaaggagttagctgcactcgttctctcatttcttactgctcactcagctttgcagcccagtcctatttcatgtctgcccttattactcttccaaaattgttctctcaggccaacagccaaagccttacagggctttatattcattcttcagttccatcttgcttgatctctccagagcatttgacactgttgacccctacttccttcttaaaatactcctcccttgatttccttatcactactctgtcttgttttgtctgcaacttcactggtcactggtccccagttttcttggctagctgccccactttacccatacagtaagtgttagagtgcctctgggctttgtcctggactgttttccttgagctgaaatcatgctgctgtaaagacacatgcacacgtatgtttattgcagcactattcccaatagcaaagacttggaaccaacacaaatgtccaacaatgatagactggattaagaaaatgtggcacatatacaccatggaatactatgcagccataaaaaatgatgagttcatgtcctctgttggaacatggatgaagctggaaaccatcattctcagcaaactattgcaaggacaaaaaaccaaacaccgcatgttctcactcataggtgggaattgaacaatgagaacacatgaacataggaaggggaacatcacacactagggcatgttgtggggtggggggaggggggagggatagcattaggagatatacctaatgttaaatgacaagttaatgggtgcagcacaccaacatggtacatgtatatatatgtaacaaacccgcacgttgtgcacatgtaccctaaaacccaaacttaaagtataattaaaaaaagtgcttcttgtttttttcccattttttaaaaaattttaattaatggtcttattatgccctcagttgttcaatcaaaatttatggaaggcattcttacttctctctcttctttaatcccatgttaactccaagtcaatcatctattcattgagacaattgagtatctactatgttccaggcacaattccaaacaatcatctttaatctattctgttaacccattttgttacctaaatagtgattaaatttaccagactctctcttccaacactcccttcatgaatactccaggccttagctaaactactgccaaaaccacctaactgactgcctgacatccacccttttttaattcctctctttagtatttctccttgctatgaacaacttttcattatgaaaatatttaaagagctttaaccatgaatgatgaacatgcatattcattccacttctttttgtttgtttgtttttttgagacagagtctcactctgtcaccaggctggagtgcagtggcacagtctcagctcactgcaacctctgcctcccgggttcaagcgattttcctgcctcagcctctgagtagctaggactacaggtgtgcaccaccatgcacagctattttttttttttgtatttttagtagagaagggattttaccatattggccaggatgatctcgacctcttcaactcatgatcagcctcccaaagtgctgggattacaggcgtgagccaccttgcccagcctcatttcacttctattccacagttgttaatattttattatatttgcttcattttactccttttatacatcgtttgtatatattcacatttttatgtgtactatttaattttattttacttattttttttcttttttttattttattattattatactttaagttttagggtacatgtgcacaatgtgcaggttagttacatatgtatacatgtgccatgctggtgtgctccacccattaactcatcatttagcattaggtatatctcctaaggctatccctcacccctccccccaccccacaacagtccccagagtgtgatgttccccttcctgtgtccatgtgttctcattgttcaattcccacctatgagtgagaacatgaggtgtttggttttttgtccttgagatagtttatggagaatgatggtttccagcttcatccatgtcccaacaaaggacatgaactcatcattttttatggctgcatagtattccatggtgtatatgtgccacattttcttaatccagtctatcattgttggacatttgggttggttccaagtctttactattgtgaatagtgccgcaataaacatatgtgtgcatgtgtctttatagcagcatgatttatagtcctttgggtatatacacagtaatgggatggctgggtcaaatggtatttctagttctagatccctgaggaattgccacactgacttctgcaatggttgaactagtttacagtcccaccaacagtgtaaaagtgttcctatttctccacatcctctccagcacctgttgtttcctgactttttcataattgccattctaactggtgtgagatggcatctcactgtgcttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatactagccctttgtcagatgagtaggttgcaaaaattttctcccattttgtaggttgcctgttcactctgatggtagtttcttttgctgtgcagaagctctttagtttaactagatcccatttgtcaattttgtcttttgttgccattgcttttggtgttttagacatgaagtccttgcccatgcctgtgttctgaatggtaatgcctaggttttcttctagggtttttatggttttaggtctaacatgtaagtctttaatccatcttgaattaatttttgtataagttgtaaggaagggatccagtttcagctttctacatatggctagccagttttcccagcaccatttattaaatagggaatcctttccccattgcttgtttttctcagatttgtcaaagatcagatagttgtagatatgcagcgttatttctgagggctctgttctgttccattgagctatatctatgttttggtaccagtaccatgctgttttggttactgtagccttttagtatagtttgaagtcaggtagtgtgatgcctccagctttgttcttttggcttaggattgacctggcaatcagggctcttttttggttccatatgaactttaaagtagttttttcgaattctgtgaagaaagtcattggtagcttgatggggatagcattaaatctataaattaccttggccagtatggccattttcatgatcttgattcttcctacccatgagcatggaatattcttccatttctttgtatcctcttttatttcattgagcagtggtttgtagttctccttgaagaggtccttcacttcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagacatacaatcatgtcatctgcaaactgggacaatttgacttcctcttttcctaattgaatacccttgatttccttctcctgcctaaatgccctggccagaacttccaacactatgttgaataggagtggtgagtgagggcatccctgtcttgtgccagttttcaaagggaatgcttccagtttttgcccattcagtatgatattgactgtgggtttgtcatagatagctcttattattttgagatatgtcccatcaatacctaatttattcagagtttttagcatgaagggttgttgacttttgtcacggtcttttctgcatctattgagataatcatgtggtttttgtctttggttctgtttatatgctggattacatttattgatttgtgtatattgaaccagccttgcatcccagggatgaagcccacttggtcatggtggataagctttttgatgtgctgctggattcggtttgccagtattttattgaggatttttgcatcaatgttcatcaaggatattggtctaaaattctctttttttgttatgtctctgccaggctttggtatcaggatgatgctggtctcataaaatgagttagggaggattccctctttttctattgattggaagagtttcagaaggaatggtaccagttcctccttgtacctctggtagaattcggctgtgagcccatctggtcctggactctttttggttggtaagctattcattatttccacaatttcagatcctgctattggtctattcagagattcaacttcttcctggtttagtcttgggagagtgtatgtgtcgaggaatttatccatttcttctagattttctagtttatttgcatagaggtgtttttagtattctctgatggtagtttgtatttctgtgggatcagtggtgatatcccctttatcattttttattgggtctatttgatttttctctcttttcttctttattagtctggctagcagtctatcaattttgttgatcctttcaaaaaaccagctcctggattcgttaattttttaagggtttttgtgtctttatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataagtttccctctacacactactttaaatgtgtcccagagattctggtatgttgtgtctttgttcttattgctttcaaagaacatctttatttctgccttcatttccttatgtaaccagtagtcattcaggagcaggttgttcagtttccatgtagttgagaggttttgagtgagtttcttaatcctgagttctagtttgattacactgtggtctgagagacagtttgttataatttctgatcttttacatttgctaaggagtgctttacttccgactatgcggtcagttttggaataagtgtgatgtggtgctgagaggaatgcatattccgttgatttggggtggaaagttctgtagatgtctattaggtccacttggtgcagagctcagttcaattcctggatatccttgttaactgttaactttctgtctcgttgatctgtctaatgttgacagtggggtgttaaagtcacccattattattgtgtagaagtctcagtctctttttaggtctgtaaggacttgctttatgaatctgggtgctcctgtattgggtgcatatatattttggatagttagctcttcttgttgaattcatccctttagcattatgtaatggccttctttgtctcttttgatgtttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctatccatttgccagtctgtgtcttttaattggagcatttatcctatttacatttaaggttaatattgttatgtgtgaatttgatcctgtcattatgatgttagctggttattttgcttgatagttcatgcagtttcttcctaccatctatggtctttgcaatttggcatgtttttgcagtggctggtatcagttgttcctttccatgtttaatgcttccttcaggagatcttgtaaggcaggcttggtggtgacaaaatctctcagcatttgcttgtatgcaaaggattttatttatccttcacttatgaagcttagtttgcctggatatgaaattctgggttgaaaattattttctttaagaatgttgaatatttgcccccactctcttctggcttgtagagtttctgccgagagatctgctgttagtctgatgggcttccctttgtgggtaactctacctttctctctggctgcccttaacattttttccttcatttcaactttggtgaatctgccaattatgtgtcttgcagttgctcttctcgaggagtatctttgtggcgttctctgtatttcctgaatctgaatgttggcctgccttgctagattggggaagttctcctggataatatcctgcagagtgttttcaaacttggttccattctccccgtcactcaggtacaccaatcagacgtagatttggtcttttcacatagtcccatatttcttggaggctttgtttgtttatttttattcttttttctctaaacttcccttctcacttcatttcattcatttcatcttccatcactgataccctttcttccagttgatcgcaccggctcctgaggcttctgcattcttcacgtagttctcgagccttggctttcagctccatcagctcctttaagcactttctgtattgattattctagttatacattcacctaaatttttttcaaagtttttaacttctttgcctttggtttgaatttcctcctgtagctcagagtagtttgattgtctgaagacttcttctctgaacttgtcaaagtcagtctccgtccagctttgttctgttgctggtgaggaactgcattcctttggaggaggagaggagctctgctttttagagtttccagtttttctgctcgttttttcccaatctttgtggttttatctacttttggtctttgatgatggtgatgtacagacgggtttttggtgtggatgtcctttctgtttgttagctttccttctaacagacaggaccctcagctgcaggtctgttggagtttgctagaggtgcactccagatcctgtttgcctgggtatcagcagcggtggctgcagagcagcagattttcatgaaccgtgaatgctgctgtctgatcgttcctctggaagttttgtctcagaggagtacctggccatgtgagatgtcagtctgcccctactggggggtgcctcccagttaggctgcttgggggtcaggggtcagggacccacttgaggaggcagtgtgcgtgttctcagatctccagctgcatgctgggagaaccactgctctcttcaaagctgtcagacagggacatttaagtctgctgaggttactgctgtctttttgtttgtctgtgccctgcccccagaggtggagcctacagaagcaggcaggcctccttgagctgtggtgggctccacccagtttgagcttcctggctgctttgtttacctaagcaagcctgggcaatggtgggcacccctcccccagcctcgctgccaccttgcagtttgatctcagactgctgtgctagcaatcagtgggactccatgggcataggaccctccgagccaggtgtgggatataatctcctggtgcactgttttttaagtccgttggaaaagcacagtattagggtgggagtgacccaattttccaggtgccatctgtcagccctttctttgactaggaaagggaactctctgaccccttgagcttcctgagtgaggcaatgcctcaccctgcttcggctcgcgcatggtgcactgcacccactgtcctgcacccactgtctggcactccctagtgagatgaacctggtacctccgatggaaatgcagaaatcacccgtcttctgcgtcactcacgctgggagctgtagactggagctgttcctatttgaccatcttgcctgcccctatttgtactattttaaagtaaattatagatttattgtatctatctatatctttctaaactaaggtgagttttctctggtgcagtcttgaagataattccttctttggaaaacctcagtctttgctcttaagacattcaactgattggatgatgcttacccatattatgaaggataatctgccttactcaaactctactatttcaaatgttaatacacctgaaaaaaaaacacaaaacaacaaataaaagatcttcatagcaacatctagatggtgtttgaccaaaccatgagacaccttagcctatccaggtcgacacatgaaatcatcacagcatcacttaatattatcatttgcatcagttattaagttggaatgatctttccattccagcagaagtgtaatgttatcattgcttctctaagaaaaaccctcattttctattaccatatatacaacaaagtccaaaacactggaaatgtcttcaaagtcccttcaagttccacttgcacctctaaaatagttttctcacatttctaactctatacatcctgcccaaagaactattctttcagtttctatgcctaggtactttacacatttcattctcttccttgcaacattaattcatcattcaggtctgatttttcatataattccatcaggaaattcttctggactagaatagcttgctccacaatatgcctcattgtatcccatgctcatgatactaatcacctccagaactcctgttcaatgtcaactctaccagctattccacaagctaacaggggatcctaaaggaaatatgcacattaggctaagaatatttacatattctgtctttagtgatgcatttgaccttctcagtatctgcttttctgtcctttgtgtttatttattgttttgtgggggggaacaaaacctcatgacttaaagcaaagctgaaagtctctgtaaagccagatattaatgttttcttttaagctaatctcttctgcaaagctgtgaattccaaaggttcttagtagacaatagtgggcctggttctttgaagggataaaatgccccaaacagtttcaccctaattcatgggaaaggtgggggaagtcatttgatgcactttctgtataaatgttgttgataaaaatgtttgacttaaaatttctgcccttctgcttttcccagaggaagactaaagggaagtcaaatgataatatgcataatatttcttccagcaacttcagcatccactaaatttcacttttaaaattcttttagctttctgggattcctgctgttaacagaaacaataattgctgttatcattatgtctataacatagaagctgcacttttattctgccacctggagaacaccaaaattttagcaacttattgttatcattttaggtgaaggaacacacctgtagctcaactgctctggcaacagtcagaatgtgtccctttgaggccaatgctctgcaccattcaattttgcataccaatgggtagccttcactcaaattaatacaagtgacaatcaacttaggaagtgtttgttaaagatacagtttgaagcaaacttacaagttttccaagaagatattaagtcatgtccatccttgtgtattttaacagcaaaccaatatttgggacagcaataagcaggactcttttctacacacttctcagagttacttttgtgtcccgtggatggttttgcagtctcgaagtttgcttatcttttcactccgtcatgtttacaaagaggagtttctcaattcttaccactcctcttcagtctcacctttctgtgcctcacagccttctagggcaaaatatcctagccaattttattcatggaccttacacaaaataaacctctggagtaaaagagacctttagagagccaaccaagataagctctagtccgtagatgattgggctaagcctagtggagggcagtccttcagaggaagcaggtggaggcctgagtgtaaaggagtcagatgctgacagtcctctccagaaaccacattttaggttatttgtcatggtcttgttgaatgcgtgatctccaccatctctttactccctccaagctcttcttgtctcctcaggggaagccactcatttacatctggcagataatagaatatccctactaacatgatgatgttctggtcatttggactatgaaattaagcagccacacaaaatgtactgcgtcgatcatactagttaatcaaaaaccacatgtaaaaactcactaaagacaaagcctataaccagtgagttaagatattatcttttctggaattagagaggcccaattgccttcattatacttagttgaaagtacatggaaaactatagataacctcagtttagttgaaatgtagaaatattcaaaaatatttcctatttagagaatacttcctaggagtacgcttgactctcaggataaaattccttgcccaaaagggccaacagatagatacatcagcaatttataaatcattaacacagaaataattgtgtaatggccagacctgatggctcacgcctataatcccagcactttgggaagctaaggcaggcagatcacttgaggccaggaattcaagaccagcctggcccacattgggaaaccccgtctctactaaacatgcaaaaattagctgggtgtggtgacatgtatctgtaattccagctacttgggaggctgaggcacaagaatcatttgaacctgggacgcagaggttgcagtcagccaagatggcaacactgcactctagcctggacaacagagcgagactctgaaaatggaaggaaggaaggaaggaaagaaggaaggaagggagggagggaggggaggaaagaaaaaatagaaaagaaaactgtgtaataagtcatatggtatcataataacaaagagattatccctggggaagatagaaaagagttcacagtagaggtacaatataaaaggtggccttaaaaaatcagcaggagtcgaatagttgtagcaagaacaatgatatgttagggcaaagagaaatgtaggaacatttctctttacgtttcttagtgataactcctgtaggcaagattttccatcttagtcttgtttccccaactacatcatatatcacctactatattccgccaagcaattttgggtaataggttgcaaatgaagaatcagtagtcttctaaatgagatgagatgagatgagaagacaaatgtgctattcaagaaagtcaaatgtagttttatcagattgtatataattgaataaaagcatttaatgtgggaaggtttgcagtcctttcctgacaccttttgcctgattattttctgcttctttccttcttcatcaaggagaaaaaggataaaatctcttcatgtgtactctcttgagaaaacagtgcaaaagggagcaccctactccctgggggcctgactacatctagggggcttgaagtgtcaagagcatgtcatggggtcacagatgacagagacaaaagagtttgtcttagaactaagatagggactgaatagcatggattacgatgtttttggggagtcaaagaatgagacactctcagtttaggggtggggagaaatagaaacaggagatttttaaagagttgccatgaaatatctatttggatcttcttaattgagagaaaaagacaaagattagaatttctgatcgggcttgatttgtttagatataaccatgcttcagaagtatttcatacatacaacataattctgtagaattgatttattttagcaacatgggaaaggaatcaggatgggaacttacatttattaaatacctatcagctgcactcacttgggaggctttagctgctgtgaactgctcctgctgcaccaggtttgctgcagtgatactcccacttcagtgccagatttatcttcccgctcaacactcaggaagccagacatatgcttacattttattaatctttgacacaatttacctgtatgccagatttcctgggagacagttatcagctagagaattaatatacaattttcatgttaatattttcccatataccactccccacatacatgcaattttttaaaatgtgggtgcatataatgagatattcacttggctaggttcactccacccatgcagtgttatctgctgttagtctctctctactaacaaatgagatgttttcaatctgaacaagcccacctctatgtagtcagatgcagtgggttaatgcagacttgtggttgtctcaggcagttttacagggttgttggctcttttgatcagtttaccagagctgtcatatcaaagtactacaaattcggtgggctaaaacacagaaatatatcctctcccagttctggaggccagtatcaggaatctgaaattgaggtatcagcagggcgatgtttgctctgaaggctctaaggaagaatccttccttctttcttccagcttccagtgactcttggcattccttggtgtgtgtgcagcataacatcaacctctgcttctgtctttacttggactttttcttccctgtatctgtgtgttctctcctcttctcacaaaaatgccagtcattggatttaggacccaccctaaatccaagataattttatctcaaaatccttaactacttacagctgcaaagatcctagttctaaacaaggtcacatttggaggttctgtttgggcatgaatgtaggggttgggggacacaattcaacccatcatgctcctttacattgtcaaaccaaataaagaatgcaggcaaaagcagggcaaatgctaccctggccccctggggactgcttctggtgtttctgtttgcctggctcatgaagtggctttgcatcacagcagttacacctcactggttgttgtcccttcacagcctggaagagaggcagcctcctcacacacagctcaaactctttgccttcctgctgcctctcatcacctgttttcatgaggctgtttttgagatgtgcacactacccagcctactaacaaatacttcaaattacctttcagcctgtgcctccttcaggctgagtgatttgtgagtttctcatctgctgagtattgctgttttcaatgatttttctctagtccaatctgcattctaataagctgatttctagatgtggcttaggaatgaactgttgtgtccattttaaaattgctcctggtattgttaacgccacttttccttatgtgacagttttcccattttagccaatttgaactaagctttccaagtaaaaattggaaaattggtaaaatctatacaacccttgctgtctcagtgtaatgttcatgttttctgaacattaagcccaaacacatggtctaatatgaatgagtgcattctctggaaattcaatttgtcataagtataggagtgctcaacaaacaccaggccagcttttatgagaaacatctaactacagtgccttatcttctgtaaagatacaaatacttccatgaaaagaaaattatcgcatctcaaatataaaatttgcttaccgaatttagaatcaaaatgaagacaggaaatagaaaagttactttagttttaaaataatctgttagcaaagcaagatctacgtatttgtcttaatatgtgtaaacatatcacaattctaagatttaataggtgatttctaaaatcaggcattttaccagtgaagatatttaagctttagtcaatagaatgttaagaatattctagaaaatcaatttagcaatgcaatatgcaaattttctagtaaagtagatagaaatattctaatctgttgcagactacaatatctttgttttttaaaaccagtttttgcaatgtctcaatcctaattgacttatattaatatatgttcattttattttattggttaaaaagatattcttaaatgatataattaggccatccattcaaaattctttatttccttcttttaagaagagaatattttaacctgtttcccttcctgtcatcatttcatacagttattttaaaataacttctcatttctttagctacttttgccaaaaaaaaaaatatgtttaacttcatttctattctagttcaggtcagagccctcctttgtgagtctgctaacagctcaaattaagctcagctattacccttgggatacaatataagtaaacaaacacaattcagacaaaacagaattacctgcaggaaataactgttctattatagtaccagcaaaaaatagctcaaccccatttgtccagtcctcaaatgcttatttttgatgtttctttcacaacaaatctctgtaaatagccatagggttgtcttggtccattgttgttgctataacgaaataccacaaactctgttgcttataaacaactgaaatgtatttctcaaagttttagaagctgggaaatccaagatcatggtgccgccatattcgaagtctagtgagggtccactacctggttcatagatggcaccttcttgccatgtcttcacatggtggaaggggcaagggagccctttggagactcttttataagggtagtagtctcattcagattagtgcctaattcaggcaagtgcctagccacatcctaaaaggccccctctcctttcaaagaggctgaaaaggtatggccgaaagaggtaaagtaaaaccagaaaaggataacatcacagagataaaaagaaccaatattcaagaaaaagtaaatgaaaaggttagtagtttaactgcactccctatgtgccaggcactgatctggaaggtgggactcaaaaataaagaagatactctttctgttcttacaaagattattttgttattcctctgcatttaatctctatcttggctcccagggactgataaatttattcctcttcccacaattatcctggaatctggagtcctgacctaaaccctagttcccacagcatggtacccagtcatgctaactctgttacttttttacgtagcttgacttcccactgctaaaaattatcttaattccttttcctacttaactgaggtctgttgttttcaggtccgtgttaccatctggctcattttgtttctaactgggtgcaaaaacacccttcttcccatggcccctacctagcacgggccacctgttcttatatatggaatgatcctgttcttatatacagatgttcataagacagacaggacctgtattgttgaggataaaagttcaagaggagtctcaagatttgttttcagccaagggtttctttcttgcctataacttgggtagctcttttatgtgttcccttaagaaagttaactttgagatttcttacttctttcagaggatatttgttagcagggtattgaccctacagtgttgttggacaggcaggttttattcaggactcaagcgctcagcttttcctcctgttacattctatacattagactccctgtcgagtgagggaatcagggcagactatagaattatctgttccttggtactgcaatatcacctggcagatggaaccttttggctgggttgtggaggaaggcattcttttctgccattggcaggaatttagggcagtttctttctggctcataaagttgtcctttgtaaacactataattttggctgtctagtcccttttcaattttccattctaaaaggagctgagccttggtgtagatgagccttggtatagatgataatttgcgagcatattataatggacaatttttttgtaatagatgtaatttttccatctaagctttgcctagactggtattaaataagcacacagccactgccagcagttttatggggagcaggaggtgtcaagtaaaacccaagctattaatttttcaaatttgtggtgaaaaatattcatgtagggtttataaagtgctgattgtgcttttgatccaataacacaagagaatttaaagttcaatttaccatatgtcaatcattttagaagagttgagtcacatcatacaggaaggttaccttcaaaagagtatcccataaacacaaatttgcatatagtcagaaatattattaaactttctgaaatgttgacaatatagttcacacttttgataggaacatactttttaataagttcagaataggcactttttcttgcagagttaatacagagcactattctgctggaactccagagcatgtgccagcatttgaattctcatagttagcttgtattttcaagcatttaacaaaaaacagtagtcttttaaagattagaataaaattatctgtgcagcaaacttgtacaacttgagatacgcataagttggcaattcagtgggaggacatgaggaatctcatttccaagaataagtacacagtagtttcttttaccctcaggaaacaagacaaggatctcaccagccactatcttagagctttccattggatggaggaataatcataactatgcttatcctacttctagctggcccactggtcaagggatgacctgtatcaaggaactagcactaaggttccagttcaaagtgctggtagtacacagttagaaataattggaagttaccttgttttgaccaaaacatagtctctatcatacacacaattttgttaaataattgaacagcctatatggtaggactatatacgttacattccaacaagatacaatatgactatagaagtcaacttggatctcattcatagtaggagtgaatttaaatttgtctacttaaaaattcaaaagagcatgcatcatgttgattccaacaagggcttctgaaaagtatctttaatatatctcctttgtggaagatcactgaaaagaaaaatatacatttcagagaagctcctcctgattccaaattcttccccagtcctggtgacttcagcagtagcatatgactgcttctccttaacttatacagcattccttaaatctcaatccaaaattgtccatcttcagatctttcattttcagatttaacgtcattagtattttagacatcttcatgaatggtaccaattgagtaatgtactagaatttaattcatatttttgtttctgctggtgctgcttgaggctgaatagcatagtggggaagtgtgagttttaatgtagacaaatgtgggtgcgaaatctcagactttcgtttactatctgtatcactttgggcaattctccttgcttctttaagctttagtatctccatctgtaaaatgggattaatatttatttcttaaagttgttgtgcagattacataatatattttaagttcctgataccagctaagccagtggttctcaagcactaatttgtaagagaatcagtttaagagcttgatttaaaaaaaaaatcactacattcagaagtgctgattcaaaatatctggagaggggtctgagaatccacatctattaacctcaacacctcaggtactactaattcaagtgttttaaagaacatacacgctttgagaaacactgtattaggctcttaatggatgttaatttccttttattttccttgcagtaaacttactaacaaagtatagaaatttgatgctggtattagacattatcccaaaccagcagttattttagaacttcatcaattatctcaaagccccaactctatttcactattgatagctgacctcacactgccaatactcagagaaaatagaagccatcagacagaaaatgtgccaaacctatatactgattccttctttattcatctggtgaatgaatgtttattgaatgcctaatagataccaggcacagctctaagacagctgtcagcaaactatgccctatggaccaaattctgtctgctgtctctatttataaagttttattgaaacagagtcatgtttatttgcttacgtggtttatagctgcttttgtactaatagcagagctgagggctcatgataaatactgtgtggccctctgtcttagtcaaatcaggctgctgtaacaaaagtactataaactgtgtgagacttatgaacaataaacattatttctcacagttctggagtctgtgaaggccaacatcaagatactagcagattcagtgtctgtgagggcctcttcttcatagaaggtgccttctagctgtgtcctcacatggtgcaagaggcaaacaagctccctgaaccctgtttaataagggcactaatcccattcatgagggcagagctttcataatctagtcacctcccaaaggctctacttaataccatcacctaggggcttagaattcaacataaggatttgggcaaacataaatattcagaccatcgtatcctaaaagcctgaaatattaactctctggctctttcagaaaagtttcttaatccctaatctagggacagacttttggacacgatttcccttattagatccttatttcttacctgatacccctaaacatctagcttttcctcttcacctcaagaagtgccaatattgcaaccttgaaattttctcttctaccttagtaatcaacaaaaaagtattaaaaaacatagtgtttggaggggaaatttcaaatttctctttgtatttcattaaataacgatttaagtaaatataaagtcatgtcagtttggatactttacaccaaaaactaactttggctaatgtatgcagaaaatggaattggttggaggtatatttactagctaaattcagaataagccagagtccagagatccaagtcaggaaccagggcaaaccctggagttttaaactgcagaaatttcttatccatggagctcaaatatagaggtaatgaacagctgaactgttatatattcagtccatgtatcattcccttcaaaattcaaagtcctaggataaagtgtttgaagagcatgttggatccaggtctgttccctaaagataagcagggcaccctgacttcctccccacaaaaaaacgcctttgagggcaaagagaaaattccccagaaaagaaagcagggtgttatttaaaagggtcacaatttaaatagacaagaaaccgacaaatgctgaaaaacagtccattgggaaaggagaggtagaggcttaaattatgttccaaaatccacttcaggcctagattgaaaagatcataagagatctgaaatgaagaatttttcaggaaaattgccctttacattcagatcacaccagatttcatttaaacctcagctgtttcagtttttcctttccaaaagttcttctcaacaatttctcatattctccagcttctgtatgacttttagaacagttattttaaccgtgagcctgtcatgatgttcattatgctaccccaccccttcatactgacggggtcctcgaagtgatggtccgaatattgacgatgtctatcatcaaccttttttttcctaattccccttctgatcaagatacatgatccctacctagggatattaaatattttaaaaggtaagtttgcttttaatttatttaacaaatgcttagttccttaatgtgtgccaagtatcatccaagccctttagccctttgcaactattaattcattagcaacactaggagataggtactatgattaacccactttgtagatgaagaagctaagtataaaaagtttcatgggccgggcgcggtagctcatgcctgtaatcccagcactttgggaggccgaggctggcagatcacctgaggtcaggagtttgagaccagcctggccagcatggttaaaccttgtctctactaaaaatacaaaaattagctggatgtggtggctcacgcctgtaatcccagctattcgggaggctgaggcatgagaattgcttgaaactgggaggtggaggttgcattgagccgagatcatgccactgtactccagcctgggtgacagagcaaaactctgtctaaaaaaaaaaaaaaaaaaaaaagtagtttcatgtaacctggccaggcacgatggctcatgcatgtaatcccagcactttgagaggctgaggcaggtggatcacctgaggtcaggagtttgagaccaccctggccaacctggtgaaaccccatctctactgaaaacacaaacattagtcgggcatggtggtgggcccctgtaatctcagctactcaggaggctgaggtgggagaatctctcgaaccctggaggcttgcgaagtttgcagtgagccaagactgtgatgctgcactccagcctggacaacaaagcgagactctgtctcaaaaaaaaaaaaaaaaaaaaaaggaaatttcatgtaacttaacatcttctctgatatggctaataagtgacagggcaggtattttaatccaggctctgaaatttgtttaaccccaaaaccatgtttccttcaaacattacaaaattaacttatccacaaaggaattggagacatgacattgaccttattagcagctaaagatcattaacagtttaattctctggagctcagctttgtggaattttatatagcaaatttgcagtacaaaaaaccattatctgctaattaccaacatctactcatgcctgatccagttaagtgagtctgcctctttattttttcatttatttataaaagcgtgtgcagagagtgctgtattcaggcagtcttcaaggtgctggagataccaacaggcataagtttatgatatctgaggaggcgtgtctaatctggtcctgagggtctcaaggagaggttcttggaagagaaacctgtacgttccatggaagtggatcatgtagggaggagggtggtgattaggggagagctggctcctggagtggggataatgtgcctagatcccaaggcaggaaactgcatgttgagtacagctatcacataggaagcgtctgagactggagtctaaacttcaactgtctaatttgatactcaccagccacatgttgatatttaagtttaaattcattaaataaagtacaataaaaattaaggttctcagttgcactagccatatttaattgctcaatagttacctgtggctaatggacaccttactggacagtgaagatatagagcaattccatcatcgcagaaagttctgtttggacagcactgctctagggtactgagcctagggtactgtttaaaaatgttaatttttaagttaaacctgcaagtaatggaacaaaatctctgggaatgggacttgggaatctgaacactgtaacatgtctgcacataattctgattggaaaccagatgtgtaaactgtaatagaaggtgcactgactgactaaagtggtaggagaggcagagacagttcacaaagagtctttgaatattaatctaagagaccaggatttaaatataaacatgaagagatcctttgaaaggaaagaaggaagaaattctattagattagcattgtccaaacatttctccattctgttgctagaatggtcttcacaaacctcagacctcctcttgtcaataactttcccctggtcagtctttctattgcttttagctaataacccaaatctctgacatgacctgcagacattactatctcaaggatcttttagaaccctgactccccccttctcccaactgcaccatgaacctgggcagtgatctcaaacttctgtcactttcctttcaaagatcaaaaatcattgtgcgtagctgtccatcaggctgtaggcttcctgaaggccaagtctgtgtcattatctgcccagcacccagcagaatgtctagctcataatagttcataacaagtatttcacaaatattcaggtatagtcacaaaatgaatggatccatagagattctcagtgaagatccctcattggccttttattaaatctgtgagctagtttgatttttctgtctcaaaaagcagaatgaaactcatcaggaagctcatttgtccaaaagaagagcatctgacaaactctgggctagctcttctggaaatgtcagttctctgaagatgaattcttgaaaagattgtcttatacagctatccccttttcacctaattccactacaatgcagcagctttaatgcagtaatatagattattattataaatggcatcaaattccaaattctatgttaaatctctactttaccttcctttatcactcaggatctggatgatcactaattacaccagccacttctttctctatactcttgtgtcctgggtgaagcacacaatttgaattttgttacaatacccttcatcacccttggactatccatgtgtgtgtctgcctgaccttcccatggtcaagtgagcaggcaggaatgcagtaagtcattccctgatgttaacaaattgaactgctttgctttcttcagaaaactcttcgattactaacctccctgcaacagataggatagccaagctctgaaatagcctcaggctaccctaataatgttctgctttagccaagccaatcttttcaccatctctaaaaccttccacatctttgctcattgtgatgcctacataattcattcactccttccttttcacttagctctgtgatgaagtttcttcatgaaacctcctagtgactccagttactaggggtgtgtcttaactcaggttttcaagtgtagcatctaagattgagattcttgtaaaactaatttaatgagggtatgctctctacagaagaggagttaaggaaggaagcaagacagaacaagagaggaaaggtaaacaaatatgggtcctgcctagatattagcttctactttatcccacagggagctgttgaatatgaattttatcacagtactgtttcttccttgagggggggtggtcaatctttcatgccctagtatcagtgagttatgggccactggctttggtgggagcctatggtataaacacttcaattgagatagtttccttttacctaaggcaatcctctacagaattctcctagaatagttctcagagcagctaggggacatgggaacaaccagtgaagaaaatctgggtgaggcaccactatagtgtaaattttctttgacagcttgctatactttaatgtataatactcaattcaaggtacgagacaattgcatctaacattgttataaatcaaagagacatcagatcagttatcaagggcttcagaacatcaagggccccagttatgagcagcatcttcataccctccatgtttaacatctttactttctgggtataatttaataagatcatcaatttgaagaatggtaactgcagcttctgttgcaaatttcaaactcttaactttaactgtggttggttcaaacacccctgcttgtttgttgtgtctaggtttaccatttctcaaatcaagaccaattcattttagatttttactttctgggttaacttgagcctcattatgaaaagcccttaaactatgcaaccagatctgtggagttctgggcagcattaactgtcagtgaataacaggaagaggtcttgcagactctgcaatagcaagctgttcctgagactccatgctggtttcacagttttcggggtatatggaaaaggctgcttctacagcatccccaactagcatcatggattttgactccaaaactttcttcactatgcaaagagcatcatgtagagtgctccatctcatcacatacgaaatcatttgccccatgtaagataattgatgcagatgcacaagccttactggttttgattaagatcagctcatcatcacaaattctctcctgtaccacttcttccacctgtcccgacactgcagtttcaaaagtttcttcacccttcaaattggccagggttgacagaacagtccctccagaagtttcagcaatgcatttaaggtccctttttaaagctcttctaattgccatagccccaacctctacaaaatactttgacacatatcatcaattccaccagctattagaataatattggcatcagttgccaggatcttcggaattctctccttgataatatctgattctttctgtctaatttggtccagtttttcagggtctgtaatgaccacctgtacatcaagtatattagtccattctcacactgttataaagaactgcctagactgggtaattagtaaaggaaagaggtttaattgactcacagttttacagggcttgggaggtctcaggaacttacaatcctggccgaagaggaaggaaacatgtccttcacatggcagcagaaaggagaagtgcagagggagaagggaacagctccttataaaaccatcagatcttgtcagaactcagtatcatgagaacagcatagagtccctcccccaacatatgggaattacaatttggattacaattcaagatgagatttgggtggggacacagagccagacaatatggcaaagcttcatttttgtttttttacaggctagagttaagtcaagcaatttccgcattaacaattattttgggcatgccctgggatcccaccacacagctgagtgcatacccactgatcagcatactctctatctgacttctcgcatgggctttcagaatattaacagaattggctggatagcgaggctggcctcttaatatctgtgtatgtagtaacaagtacagtatctgctactatattagcaaataaatcaccatttattccaatgattttggaagacatccatgtctcagtggaattaatcaggcaatctcttcccagttcatctgtgtagataattaagttttaacggatataacgcagggcttcgcattgaggtagttccatctccaacttctttgtcttgcaggtcagccagctcacaaagaacttcagctgcaggattgttctacctccggtaacctcagaatggctgcaccatcattagtaatggttacatcaccaacatcatccaccaacattttatccaagccaactggaccaagagaacttttcacagtattggcaattgaagcttaagccataacgttctgggagcggaccacctccccagtgctgcggtcttggtccccgaacacggacaaaggcccctccatcttcaacgcaggggtatacgtcgacttccactcacacacaccgcgggcaaccagtatcatctcacctcagccaaccagcgaccagagcagtgatgcgtggagccgacccgcatgacgccacaggggctgctgggtaacacccctacaccagcttcccagctcccccaacgcttggccgcaggacatggcaggaaagctagtgtgaatttttaacttgggcaaaaatttgtttttggagggcatgggagggaggaaacttagacattgcaatgcttcatggctctccaaaggaccagtgtataaagagatgtgcaatgtatcaacgttttatgggaggagggaataaatagggggaaaaagtctgaaagctccttaggggggtaatgatagaaaaaaaaaggttgagaaacactgcaatatggggtgcagtctgtttgttctctgaagtcctaatgcattgattttcacatcaattgattgtacatgtgctatttgttttgtattcccctcagtgcatagtacatcagcatataacagttaatagtagtggtcccctgcttctggaatttatacacagcagcttcccaggccatggaagaaattccacctggatctgtttatttccttcttgaatagaagatgagattttcccttcatgttctcatctccgtctaaagtgtttaagttcaaaactctcaattcctgaagttggaggttacagtgcgctatgatcactccactgcactccagcgtgggcaacagagtaaggctctgtctctaaaaaataaaaataaataaaaaatagaaaataaacataaaactctcagtttagggtttaaaaatatttgatgttggtgatcaataaactttatccattctaatatacttcctgaaaagtcagtctttcttgcctttcccacttcctctgcgtgtttctctccagttctcattagtttccccatttcccctctttctaccagctttcagtgtgagttaatctttccaatctgaaaatctggccctgtaaatttgcatctgctgattattgagatatatctttcagcttcaaacccacctttccacatttgcattgcgatgctgggtctgggactcttccaaccattgtctcccctttgctggatgtctcccagttcagctctccctaaagaaggtacaaaaagggatgctgagggtaggcagaaggaaaagacatgtgttccttgctaagtggacactgctcccaccaggttcaccacagcaaagcagttcacctgagcagtggcagtggatctggcttccaatttttccacactcatagaactagcttcattgtaccctttaaagacaccagcactgatggccccatgttacctccaataggggtctgagtcccaactctgttaagcccctttcccaagtacctattccaaccacttccctttgttcctccagcatttactagatctgggtcacctccatgcttcttttttgccttttcagctcccaattccttaaattctctcagttaaaataactgctaagatttctgtttttttgactagactctaggccccaaatgctaatatgctgctcttggtccaagatttctctgattctttgttttttactttgtaaaaactagaggatgaggggacacttgcttcagggtacctgagagagaaagctgatgagaatggaaatacacaaaaagcagagtcatacttttgggatctagaccacagaattatgtaaataactaatagtataatatttctactgaatttctgtactggttgaattgtgtccaccaaaacatatgatcaagtgataatctttggtacctatgaatatgacattttttggaaatagggtctctgcagatgaatcatgttaaggtgaggtcatactgtattagggtgggccctaatataatgacgagtattctcatgacaggatggaaattgagacacaagacagaggcatataaagagatggccatatgacagtcaaggcagagactgatttcatctaaaagccaaggaacaccaagaattatcagcagccaccagaaggtaggagaagggcaaggaagaatcctcccttggagccttgggagaaagcatggccctgccaacaacttgatttcaaaactgtgagagaataaatttccatggttggaagacaccaactttctgataatatgttacatgagccatattaaactaatacaatttccaacttccaaaaagaaagaaacatcattaaaacatttgtttcttatgtatatgtgtggtttcaacatgtgtctgcaaataaactactttgtttaatttaggaaacaattttcacttccacaagaatgacagtgaggatgacaaggcctgcctttgtcttggttttgaatgaatgattcctaatcattataaaacttaaacatagctttttttggtctaagcttttacaacttggcattatggactcttatgtaattccttaagcattaatactgaaaaggtactgaactgtttattcacaacccacagaaacaatataatgtattatttacaccaggcagacagacacaaactctttttttattttgccagttacttatatttctttttaaacaaattatcagaaaaatcacaattaatatggcaatgacctcctattacttttgctattttcccttacctaatggactcttttggcaataataaggcaagaagaattttgatcttaaaagccagagagaagctatgatctcaaagtactttgccatgttaattaatggcaaaactttgggaattttcatttcagtccaagcaaacttaaaatatctaaaagccaattatttcaatcagatccttaattaaactgggacaaacatgtatcccactcagtatacctaggttattatgtggtcagtcaacccaacccacttcttcctagctgtaaatccacttgggttctagtccttgttataagttgacctgttgaaacatcgttgccttttttcttccactaaccttgctgatgagtctgctggagtggtagtgaacaacaaccttgtccatgaagaccatagcaaaacatctttgtcccgagcaatattctgggaatgtgttttcatttaaatgcctccatctttgcatattctctttttcactttcattaaggccgtggccacaagcctgcaaacattcaagtaaaagtcgcagatgtctcaactctttgtcttctcagacttcctctatctgtctaccctcaccctggatgttctccaggcctcctaaaaaggaaggcaactcagccttctttatgattctttatgacactttttttgttttattctttcctttttgtgggaggagaagcatcacagtgtagtaactaagggctttgaagaaaagtgaaaagatgggtttaaactttaggctctaccatttattagttgtgtgtcctcaaacaaattattgaaacttccacaaaactcattgccctcatttacaaaatagaaacaagtaatttatacttgaggttatttttgaggattaatgagacaatatatgtaaagtattaagtgcttttgatataataagtaacaaagaatttttgcacctgtcttcgtttgcttgatatttagccatagtcacatttatattagactcaagtaaactttggcacatcctgtatttcagtgggccctaatagtaaatatcaaggcaaatgaacacccaattttgctccatcaattgtagcatattcatgcaagggcactgtcagtatataggaaatgaaagaattttttatgcatggaacaatgaacaattatagtagattaaataccagttgttaaaacacactgtatctatacaaaagacaaatgagaaggaaaattaaaactaaatatatttaatgagacccatagccatcttctgctcatcttagttgtcagtgtgttttttattttagtctggtttttcctgtaaagcagtaaagatgttgaattttgctctggaaattaaaccaagagaggtaaaatttttttattcctctgagaaatattgcagattattgtgttccatgaatagtataattactttcacaataacagaagactgaacagtcacaggtgttgggttttgcattgcaaagtgtgggtgaagccatcattagcagctttgttctcagtgtcaccaaaaacaggcatcgctgtgtgcctcatagttgccaatattccagggtattcgtagagtcagactctcaaacatcttgaaccaacaattcctagaggaggctacccattttagaatgtaatttttatcatgcccttctctccttcagccacagacctgacatgagcagcaagtgtccagaactgcaggactctccttgaaaggcacatctagtgatgagtcttcactgtcaaatgtctcttcctaacatgtactttctaaggcttcctatacatattctaaaataagactggctcctcctttatctatgcctatcctccttcttcttcccacaaatctgccatgcctcatgtcccttctgcagtgatcagagagaagcagtggaatcaagcatgacttcagtagttttgatctgagcagatgaaggattagttgtcactaatttatatggggaagaatgcataagaagcaggtttggaggtaggggatgaaggcaatcaaaaaaagggagttttattattatgtttgaaacatgtattatgcatccatatgaaaatcaagtgaacagttgaatatgagactctagagttcctgggagaggccagggatagagatatacatgtggcagttgccagtatatagatggtatttgaagccatgagatcagatgcaatggccaatggagttaggatatatgaaaaagagaggacaaataacttacttttgcgaaaattcaacaataataagatgtgaaagaaatgagaagaagtaattagtgtaagtttttatacaatctgttttctactcttggctaaatatgccaagatttactaatcattttaatgggacatgtttgcccaatcccagtaccatgtttcacttatttgtgagaagtaaatgaacctctaataatttagcaatcagaatggaatacagcaagtcagccatgacaggaactgtacaaaggaaaaagggaccagtgtcccatgatctgaatcccaaaatttaatcggatcattagactatgttccattattgtctttaaaaagcaaataactttgtcacttaaaaatccctctatttctgtcttaatcatttcaggttccgttctcctaaaaatatacttacgaggctgaattattgaacctaaatgtagtaatttttatttatttcctacagattttatattgatggatttgactcatcattagtcaagcaatatattttttaacctaaagctaaatattcactgcattaactttctttagctttgtgttaccacatacaagaaaatcataccttctgtagctatctatttcccttcctccaggcaaatttattttttttaattttttaaaaaatttttttgtttttctttgagatggagtcttactctgttacccagactggagggcagtggcacgatcttggctcactgcaacctctgcctccaggttcaagcagttctcctgcgtcagactcctgggtagctgggactgcaggcacactaccatgcccgtctaattttttttgtatttttagtagagatggggttttaccctgttggccaagctggtcttgaactcctgacctcatgtgatccacctgcctccgccttcaaaattgctgggattacaggcgtgagctactacgcccagcctgttttgtccttagtaggaaataagacctatcaagattaaacaaaccaacttgacaggaaaatgtttatttcaatcagaaaggccagataaaaaaccttgactgaaacagtagtaactttagttactttgtggcaggtttataatattttattatttattcattatttattaatttttctcttaggttacacatgcacaatgtaaattttaatgtaattgaaacttttatttctatgaaagattttatcttttagaaaaaaatacaatgttgatattttacagctgggatcttgaaaggtaaggcaatttacttccatcacagatcagagacagatccagatccctgagatccattctggtgcctttatacacatttgggagtccctagtaccaattaaagaccctaaacagcctgaatttactaaattcataattttaactataaaataattatttttcatttgcattttatagctctgatctcgttagttacaaagctgaaatatgccgtaaaaatatgtagtcaataggttcaaaatattaaagacctaaataagctcacatggacatcagaaacagcatcataattattgtctttacaaaattaatatctccctcatttatacaggaactgttgtaaagactaaatgcattagttaacaattttaaaagtgaaaaagttcattttcttgccatataaacacataaataacatacttatctgttacaatttgtcaaagggtccttccaatcactgtcagaagtacattatctaagtatttagtctgctgaatctaaatatcattggcaataaaaactgcccatcttttgattaaagaaattgattttgcaaagtgcaattggtcatggcaaatgatgtgctttgtgaccagcttttttttctttttttttaaattttattattattatactttaagttttagagtacatgtgcacaatgtgcaggtttgttacatatgtatacatgtgccatgttggtgtgctgcacccattaactcatcatttagcattaggtatatctcctaatgctatccctcccccctcccccgaccccacaacagtccccggtgtgtgatgttccccttcctgtgtccatgtgttctcactgttcaattcccacctatgagtgagaacatgcggtgtttggtttttttgtccttgcgatagtttactgagaatgatggtttccagcttcatccatgtccctacaaaggacatgaactcatcatttttgatggctgcatagtattccatggtgtatatgtgccacattttcttaatccagtctatcgttgttggacattcacaatagcaaagacttgtgaccagctttattgagaaatttctatcatcattcacctggcatctggcagagatcaaacaatatgccctaaacacatattaaaacaaatttaaaagctgaggaaagtattttaaaaacaattctaaacaagtccctgaactagcaatgacaaaaaattaactgaaggtggaaactccggatgttggtgcatgccaaagcctgatagtatctgctgacacacttctgttttgaaggataataagaattctggataaagaaaataaagcctagggtctactcaaggcttagaacattctaataagggaactagacataaaactggagtaccataggcttatacaatctgtacaacataaacaagaaataagctctctgtgcagaaaaagacagcaaggaaacttgcctatctttatcctgtggttgaaatggatagaatctttcctgaaaactgatgaatacaaagacttccctgacaagtttttgtccccatattcaacctgtcgggtggggtctctggaaggtaggggaaatgcccttaagttagaaatttaatttaatgtggccaaagacatctagcagaagcaattgaaactttgttccaaagaaatgaaatttcaactaagttccccaaaaattcttgaagactatgttccaagggtcatgtgtttacagccaaaaatcacaaacaacagacatcagacgccatctaggaaatacttaaattcctgaaattatctaccatctaataggtacatctaatatggtttaagacacaaaaatgacttgaaaatatgagcaagatacaagtgaccataaaaagacaaaaaagaaccaaatagaaattcaggaagtaaagaatataataatatgaattaaaaatgaaatgtaagagataaaagccaattaaatatagctaaagagagaactgtagaattaaaaatttaaaaattatttataatgcaacctatagagaccaaaagatggaaaacatgaaagagaagttaagggacatagaagataaaatatgtagatcaacatacctaattatgataccagaaggagacaatttagaaatggagagaaggtaagatctgaaggtgcaacaccgtagaattttctagaattgttgaaaaagattaaagcaaaaaaaaaaaatcccaagcaaataaaaacagccatgccaagaaacattatgaacaaaccacagaacatcacagagagatgatctaaaggggaaattacgattagtgtaacagctgacttcataacaaactaacaaaggccagaagatgataaaatcatatcttttataagcttgaaaatttaggattctggcaagatggcagaataggaacacctctggtctgcagctcccaagcaagaacgacacagaagatgggtgatttctgcattttcaactgaggtacctggttcatctcattgggactggttggacagtgggtgcagcccacagagggtgagctgaagcaggatggggcatcgcctcacccaggaagcacaaggggtcagggtatttccctttcctagccaaaggaagccataagagcctgtactgggaggaatggtacacttctgcccagagacagcacttttcccactgtctttgcaactgacagaccaggagattccctccggtgcttgggtcggtgggtcctatgcccatagagcccatcaagctaagatccattggcttgaaattctcgctgctagtgcagcagtctgagaacgacctgagacactggagcatagcggggggaggggtgtctgccattgcccaggcttgagtaggcagttttagtcacctataagtctatattgaaattatctttcaagtgatactatttctcatgaattagagtgacactatctttcacaaattacaatatataaggtatattcaattaaaataactgagtttgctgcaaaaagacaatctctaataaaagcttaatatgtgtatttcagtcagaaaaaaaaatcttatgtgtattactcagggattttccagaaaaacagaatcaattgtgtgtgtgtgtgtgtgtgtgtgtgtgtgtgtgtgtgtgtattagtcagggttattaagggagagagaactcataggagataaatagaagatagagatagatagatgatagatagatagatagatagatagatagatagatagataggagatttattaggataattggctcatgcaattctggagactgagaaatcccagggcaggccatctacaagctggatacccagggatgtcagtagtgtggctcagtccaagtccaaaagcctccgaactaggtaagccagttgtataagtcagcctgaggctgagggaccgtgaacccagggggataccagtgcatgtcttggagtccaaaaggccagagggaatggtgttctgatatccaagggcaagagaaaaaaaacttcctttcctctgccttttagtgttttgctttgttttattttgttttgttttgttttgttttgtttgtttgttttgagatgtagtctccctctgtcacccagactagagtacagtggcgtgatctcagctcactacatcctctgcctctggcatccaaataatcccaagacctcagcctccccagtagctgggattacaggcgcacaccaccatgccagctaatttttgtatttttagtagaggtggggtttcactatgttggccaggctggtctcgaactcctgatctcaagtgatccacccacccagcctcccaaaatgttgggattacaggcatgaaccactgcacccagccttcctctgccttttactctatccaggctgccagccaactggatggtgcctgcccacattgaggacagatctttcccactcagtatggcatctcatgtgccaatatcctctggaaacactctcacagatacacctagaaataatgcttgatcacctatatagggatctcttaatccagtcagcctgatagctaaaaataaacttcactatttatatctctatcatctatctatcaatctatctatctctatatatctatctctacctatctatctgtccatctttccagagaaagaaagagagagagagatttattatgagaaattggctcaagtaattgtgaaggccaacaaccaacaggagagccaatggtcacattccagaacagcccacaggcatgaaacccagggagaactgaagtgtcagttgaagtccagaggcatgacaaaaaccagtctgtttgaaagcagtctagcaagaggcattccctcttgcttggggaatggtcagactttttgttctatttaggccttcaactgataggatgaggttcaccaaaattaggatgaacaatctgctttacttagtctgccaatttaaatattaatctcattcaaaacatcctcaaagaaacacccagaatcatttctgaccaaatatatgggcagactttggcccagtgaagttaacacataaaattaaccatcaccacctcatactaagtagaagaggtgaggaaaaaaataaagatgatgagtagatatgtggggatctaaacaaacattgactatataagaaaagaataatagaaattaacctggttaaacaaaaagaaagcaaaagctgaaatattgggttaagttagcatttaaattgggggggcagggaagaaggtgtctggaattagaacagtcaaagattactgaattatttttgaggtggcaagagctattaattccagacttgttaaattatttgttctaaaatacctagagcaacttctagaaagtagacaacaattttatttgccagtttatgggcctgaaacttcccaatataactataagagagataaagaaacagtgtttctgggcacccagaaagaggaatgtaagataggacttgaacacagcattgtctctgccacagatttaataatgttcaaactagcagaggaggtggaaagcatcatgagaaaaacgaaatatctaatccaaaaagatgcaagaaatgagggagggcagagaaacagaaaatgtagaacgataaaagaacaaaataaaatgatataaataaatcaaatatatttgttatcatagtaaatataaatacactaaactctccttaaaagacaaagagactggattttttttaaagacggttactcagaaaaacacaagaaattagtacatgtagtaaacagaacaatagaaaagagaaaatcttccgagtgggaagataatagataaattctaaaagtggaaaaccaagaagtaccaatataaagcatgttctttagagaaattacaataaataaataatgatcagaaacaacaggtgctggagaggatgcggagaaataggaacacttttacactgttggtgggactgtaaactagttcgaccattgtggaagtcagtgtggcgattcctcagggatctagaactagaaataccatttgacccagccatcccattactgggtatatacccaaatgactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatgttctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataataaaaaaaaaaaaaaagaaagtttaattgtctctgagcagcaggaagtcagggtaacagtggcatctactgtttttcatacaagaccttgtatggtaaacaaccatttttatcttcaaactgtgtacatgtatacatttttatttctttatttattttaaacaagaatgccttactatgctacctttcagttaggttattttgtttcactacatggtatgtttaagcttagttgtgaaataaagaattcgtgactaaattctacacatttactaataatgagtatatagatccaaggtctaatcaatatatattggaaaatgaataaatagtgaattaatgaatgaaaaattaaatgttcactttgtattgaatgtcaaaaccatatataacctcctttaattactataaacagaaaaacattagaccaatttgctgaaaatttctgacatattgtttgtcatcatcaacaagaaataatctggctataatatagaaatttaagaaaatactgaataaactataaatcatatttttaaaaatgcatcagagagataaagatgcacagacacctcaatgaccaaaactcagagagggacaatccctatgtgagcacagtctggaaggttctttcatttcttggggtcacagggcactgagaagtaagcccaccacacaccaggagaatttgccccaacctgaagaaaccagctaaaatttaataaccctgtgggatatgctatagatgagacagtgaagaagccccaggcagaactagctcaccttgcccattgtttccccaacggatttctttctttactgagtgtgtggctgcttgcaggagctgttaagcaaaaaggaatatccagtgattgatggagcccgtaccagtgcatgagaaccaattatgtatgtctcttcctgagtctgcattcagtaacatgtcagtagactgaaactgcacatggtggcagcattcatactacagacatcagcagatgctgcaaattagactttctttttaggacagttcattaagcatttaccagcacaccactggctatattccatggtacaggatactgcaggctgggcagaaaagttgagtaagtatagtctcaaagtgcctaaaactcaagccttgctggaagaagtaacctaaatctgctctgagggcatttgtaactggtggcgaactgaaattaaatacagcccaatcctgacctaggttaattcataatgagaagaaatcagctcctaacccctgacagatgaaacattgtacactttctggagctaaatactatttatttcaatctctacttttttatacacaatatctaacatatcaaaataattttcatataagccaaagtaggaatataccatccagcagaagaaaaaaactgttcagtgaagtagactcacagaaaatccaggtgcaagaattagaaaacaagaacttaaaaatacctattataaatatgttgcagaaataagattaaaaggtagataccatgagtaaaaaagataatgaatctcagcggagaaataaaaaaattaagaagtaaacaaagggaaatttctggaactgagagtataatataccctatgaagaattcatataatagggtcaatggcagacataacagagcagaagaaaagatcagtaaactcagataagtcaatagaaattatccaaacagaaccaccaaaaaatgtaatatatatacataaaaacgcacatattttacatacacagttcatcctcaccatctgtggaggattggctccaggacctcttgtggatactaaaatctagaaatctttaagtccctgttacaaaatgctgtggtgtttgcatataacctacacacattcttttgtatactttaaatcactaaattatttataatacctaaaatactgtaaatgctgtctaaatcattgttatactctttagggaataatggcaagaaaagaagtccatacatgtttagcacagatgcactgtttttagaaaaatattttcaatctttggtttatgaaatccatggatgcagaatccatgaatatggaaggacaactgtatatataaatacatatacatacatatgtacatgcatgtatgcatacacacattgaaagagagagagggaatgaggcaaacaaaatatataaatagatcggccgggcgcagtggctcacgcctgtaatcccagcactttgggaggcgggcggatcatgaggtcaggagatcgagatcatcctggctaacatggtgaaaccctatctctactaaaaatacaaaaaattagcaggacgtggtggtgggcgcctgtagtcctagctactcgggaggctgaggcaggagaatggcgtgaacccgggaggcagagcttgcagtgagctgagatcacgccactgcactccagcctgggcgacagagggagactccgtctcgaaaaaaaaaaaaaagaaaaaaaatgttatatatgtatacacatatacgtatatatatatagattatgttaaaggatttttcagaatcagtaagacattaactcatagattcaaaaaaggcaacacatatagaaacattataatcaatctactaaaaaatcaagggttaaaaaaaggtaaagaagaaaatcttaaaactcacccaaagtaaaaagacacatattcaaaagaaaaacagtaataattgtcactctccatttttactaatgaatcatagtagtctttcgggattccgaaataattagcactaattcagagtcacagggaaaagtaaatatttgggaatatgtgtacaatttttttaaagaccattagctgctcatggaaaaaagttaactgtggattttggagttttaacatttgtggaagtaaaatttgtgacaataatagcacaaagggaaggagatataatggcattctattgttttcaggttcttattttgtgaaatgataaaatccaatgtagactgttataagttaagaatatatattgtaatctctgtggaaaaataaaaactaatcaaaagggcaggactaaaaagccaatatacataattaagtaaaattaatccaaaacaaggcaggaaatgaggatggtacaaataggagaaatgaaaatcaagttgcaacatggtagtcttgacctaacgtatataagtaatggactgaatgtccacctctgctatcttctagctctattttcccacctttagttattttctcatttgttaagccatttggaacctaccctttttaaaaattttcatgaacaggatcataaacacttatctcaagaagagaaataatatgtgataatttaaacaactgatcagatgaacttattagtctccagtttaacactaaaacctttttaattaatagtgagaaagttagcaaattatatcaaacaaaaattgagtcctctgtgaaaagacacacataaaaaatttaatattctatattgacaccattataaaaattgggcagctatcttcatgcaccatttctattaaattattctcaaaaagttattctcttagtagttgatttcttcattatgtaaattatgaagtgatgcttcattcatgctctggtatccacaagtatgctacccagacactttcagatataggaagagaagaggcatgtatgtgtccatttttatttctagcaaaattacattttactcagtgtagtaatcttcaaataaaagtcactagtttccaatctttttttcccatggatgattgccatgacaatcaaaagtgcaaaatgtccttgttcatggagatagttctggaaaaattgtctctagctcaaactttttggtaaaagcaattatagtgtcactgttttaaataactctgagatgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagttcggcctgggtgacagggcgagactccgtctcaaaaaaaaaaaaaaaaaaaaaaactctgagatgaatcttttattaaaatgaagactccttttataatgaaaaggtaggcatgtttccgaagccactttggccttgaggggaaagcaatgttccaatagggtcacaaaacagtaattcctcttcctgcacttttgccaatggaattccctacctatttatgaagactgctggttccgttttagataatcagattcttatacacacttattgaacttgccatttttctcctctcaactcccactgagagacactgatgtcttccaagtggttaggccctgtcctttttcactccagatggtgaccggttcaatcgatggttcaagctactctgcctattctatatttgaatattccacagcagtaatccacagtaatttcaaataaagtctccttctcctgttttggctaaattcataacataagctacaaagtaataccgtcaggttcatgatctcttcataattcactgagaggactacaaaatcatgtttttatttgtttattattattttttctttttttattatattttaagttctagggtacatgtgcacaacctgcaggtttgttacatatgtatacatgtgccatgttggtgtgctgcacccattaacttgtcatttacgttaggtatatctcctaatgctatcctttccccagccccccatcacaatacaggccctggtgtgtggtgttccccaccctgtgtccgagtgttctcattgttcaattcccacctgtgagtgagaacaagtggtgtttggctttctgtccttgccatactttgctcagaattatggtttccagcttcatccatgtccctacaaaggatatgaactcatcattttttatggctacatagtattccatggtgtatatgtgccacattttcttaatccagtctatcattgatggacatttgggttggttccaagtctttgctattgtgaacagtgccgcaataaacatacgtgtgcatgcgtctttatagcagcatgatttataatcctttgggtatatacccagtaatgggatggctgggtcaaatggtatttctggttctagatccttgaggaatcaccacactgtcttccacaatggttgaactagtttacagtcccaccaacagtgtaaaagtgttcctatttctccacatcctctccagcacctgttgtttcctgactttttaatgattgccattctaaccctgagatggtatctcattttgggtttgatttgcatttctctgatggccagtgatgatgagcattttttcatgtgtctgttggctgcattaaatgtcttcttttgagaagtgtctgttcatatccttcacccactttttgatggggttgtttgattttttcttgtgaatttatttaagttctttgtagattctggatattagccctttgtcagatggatagattgtaaaaattttctcccattctctaggttgcctgttcactctgatggtagtttctttttgtgtgcagaagctctttagtttaattagattgcatttgtcaattttggcttttgttgccattgcttttgtgttttagtcatgaagtccttgcccatgcctatgtcctgaatggtattgccttggtttttttctagggtttttatggttttaggtctaatgtttaagtctttaatccatcttgaattaatttctgtataaggtgtaaggaagggatacagtttcagctttctacatgtggctagccggttttcccagcaccatttattaaatagggaatcctttccccattgcttgtttttgtcagatttttcaaatatcagatggttgtagatctgtggtattatttctgagggctctgttctgttccattggtctgtatctctgttttggtaccagtaccatgctcttttggttactgtaaccttgtagtatagtttgaagtaggtagcatgatgcctccagctttgttcttttggcttaggattgacttggcaatgtgggctcttttttggttccatatgaactttaaagtagtttttaccaattctgtgaagaaagtcattggtagcttgatggggatggatggcattcaatctataaattaccttgggcagtatggccattttcacgatattgattcttcctacccatgagcatggaatgttcttccatttgtttgtgtcctcttttatttcattgagcagtggtttgtagttctccccaaagaggtccttcacatcccttgtaagttggattcctgggtattttattctctttgaagcaattgtgaatgggagttcactcatgatttggctctgtgtttgtctgttatttgtgtataggaatgcttgtgatttttgcacattgattttgtatcctgagactttgctgaagttgcttatcagcttaaggagattttgggctgagacgctggggtttgctagatatacaatcatgtcatttgcaaacggggacaatttgacttcctcttttcctaattgaatatcctttatttctttctcctgcctgattgccctggccagaacttccaacgctatgttgaataggagtggtgagagagggcatccctgtcttgtgccagttttcaaagggaatgcttccagtttttgcccattcagtatgatattggttgtgggtttgtcataaatagctcctattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattggtttgtgtatgttgaaccagccttgcatcccagggatgaagcccacttgatcatgatggataagtttttgatgtgctgctggattcggtttgccagtattttattgaggatctttgcatcgatattcatcagggatattggtctaaatttccctttttctgttgtgtctctgccaggctttggtatcaggatgatgctggcctcataaaatgagttagggaggattccctcttgttctattgattggaataatttcagaaggaatggtaccagctcctctttgtacctctggtagaattcggctgtgaatcagtctggtcctgcccttttttggtcggtaggctattaattattgcctcaatttcagagcctgttattggtctcttcagggattcaacttcttcctggtttagtcttgggagggtgtatgtgtcgaggaatttatccatttcttctagactttctagtttatttgcatagaggagtttgtggtattctctgatggtagtttgtatttctgtgggatcggtggtgatctcccctttatcattttttattgcatctatttgattcttctctattttcttctttattagtcttgctagcggtctatcaatttcattgatcttttcaaaaaaccagcttctggattcattgatttttttgaaggaattttcatgtctctatctccttcagttctgctctgatcttagttatttcttgccttctgctagcttttgaatgtgtttgctcttgcttctctagttcttttaattgtgatgttagggtgtcaattttagatcttttctgctttctcttgtgggcatttagtgctataaatttccctctacacactgctttaaatgcatcccagagattctggtatgttgtgtctttgttctcattggtttcaaagaacatctttatttctgccttcatttccttatgtaaccagtagtcattcaagagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgcggtcaattttggaataagtgtgatgtggtgctgagaagaatgcatattccgttgatttggggtggagagttctgtagatgtctattaggtccacttggtgaagagctcagttcaattccttcatatccttgttaactttctgtctcgttgatctgtctaatgttgacagttggatgttaaagtcttccattattattgtgtgagagtctaagtcgctttgtaggtcactcaggacttgctttatgaatctgggtgctcctgtattgggtgcatatatatgtaggatagttagctcttcttgttgatttcatccttttaccattatataatgaccttctctgtctctttttatctttgttggtttaaagtctgttttatcagagactaggattgcaacccctggtttttttttgttttccatttgcttggtagatcttcctccatccctttattttgagcctatgtgtgtctctgcacgtgagatgggtttcctgaatacagcacactgatgggtcttgactctatccaatttgccagtctgtgtcttttaattggagcatttatcctatttacatttaaggttaatattgttatgtgtgaatttgatcccatcattatgatgttaccagttattttgctcaatagctcatgcagtttcttcctagcatcaatggtctttacaatttggcatgtttttgcagtggctggaactggttgttccttttcatgtttagtgcgtccttcaggagctcttgtaaggcaggcctgttggtgacaaaatctctcagcatttgtttgtctgtaaagtattttatttctccttcacttatgaagcttagtttggctggatatgaaattctgggttgaaaattcttttctttaagaatgttgaatatttgcccccactctcttctggcttgtagagtttctgccaagagatctgctgttagtctgatgagcttccctttgtgggtaacctgacctttctttctggctgtccttaactttttttccctcatttcaaccttggtgaatctgacaattatgtgtctttgagttgctcttctcaaggagtatctttgtggcattctctgtatttcctgaatttgaatgttggcctggcttgctaggttggggaagttctcctagataatatcctgcagagtgttttccaacttggttccattctccccgtcactttcaggtacatcaatcaaaacatagatttggtcttttcacatagtcccgtatttcctggaggctttgttcttttctgtttactctttattctctaaacttctcttctcacttcatttcattcatttgatcttcagtcactggtaccctttcttccacttgatcaaatcagctactgaggtttgtgctagcagactcagactgctgtgctagcagtgagtgaggttctgttggtgtgggacccctgagccaggcgcaggatataatctcctgttgtgccgtttgctaagaccattggaaaagcacagtattagggtgggagtgtcctgattttccaggtaccgtctgtcatggctttcctcggctaggaaagggaattccccgaccccttgtgcttcctgggtgaggcgacgccctgctcttctttggctcactctctgtgggctgcacccactgtccaacaagccccagtgagatgaacccggtacctcagttggaaatgcagaaatcacttgtcttctgtgtcactcacgctgggagctatagactggagctgttcctattcagccatttggaacccctattgtttatttttttattcaatctcttttaagattgaggttcaaactcttctggagtagggagtgctgactgggagggcgattttgatgagaaattctgtgttgtacaaatcacccctactcctccagtcctaaggtattattctttttataatcttttgagtataatgtctagccctttccttaagatggatgcttccccaggggggatccagtgttctttacacaaatggatccctggcaatcccattcctacagagctccggctgaagtcagacatacttaagacctagagagaacactgcttaggcttgtttgggaccctggtattataaaaaattatctcttcatttatttgttgtttaagttttagttaaagtgaaattaatttcttaaagatattcatttaagtgtgtgcgtgtgtttagagtaatttctatacttactaaatgttgagggaactggattttaaactattatttcgttgccaggattttgcatttcaaatattgcattacagcttcattctttccttgaactagatttttaagtgcaggaaacaaccttgagctttcagttgagagtgcctccttgctcacagacaaaggataaatcaggacagtttgaagcatgctgagatgtactcttagaatttcctgcaattctgtgtgactccattgacagtgacaaatgaaagtggtttccacactccagtggactatgtaccatcctaactaggacacatttagcactaagtcagggagtaagtattctttgtatttttctgtcagcaatttttgactgttttccttattggtattgttgattttgctttgtgttgttgttttactgttaagccacaacagataagaaagaagaaaaaaacaaaaaacataagttagcacaaattttggggatatgaattacaattgtgctttgctatttatttctctaaaattgagtttcatgttaatattaaaaaaatacacattgtggctcagagggagttttaggttattagggaaaatggtttcatgaaagaaaacagatgccaaatggtattatgcagtattctaaaatgatcatgacgtttgagaaaagcagttaaacaatacctccactagaagtcataagattatacaattttcaagagaaataaaggaacgtttattatatcaaaacttttgagctgcatttttaagttttatccactgactagcatttcaatttatgaggtagtcagactttgtgtcatgaaatgtttgttagtgttctgtccaggtacagaaattgttagagcgatttctcctacagacactaaaatgatagcaatgttccatggaaatgaaaagctatttgcctgatgaatagcaagacaatatgcaacctaggatgcataattctactttccactgttacccttgggatccatagaatgagattaccttaaaactgaacatatctcctattcaagtccttccagtatttcaggaactaaacattcaagaaaagactagaagcagggagctcaatgtggaagctaatattataacagttctcaatagtccctgcaacaaaaacttgatttcttcaaaattactctaggaaagaaagtgactccttatcttgtgacaacatgcagtacttagcactttatttcagacaccattattgactgtatcaaactgggcatctattgggaaaaggcatgaagaacaaccatgtaagaaatatgccaacatagaaaaaaaatcttagattaattatgtttagcttatgtcgtattttaaacctgagtgtagaacgttatgttcaagtccattatttctagcattctcaatcacaaatagcttttattgaacgaatacatttgttccttgattctttaggactgttaaccaggcccaaataggagctgagccatctaagcatgttgagggattaccagagattgtaatcccctagagaatcaattttcttctcatctttatctgattctattttcttgtctccctgtaatgggagccagattctttgaatataaatttcctgagctaacatggcaaaaagcctacctgagaagatgaaaccacatgacctggggtgaggagagtattagaaagtgggcgagcccctgagcacccctatagacaacactccagtttgtaggtattgttaatctgcaggatcaagttacagaaaacccaactcaaattacttaagcaaataaggaatctagagtcatgtaatacaaagtcaaaaatggctgagccctgtgctgcaagcgctgtgagtagggctcatgggtctttacattgcctccactttcctctctgggtcctttttcagaaaggctttcttcacattggtgagctacctgacagcagcatttgcttatatcaacccaggtctaaatccagcagaaataagaataacacaatcttatgagtgaagcaaaagtcctggaattaactctgattggaaaataatcaccttgatttaggtcctgctccatccctacaacaatctctataggaagaaataggtgagcctcaaatcacccagttcgtaataacctgcttttcttgaggctgtgagtgggatcagttttaccaatagcgcctaggccaggaatgggttcgtgatggtgtcctgaggtcaggtcaccatgaccacaaaagcaggccaccaatatgggcaggcacaatcaataactgtccattaaacactattccaatggtttttcaattctggctatacattatccaagaagatttatataaatacataaaaaatatacttggactttatccctcaaaaattctcaaatgttaagttcagggtgggaactggatgtttgtattttgacaaagttctgtagatgaatcaataattaccagatctaaatcattaagtggtctcactgaatttatttattaaatgagtgtggtaaaataacttatcaattctcaaacatttccaactatgagccacctaaacagtgtcaagagtcctagagcccacatatccattcacccacccatacttcaccagcaccaaacatacctccctcattaatgttattttgacagggtaccactcaaaaaaactgcttttgaggagttctaactaggactttgagctctgccctagttacagtaatgttcttgtcaaggttaccggagttctttagaattcattttttaagtgtatgattaatggaaaaattatatttaactatatattaaaagataatatgttgaattcacaaacattttgcctctttttttcttaaccttctcacttaatcactctcatccatagttacaacatcgaccttaggattgcatgatgctgcattatctcccacacctggaccacaatctttttttggtcttgctagtttgtttgactattctttttcctcacaaatcttcaagttcattgacaattctctcccacccctctccattggtctctacctgtctttatgactttactgactactgactttactgactcaaattagattccagagtcaacaaagacaaaaactctatactcaattcctctctgtcttttctttgtgcttgccacctcaactccagctcttcctccaagtttgcactaagacagctgagttttgctggagaaaaatcccaacatccaaatatgtcatgtcactcctgtgcccagaaccctccaatggctttcttactttgattaaaacccaaattcctttccatgctgtgaaacactgtgatttggtcgacagtttccactctggcctcatctcctcttcatgtcactgctgtcactctgacctcatcactggtccttcaacaagcaagtgtcttcctgccttaagcatttgcatttactgttttctttactcaaaatactcttcttccagatatctgcaagtctcatgacctcattttattcagttttgttcccaaacatctccttccctgactatcctagataacagatattttcctagataacagatatttatgagttgaaacacacacacacaattaaagcctgaaacacagatagatatgggtagcatcaccatgctggtcaactaaattgattcccctgggatgatattgcactaatcagcacctaacataatacatgtactacatttactctttgatcttttcctgtcttcttctgcttgattataggctccgtaatgacagaatttgttttgtccactgctgtatcttcagtacttaaaacagcaatgacacttaatgaatatttgttgaatgaataaatacatgaagcaagtatgtttataccattataagttcacagtcacttacttcaactgggcctcaatactacctggcaattccactgtttttatctcttcaactgaatctctcaccctccataatgactattttaaattttcactctttaaacctctcatcaacacaaacctacacacacgtatacactcatgtgtacactccacaacccacaaccacatgctcacaacagacaactttgtttcctatgttacagaaacatagatgttcatagacaagagatccctgtaagtcttgttacaaaaccaacatgcattaccatatgggtacttgtgcttctctaattgctgttgttattttttagaaaaaaagttgtatttactcctatctaagccaattcctcctcattttgttaggacctacttcttcctatcttttcaggaatatctcattgtgaatcttcaaataaccttaactccatcccaccttaaaaaacaaaattaaaatacttccttcagccacataatcctccgcaatcactgtctccttcccttcactgcaaaactttttagagtaatggcccccttgtctctctcctctcttcccacacactcctcagtccactctaatctcaataaacacccactccttcactagaaagactgttgctaagattctcagtgacctacttccacattgctaaaatgcatgggtattttttaatcttcattttaggtgaattgtcagcagaatgttgtactattaaccaccccttctttttaaaaattcttactgtaaacttccttaacattgtatcctcctaactttcctcctacatcttcagccagtgctcctcagtttccattgtgaattcaacctcctctagatggccccatgtatgaacattcctgaaaactcagccctggcctcttctcttctcttcttattctatactttcttttctggagatcccactatcagccaaggctttaataaccaaccataaaccagtgatattcagatttttaccactagtgataatctctcctctgagctcctagcttgcctctccaattttgtaatgtgtattctccacttgaagatcttaaagatacctcaaaatcaatctatccaaaaccaaatccatttgctttcccttccaaagtagtccttcacccttgtttccactgttaggaacacagcaccctgtatctagttgtgaaagccagaaaacagggagttgtcatggccaccaccctctttccttaattcccttatataattcatcaccaaattctgctaattctacatcttaaatatcaaatatctccttcctctctgttctttctctctaattcactggctaccatcttagtctaagacattaccatctatcaactctctctacatggtctcctcatttgccttttgcccactccagtctgtcctccacgtggcaaacaaagagattttctcaaagcacgaccctaatcatgccacaactctgccacaaatcctttgtttcccattgttcttaaaataaagaacaaagtattttttaacatgccttgcaatcaattaatgaagaagctggtccctgccaaggtctacagactaccccacccactacacttcagataccctggtcattagtggtagaaggagctatgctatcactcctgccatggccttttctcatgctgttacctttgtatccaaggcctttcctcatccaccattccctagttcatttctgttcttcattctgcaaatctcaattctcaactcaacttttaaatttcttagggaaagttttcttactagaacactggaaaaagttctcctacaatatattcttttagttcacaatattatctttggcacttgtcacagtaaataactgtaaacttaagcagttatacggtcaacattggcctaataaggaagcccttcagagaatgactgtatcttcagttggtccttcatattcataggttccacattcatgtattcaaccaacctcataaaaatatattttaaaatggcacctgtactgaacatgtacagacttttttcttgtcatttttctctaaactacacactataacaaatatatacatagcatttatattgtactaagtattacaagtaatctagagattatttaaagtacatgggagaatgtgtgtaggttatatgcaaatactacacaaaacaacttcatttaaccattacttctctatttgatattttggtggcttagagttattttgctattatttttgaaaatttatgcaatgagaatacacaactctcacactgtgggtaagagaaaatttattttaaaaataaatatttgctgatcaaacagttggatgacaatatttgtttttcaaaaacaaaagaaaagacactgtcattatcaaaaacatcaaattttgaaataccagctgatggcaaggtaccacctctagagatctgtgaattaattggtgtgtaatgagatttgggcattgaaaatttttaaagttgcccaggtgattctgatgtgcagccaagtttgaaaaccactgcagaagatgcttatcaatgcccttttcacaagttgaatgctaccacaattaatgtaccaatggatataaatacagatgacgtggctctccaaaacaaagaccatgtcagctaatagctttatgtagcacttggcaggaaaccgtgtaatcacaggctcatagtgattaataaatctaaggggagaatcatttgggtgaaatgattcaagaagcattctttctccctactaatttggaatgcaacttacatctgaaagagatattgcacagatgtcagcccaagcagcaatgttgagtccctccaatgaagaagttagccagctccataactagtgaatcaggacaacagacactctcatcgtgccacaaggtcaaaaaacccacctctgtgctcagaatgactgggtttcaatctcagctctgccacttgctagtttgcaccttggtcaagtcttttaacttttctatgcctcagtctctatttttaataatagaaaaatgataaatatataataaggtatataatagtaactatttcaaaagcttggtttgaaggttaattgaaataattcatgtaaagcactgagcctaggtgcctggcctatagttaacactaaatatatatcagctgttactactttctcaagttaaagctggaaattcctactgaaggatggaaactcatccattttgttgttttaaagcttatttgtaagtcaaagaaaattaaaactgaaactgcagaattagcctagaatgaaataatatcaataacagaactaaagaatatcactaaagctgtattcattttcctaaatcctgataccaatgaagaaaatagactacaattagtgaaataagagtttgacaacaaaatagccctaaatctaaaagcaaaaaagaaaaattaatagagacagtagcaaaaattaatgaattagataatagaaaattaactaatcaataaattcaagacctagttttcaaaataaaaaaaaataaaatagataaaatcttaggtaacctaataaaaaaagggagaaagggagaaatcacaaatttaggatttggacaaagacttacttcatgtttacatttaccttttcttttattttgaattttatattctaggccctggtttgaactggtagcataggatttacatttggtaagtgttacattgactttgtttcttatagtctgttagtggtttggaacaagctgcagtggctcttggcatttgtgtgtccccaggggataactgagctggacagatttttttggcactttgggaactagctgccaaagcatccagtgaattataaatggcaatatttttgtatcagattatggtttagattaataaatttgtcttttggtgtctgttactgaggaaatttctttgacgcattctgtaagtagaagcatgaaatctctagagtggcctgatgcactaaaagccacagggagaaatataattgaaagacatctgtactgcaatgacaaagcaatggaaaggctgaagttcaaattgcaacaggctcaaaatatcaacacttaagttaaactaccggggctggtgcctggacagaaactttggagaacagatttttttttttagttgaaagttagttactagtactaatcttcctttgaaatcaggaaaccttctccattcccttgaggaacaaagtccccagtttgtgtgataaactagcacctcaacggagtccagaactaggcaagagaaagtaaagatgtcttccaagtcctcctatgcagatttgtatcacggtctcatttttcagaacttatcagtcaagcaatagctgtccaatccagactcaactccaagcagactgtgttcaggaaacctaagtcttttgtctacaatgtttataaaagcataaatcactgaaatgtggcatttatattttaaattatttcattagaaatttacaatttctatgctttatgagaacaaattaaactatgacttatgtttaagaattttgttactaattgtttgtacttaaaagcccaatttacaagcttttttctctaggaaataggggatcatgcatccttttacacttttcccccatccttcacccaatctctcataagcacacacacggacacatattatgtctaggagtcagtggatatgctcatagagcatctctctggaagagagaaaagtcgtgatttgtactgccttccaatttccatggtgtaaatattcccacagcggctgatttcaagctaacagccagctttagccactggcttacaaaattcctgaatatttaaaatcagctcttttaagtcatttccattgtctacaatacatctctgctgggactgtactgcctctgtattctgctccctaccctccagcaagcacttagtggttaggaaatttatcagttgaaacacacacacacagttaaagtccgaagcacaaatagatatgggtagcattaccatgctggtcaactagattaattccatttattttcttagtcactcagtcactctatgtttactgaatgtctaatatgtgtcagataccatgctaggcattgaagttaaaaataataaactaatataagcttattgccctggaggagctcagggtctagaaacattaggaaaaaaaagaacaaaaatattaaaatgaacaaaattatttgatgcaaatatatggaggcttcattgcatgcccattttggagcattgctgattttctatttcttttatataaagcctcccctaattaacactctccacagacagttctcagagtgccttgatttttcataagaataaatcttgtcatctcaactaaattataagctttgtacagacactgaccatattttgcatttatttcccatgctttgcaagaccagataccccaaaataataaaccaacatttgtatttccaaaacattttcatagatgttatctcatctgagcctcacagcagacctgtggtgtatgtagatttggtattattacaactagtctttatctttgttttataaccagaaactaaagcctaaaaaaggttagggaactgaccaaggtcatgtgaaccagaacacaaacgcatgtctttgaactccaaatcccatactcccttcactgtacagtaactctacaactttttattgatttatcaactgcatataaaatattcaatggtctttaacagagcacagatgaaattcttattcctgcagaccctaaatgtctagaataagaacatgtccttgtcctaagtgcctgtctatttccacaatcttagccagcatgcaggacccaaaagatgtaaagcacatcactgtcctaaatctccatttccaatggtagatggctaatttctgaatccatctggctactcggtgccatttattttttctattttatctccctaatgataatttaaagaaatagaacctttaagtcttaatttaagacactgtttccaataatccatcatggcaggaaccctttaaaaaacatcatggacaagaaatgtgaaatagcaacttattcctcaccctgtgctctccactgtcatgtacagagcccacataccactgctaaccagttccacatgggattgttaggcattctgaaagtcagaggcaatgttaatacaatgtttctacctcaaaggcatgtttataattttctactagctcctagatgagtctggtcccttgttctagttcaatcaaagattttgcaggaactttcaatctggatttcaacttctcatgttatcatgattagaggaagttctgcccccaggtacctgtcctgtgccctgccagcttcaagagctccaactggaggacagcaaccacaggagtagactgtgtgctacagtattaaaatagactttgggaagaaaaaagaaaaatgtgtaacccttaaagagcatttgtaacctgaatatccagatctcatgactttacaagtatatgcaagtatatataagcacagcatgaggtataatgtgtctcgcacaaaaacagattctcatttggtatttattgaacagatgaattattttgatgtgtatgcatgtgtgtatctgttgagacaactgacttacttaagtgtctttcttgcctattacagtgtaagctacttgaaggcagggactatgacttatttttgtccctatatctggggcttaacacagtcaggtatatagtagatactcaatatgcatttgcagaattaatgaataaacttggttcatattagcatcattatttaaatcttgccaactatgtcttactgtttatgaactaattttaggtctttgcaggaacatggtacacacatctataaaaccatccaggctgcccctccccttcttctgttattccagctcaggcactgctgctttattgacataattgttctctctgcttctgccaaagtgtagctctgggcccccactgccacagtgataattgggttgagtatttgctgatgtttccactttcacagccagctcatccaggaatctacagccataattctcaacagcacttcagaagtgttgctttaagaaaagctatgtcaccttcactgaccactgacccctgtctcctcaagtcaccacaaccaaagctcagcattttatgaaagattggtactgacttcaccaccactgtttctcataaaatgcaaatctctgcccctttatctggacacaagaactcttgaaaactgagagcagttcccttcttccatattgcactctgtgtgaaagcaatctgaccacagagtttagaatcgaaaatgttacagagttccaatgggtatatgacccattttctccttgtgcattttctccctggctgaactgaggtgaagtaacagctgcatgctctctagccagaatcaacacacctctccagacttgaagtcttgttgctaagactctctcctcggggtaaacttctttccctttaggatgacttgtccttctattttcatcctgaagtctggtttttattatctttgtaactcccaccacagctggtcagtcatgtctgttcttctctgagtcttgcttcaaaatcccttgcccatgagcttcttagtaccccctcatgaaaaatcaatgcattcacatagatatttgcctgagggggaggaaaagggtatgttattcctcacattagaccaaaccaaccaaatctcagatccagcctaactcaggttccattaaaatacataacacctaattctggaattttaactgaagcttctgcagatttagaattcttcttttctctagctaagacaaagagagaaaacaaaggagatggagactcctttattccccccagaagaagattccacaacatggctgtgctgcatctgacagttgcgccttacttttgagaatgcagtatactcttataaaaggattgagtggtccacttgtcagagtcacaggctaggtgagtcatgcatactcagagaaagaagcatttgcagccaggtcttccaaagtgacacctgggaaagagaaataatctgtcctgtcttgagcaattaggaatcagacaaataacactcaaagactgaggcttcctacgggaattctaagtatcaacagacagtctgcaaaattattgtttggcaggtggttttctaattatcatatatattatttggggagtgggatgttggagaatataaataacatcatctttgtttcatgccttacataatacagtattcgtggagggaagctacaagtactaacgaaagaaattgggtgggagactcatgcaagagtgtgctcatgatgggattcacatatattacaccatctactggtattactcccttccattccattgacatacttaccagtcttgtttcacccaggaagattttgtgtatcaaccaattgtatactttaaggacaggctagggactagggtgccatggaaattctgatgtgactcaggaagcattaaaaatggggaattcttattcagaaggacaatccttttgtacatgaagttcagtagcctattagcctttgggattggggtaacccaagctcaagttaactacatttagttatcaataatgaaaaaacaagataacccccagtatctactctaattttaccatccaaggcacaggtgccaccacacttataatccatgccacatcaaccaggaccttgctaatagctgccctatgcacagaatgtttcagagttagtatgttcctttggaagatatttcataaataatctgaaggggattatattgaagttcatataaaataataaaattatatagggagtctgaagtagagatgaccaaaaacaaaaaaaatccatcacatattcactgactgggctaaccaagacataagggaataggaggcctatatggagtaatttctagagtctcccacagctgtcacattgcctgaaactccaggatccacacatattcataaaggactttatgttttcgctatgatgaagaattctgttccctcaatggggctaattcattgaagggataatgtgatacatcattaagccatttgtagcaagatgaaaaatccagagcataaagatacatatgacaaaatagcatccaaaagaataaaatacttagatacaaacctaactcagaacacgaaagtgtgtacactgaaaactataaaacaatgctgaaagaaagtaaagaagactcaagtaaatggaaagacatcccatactcatggattgtaaaacttagtattgttagcacgtccatactacccaaagcaatctacagattcaacccaacccctaccaaaatctcaacagtattttttgcagatatagaaaaattcctcctaaaattcatatgaaattttcgggaaccccaaataaccaaaacaattgggaaaaggaagaacaaagttggtggacatataattcataatttcaaaattacaacatttaaaactgttgtactggcataaagacagacaagtagaccaaaagaataaaatagggagcccagaaataaaccctcatgtacacaatcaagtgatatttgatgaaaataacaagattactcagtggaaaaaaagatggattttctacagagagtgttggtaaaactggatatccacatgcaaaagaatgaagttgaacccttaccttatagtccatacaaaatttaactcaaaaagattaaagacctaaaattatactagaagaaaatatagaggaaaagtctcataacattgtacttgacaatgatttcctgaatatgataccaaaagcataggctacaaaagcaaaaataaaccaataagactacatcaaactttaaagcttttgagcatcaaagaacacaatcaacagagtgaaagtgcaatctatgaaataggagaaaatatttgcaaatcatgtatctgatagaagttaatatccaaaatacataaagatttcctataactcaagaatgaaaaaatcaaataacccaatttttaacatgggcaaagaatctgaatagacatttctccaaatatgattgagatacaaatggccaacaagcatataaaaagatgctcaacataactaatcatgagaggaatgcaaatgaaaaccataatgatatatcacctcatacccattagaatgcctactatcaaaaatcagaaaatgacagtgttagagaggatgcagagaaactggaaacttagttgcacagtgggtgggattgtaaaatggtgtaattgctacggaaaacagtatggttcctcaaaaaattaaaaatagaattaccatatgatccaggaattccacttctgggtatatagtcaaaagaattgaaagcaggatctcagagagttacagtcatgtgtctcttaatgatagggatacttctgagaaatgcattattaggtgattctgtcattgagtgaacgtcatagaatatactatacttacacaaacccagatgatatagcctactacacaactagactttaaggtatagcctactgctcctaggctacaaacctaggctatggcatgttactatactaaatactataggcaattgtaacacaatggtaagtatttgtgtatctaaacatatctaaacacagaaaagataaaataaaaataccgtattatggaaccacacacacccacgtttgtaacatcactattcacaataggcaaagaggtgtgagtaatccaaaggtctatcaacagatgaatgaataaacaaaatgtggtatatacatgtagtggagtattattcagccgtaaaaaaggcaaaaattttgtcacaaggtaaaacatgggttaatcttgaaggtatccatgttgctaagtaattatcatttgctaagtgaaataagccagtcactaaaatgcaaatactgtataattctactattatgaggcatctaaagtagtcaaattcatagaaacagaaaaaagaatggtggttaccagggttttaggggagaagaaaaggaggagtcgtttaattaatatagagtttcagatttgcaagataaaaaagtgctggagatctgtttcacaacagtatgaatatattttacattactgaactatacacttcaaaatggttaagatgtcaaaaaatgcaattaattaattaaataaatatgatgtacaccctaaaagaataaaaagagataaatagaatgttccctgaacaagccttgatcagtagagctccacaatgaggtgctatgtgcctgaaggttagaaagggctggagtgccccaaaatgatttgctgtgtgtaagtgctaaagaacccttgtcagttttatggttttgcctcaggccagcccttagcctggttttgctgcttttgggaaaagccagtacaattctgagagggggcatttatacattcacagtttattcatccattcagcaaacatttcctgaggctcaactgtatgctagccattgtgtgaggccctggggatacacaaagaaggaaaagtccagactttaaggagccctcatatcaaagcctccttgagagatgccagagctgcattcccagatgagagatataagattggtcacctgaacaattgatggacattaaaagcagcaccacaaaactaaagtgacagaaacctagaaatctattagttcagtccttccctgctgtcttccccactcatccaatcccaagtcaaaataagcaaaagttgctatatctacatgcatacctcagagacactgcaggtttggtttcagaccactgcaataaagcaaataacacaataaagcaagtcgcacaaattttttggtttcccagtgcatataaaagttatttttacgctatactgtagtctagtaagtgtgcagtagtattactgctgaaaaaacaatgtacatatcttaattaaaatactttattgccaaaaaatgttaacaataatctaagccttcagtgagttgagatctttgctgttggagtgtcttaccttgatgttgattgctgactgatcaggttggtggttgctgaaggctggagtgactgtggcaatttcttaaaataagacaataacattgccatatcaattaactcttcctatcacaaaaaaaattctgtagcctgtattgcggttcgatagcattttacccaaagtagaacttctttcagaattcaagtcaatcctctccaaccctgataagactttacaactaagtttatataatattttaaattatttgttgtcatttaaacaacgttcacagtatcttcaccaagagtaggttccatctcaataaaccactttctttgttcatccataaaaagcagcttctcagccgggcgcggtgattcatcatgcctgtaatcccagcactttgggaggccgaggagggcggatcacaaggtcaggagatcgagaccatcctggctaatacggagaaaccccgtctctactaaaaatgcaaaaacttagccgggcatggtagtgggtgcctgtagtcccagctacttgggaggctgaggcaggagaatggcgtgaacctgggaggcagagcttacagttagccgagattgcgccactgcactccagcctgggtgacagagcaagactccatttcaaaaaaaaaagcaacttctcatttgttaaagttttattgagattaaaatactttagtcatatcatcagcttaccacttctaattctagttctcttgttatttctaccacatctgcagttagttccttccagtttcaccgaagtcttgaaccccacaaaatcatccatgaggtttgaaaccaacttcttccaatctcctgttactgttaacatttttacttcttcccatgagttatgaatattcttaatggcacctagaatggtgaactctttttagaagattttcaattaattttgcctaaattcatcagaggatctatatatctatgacaggtatagtttacaaaatatatatttcttaaataataagatttgaaagctgaaattactgattgatccaggggctacagaatgaaagttgtgttaacaggcacaaaggcattaatttccttgcacacctccatcagagctcttgggtcactacgtgcattgtcaatgggcagtcatatttttaaagcaagtctcaacagtggctttaaaatatacagcaaaccacgatgtaaacatatgttctgtcatccagactttattattccaattttacagcacaggctgagtagatttagcataattcttaagggccctaggattcttggaatgatacatgggtgtcggcttcaacttatcgtcaccagctgcattagcttctagcagaagagtcaagctgtccttagacactttgaagccagatattgatttctcctctttagctatgaaagtcctacatggtaccttcttccaatataaagctgttttgtctccattgaaaatctgttgttgagtctagacatcttcattaatgttcttacatagaccttctgaataattgctgcagtttctacagcagaaaattctgcttcatcttatgcttttatgatatggagacaacttctttccttaaacctcacaaaccaaactctactagcttaaaatgtttcttcttcagcttccttaactctctaagctttcatagaattaaagagagttagggtctttctctggattaggctttagcttaagtaaatattgtgtctagcttgatcttctctccagaacatgaaaactttctccatattggcaataaagctgttttgcctttttatcatttgtgtgcttacgggagtagcacttttaatatccttcaagaacttttcctttgcattcacaacttggctatttggcacaagaggcctagaatttggtctgtctcatcttttgatatgccttccttagtaagcttaattgtttctagttttttatttaaagtaaaagatgtgcaactcttcctttcacttgaacacttagaagccattgtagagttattaattggcctaattttaatatttagtatctcagggaatagagaagcccaagaataagggagagatggtggaacagcctgttgatacaacagtcagaacacacaacatttattgattaaatttgccatcttctatgggcactatttgtggtgcccaaaaagagttacaatagtaacatcaaagatcacaaatcacagatcaccataatagatataggagtgtttaaaaagtttgaaatattgctataattaccacaaggtgacacagaaactcaaagtaggcacatgctgttggaaaaatggatttgtttgtcccaggattgccacaaacttcaatttgcaaaaagcacagtacctgcaaagtacaataaagcaaagcaaaataaaatgaggtatgcctgtataaactcctcaataagcataaaagttcatgaacaataaatacccattgaaatagaggaccacggaaggtggcttcagatttataaacagctgcttcactaaccagcttcctataaagctactacaattgagacaaatagacctgctcgaagttcttgccgtggaagcaggtgctctgcctgcatcctagtgtttgctttgcagtttgtctctgtacagatgcccccacccacctcacaagccattttccatcagtacatcaatacccttaagagtgacaaaaacctgtaactggtagattgagaggatcagctagctctatgaggtaaaattactagaaaccactgtttaaaaagcagtgtcgaatcaactttgctgatgactaaccaggcaatgtgcaaatcactaaaaatttctggatcacacttgcctcttctataaaatgagaacttgtattcattgatctctgccattcttagattctatgtaaagtcctaaaaaaatgatccagggaaatacctggctaaaacagtgatttcaaaggttatgtctgcctctaaagcagtggttcttaaaatgtggcccatgcacctgcaacatcagcatcagctaggagcttgctaaaaatacattcaccctagactcatgaatcagagttgctggagatgggagccaaggaatccacgtttcaacaagccttctaggtgattctcatgcacatagaagtctgaaaagcatcgctctaaagcatcatggtatcataatttaaaacatctgcttgggctttaaattccgtgagttgctctattgtgaatatacaatgtattttctctctaaaggaccccagatagaattgaaaacttccacctttttatttatgatactatttcatgtgcatacatctgtcatagaatttgccttattttgaagaacatgctattgtctgtctccagtatagagggaaaggactaaatctttttcaactttgtggctgtaggatttaggatagtgcctgtgggtcctttgttgagaatggatacacggatggatgaatgggtagatggcagatagatacatgcatggatgacaaagtgtttaaaaatccagaaagcctcgtttgagtaaaaggaagagttaatatcaggcagcaagaaactgtaaattttggcttcagcagtataaatattgctgtattggggcctaaatagattttctatttattcctgctattcctgtacttgggcctaaataaattttttccagctaaaaattatactggtgagagtactgatcctgagtaaacaactgagatctgctcctgaatcacccaggcccctttggaacagcctggaggcatcacattgacttccagttctctcatgtgaatgaggcagataacaccacctgtcgtgttcctgtctcacagggacactgagcatattaactaataatgactatgaatttcttttgaggttctatgagaagattgctatatatataggaaatgttaattaaaagatcaaacatttgacagtattttaaacaaacttaatcagttttgccaaggtgaggcaggaagaaaatgaactggctgtcttctccttaaatagaaatcaaaaatcatccacattctgtgtctgcttgttctgtgaaagactgtgtgtgcagctcataggaatcttccctttcaaatgtgaaaggaaatgcaacactgaaaacccaggagggataggagatgaggagttaaatcatacaactaaattatcagaatgagatgtttttttctggcatgatatggtcgggaagaaaaataaagtctaatgttcccatctatatttttatgaccattttcaaagacaacaacataaaatcaacctatgcttatctgtgattcagcttcttcacctttaaaactagccaaactaagctcatctcccaaagatgttgagaagataatatgacgtggcatagaggattgttttggtggcaaaggaggctttttgccaaatgataactttggtttttatgttgcacttgttgatattttgctgtcatggaaaactcctcagcatgaacgcttgaaccttcaacatatagaacatatatattacagtttaccgatggctcttaaaaacatattcttaattagtctacccaataatgctttcaagtagacataataattcctattttaagtataagaagagtaaatgtcagagaagtttagtgaagagctcaaggtcattgttattaagtggcagaattaaaagttcccccaggacttctgacttagcttccaagtcagctgctcaccctactggtgtaagggatattaggaagggaggaaaggagagagaaagagtctagggatgttagtatgttttttgtgtttttttgtctgtttgtttttttgagacggagtctcactctgtctccaggctggagtgcagtggcgcgatctcagtttactgcaacctccacctccagggttcaagcaattctcctgcctcagactcccaagtaactgggactacaggcacccaccaccacacccaactaatttttgtatttttagtagagacggggtttcaccatgttggacaggatggtcttgatctcttaacctcgtgatctgcccgcctcggcctcccaaagtgctgggattacaggcatgagccaccatgcccgtccataagtatgctttaacaaataaaaaaaaatcaattagtgtaatttactatattagtagactaaaaatcaaacaaacatatgaccatcccaatatatgtaaaaaagcacttgacaaaaatccaacagccattgctgataaaaaatgttcggcatactagcaatggaagcaaacttctgcagcctgataaggaacattcacaaaaaaatctacatccaacatcatacctaacggcaaagactcaatgcctttcttctaatatcaggaacaaggcagggatgtctattgtcatattcaacattgtactagctgtcctaacctgagttcaactaggcaataaaaataaataggcacccagattgtgggaaaaggtaaaactgtctttatttacagtttttattcacataagacataatcatctatgtagaaaatcctgtggaattttaaaagagatactgaaagtaatcagtgagtttgtcaagtctcataatacataaaagtcaactgtatttctacttactagcaaaaaagaacttgaagttgaaataaaaaacaatatttttataatgacattaaaaatagaaaatacttagagatatatctgacaaaagttgtgcaatccttacactgaaaactataaaacattgctgacacatgttttaaaaagcttttaaaaagggagagatctaccattttcatggaccagaagaatgagtattctaacgatgctagttctccttaagatgatcaataaatccaatacaattgcaataaaaatccttataggctttttgtagaaattaatacactgattctaaaatccatatagtaatgcaaataatgtaccaaagctacaacaactttgaaaagaaaaggaggaaacttggaggacttaacctgatttcaagacttattataaacatatagtaatcaagacagtatggtattgttattaaaatggacaaatacataaatggaacataataaagtgttcagaaatagacacatttattatcaattgatttttggaaaatgtgcaaaagtaatagaaagaaaaaaatagtttcttcaatgaatggtgctacacaactggatatagggaggtaaacctattaacaatcaagaacttggttctgtatttatatcatatgcaactattaactcaaaagagttcgtagacaaaatgtaaaatctgaatctataaaactactaaaaaatgggaggaaatcattgtgaacttgagctagacaaatattgactaaatacaacactgaaagcattagctggaatggaaaacaattgatatcaaacttcatcaagattaagaacttaggtgtattaaaaatacttttaagagagtaaaaagacaaacaacacattgaaaaaatatttgcaagtcgcatatctaggagctttgcatatagaatatacaaatcattctcaaaaatacaataataagaaaacaaattacccaattttaaaaaggggggcaaaggttttgaaccagcctatcaccaaagatatttaaataacaaataacacatgaaaagatattcaatgtcgttagtcattagggaagtgcaaatttaaactacaatgagatactgctacatgcattttaaaaagtcaaaaattttaaaagactgacatcatcaagatttggtgaagatatggagcaatttgaaatctcatatactatcaatatgaatgtaaaatggtaccaccattttggaaaaattttggaagtttcttaaaaagattaatatgcctattacattacccagctatttcacttctaggtatgcagtagtagtgaatgaaataatgtgtgcgtacaaagacctgtcaacaaatgttcatagcagctttatttgttagaatcaaaaactagaaacaacccaaaatgtacatcaaccagtaagtgggaaaacagttgtggtatatacatgttatagaatatttagcaataaaagggaaaggaactattgatgcaagtggatgattgatacaacatggattaatctcaaaaacattactctgagttaaagaagccagataaaaaagagtacatataaaagtctagaaaatacaaaactattctatactaacagaaaacaaatccatggttgtgtaggatgtcaaggtggctagaggtgtttattatcttgattatgatgatgatttcaaaagcgtgtgtgtgtgtgtgtattgtatatgtgtttcaaaacttatcaaattgcacaatttaaatatgtgaagcttattgtatgccagttatacctcataatctattaaaataaatacagaccatatgcggtatgcagttacaccactgacagttgtcagacagctactttaaggcagagtaataaatggcagcatatacaaccactctgggtcactttcaattttttgtgcacatggtctggttgcctaaataatttggtggacagaaataggtgatttccagagctaacaagatttgctaatgaatgctgttgaaacagacttatacattatttaagttagagactaactgtgtctgactataggacaatgttgcaggaagtcaggaaccacaaacgaagggaccagctgaagccatggcagaagaacatggattgtgaagatttcatggacatttattagttccccaaattaatacttttataatttcctatgcctgtctttattgcaatctctacacacaaactgcaaagatttcatggacacttattacttccccaatcaatacccttgtgattttatatgcccatctttactttaatctcttaatcctgtcagctgaggaggatgtatgtcacctcaggaccctgtaataattgcattaactgcgcaaattgtagagcatgtgtgtttgaacaatatgaaatctgggcgccttgaaaaaagaacaggataacagcaattgttcaaggaaaaagagagataaccttaaactctgaccgccagtgagccgggtggaacagagccatatttctcttctttcaaaagcaaatgggagaaatatcgctgaattctttttctcagcaaggaacatccctgagaaagagaatatgcccctaagggtgggactataaatggcccccttgggtgtggccatcttctgtggttgaaactgtaggggtgaaataaaccccagtctcccatagcactcccaggcttattaggaagaggaaattcccgcctaataaattttggtcagactggttgctctcaaaaccctgtctcctcataagatgttaccaatgacaatggtgcccaaaacttcattagcaattttaatttcgccccagtcctgtggtcctgtgatctcgccctgtctccatttgccttgtgatattctattaccttgtgaagtatatgatctttgtgacacaccctatttgtacactccctccccttttgaaagactccctccccttttgaaagtccctaataaaaacttgctggttttgtggtttgtggggtatcacggaacttatcgacatgtgatgtctcccctggacacccagctttaaaatttctctcttttgtactctgcccctttatttctcaaaccgggcgatgcttagggaaaatagaaaagaacctacgtgactatcggggcaggttccccgatatgacaagatgagaaaagtcagtctacttgttctgaatcctataagaaatccttcaacatgtaggaagtagccactggataatggaaagaccatagggatctgaatcagatctggacttgaatcccagctctgctacctactatctcaggaaagataattgaactcaattcttttatttccatagattgaggataataattacacttgcctggtagccatttgatgattaaataagatagtatacactcaacattcaatatttcatttttcttccccttccccatacactccagtaagatccatcttcttcctattctctaggctagccaggcttgtttctgtctcatttgctcatgaccatgggttattaatccagggcacatgcacctgagtttaatggagcacaatatgcagataaccagatttatgcatcagctaaattggggaacagttattcatgttagcaaattggtcctcacattaccaataaataggtcaccagtttcccccaagatatgcaaaatcttcagagtatttaaagtgccacttgacttgcaaactttcatttacatgtaaaagtaagtttaatcaatttctaattttccaggaatttctccatttttcagccagaataaaagcaaatttgtcctttcatctgttggggcaaactaataatttgatattcaaagtgtcactgaaaataaactccactgtgggactcatttatgctgtgaatgctaaaaatctgatccaacaaaagcaaatagcttcctttcacattgaattaaaatcaaagagagacaaagatacagaaagacagaggcacaaagagatgaaaaccttataggttggagaagaaagtctgacttagtttttaagaatttcattttcatcttgactattaacaaatatattttatttctgtaggatttcaataggaggagaaacatgatacaatttaccttttctctaaagcttttcttaaatttagtcttaatagaaatatctgcctttattttgactatgaagcaatatttggatacgtatttttgagtcttaaaagtttactcaaatatagtgataagatagtggcacagttttttggcattctgcatttaatttgtttttttttttttggcttttaaatcctgaaatttaaaaaagtacataaaagctgtaaagctaaaaatgtattcatatgttacacaagcactgataacccattaaatttgagcaacaaagtctaaagtagtgctcttagaatacaggctgaggaaggactccctgtatcaacattatccatgttcctattataataaaaatgccaatttttggactttctccagatctcttgacagtagctcccacgaattgaggtgttgttgttttttttattttttattttttgttttttttgctagacacgttacgtgactttctacactggaaatttgaaaacacatgggctttaaattggagcggaggccagcaagtaggtaggaaagagaaagaaaagaattgaaagaaaagttcctatcactaggcaaaatgaaaatcagcatgaagccatgtgaaggatcctttaccacaaccctgagagatgctatactaagcccattttaaagagctgtcaagtgggctttaaaaagccctccagagcctgctgaaaaatacagttcttaaacactgtgctgttgcattactgtctctgcccagcaggtgtatgttgtctagtgtccttctgtagaagcaggatgcctgctagagcagtccatggtactggggagaatgagcagcattattcaataagcctagggcatctttttatccagagctccctgaacgaaatggccagggctgggaaaaaagacagcaatactggacattaacgggaagccatgcaaggattagtttggatggagaattgctagaaaagaccatactccataagaaagccaggttcccatgacctaggatgcctgctttttcttactcattcatgagtgagcctttgttcataactatgaatatcactgcaggcgaccctgtatgaaaaacgacagactggcatgaagataagaagattctccccactggatatcccactgtttattgccagctaacagatgtttactcaaatctccagaatttacttatttttgagatggagtcttgctctgtcacccaggctggagggcagtggcactattttggctcacttcaacctctacctcccgggttccagagattctcctgcctcagcctcctgggtagctgggattacaggcacatgccaccacaccgggctaattttcgtatttttcatagagatggggtttcttcatgttggccaggctggcctcaaactcctgacctcaaggaatctgccccctttggccttctgaagtgctgggattacaagcgtgagccaccgtgcccggcctcaaatctccagaatttaaaagggatttcctgctgttcctgttgtgccttccaccctgcccactcagcctcaggccactgcaggctgaggcctctctcctgagagcggcttcctgctcagttgatgaatagtcaggcaaggctgaagcagtagcccccgcccacagaccacggtttccagactgataaacgcaaattctcttgtaactcatttctcttcttcctgtttgaaagagtgaagatataatgtaggcacatcttttgttgttgttgttgtttaaggctgttttcacgcttggtgcttgttgtgtgtaggcaggactaataactgtgagcttgttttgagagggatctccttgtaaaggttgaggaggaaaaaacaactcaaataaccccagaatatgtgaggagattatgatgtggatgagttccatagattaaggtctcctctcctggaaactaggaaacttattgaaattacaaaggtcaaaatccagagacattatcttttgcagaggtctttcgcctttcctgatttaatatctgccacctagtgagaggttgaggaacaggcatcgcagaaattgaacattcacggctattttcaggctacaatggctccctaaggctgagagtaaaaaggaaattgtcgaaaagagatatggcagcaacatgggagaaacagctcttgaagctttctgaaggccttaaaccccacttccaattccccttctgaacaagtacaaaccgtcctaggcccccatctcctctacctcctttattcttccttctccccttcctctttcttttcctttttctattcctaccacaaagcccaagtggcagatgatcattttcaggccctagcacaatagacagacacttagtccctttcctcacactctccaccctgacgcctcaaatgcagtggcttttttcatgagcttctgcacatctgaaggaagagtatcaatcaggaccgaggccatagataacgtattagtaacgttcttcttgtacaatattcagaaaatgtcttcatctaggactcaaggcagaaatatataaatatgattaaaaggaggttaacccatcttaatggaaaccagattaattgctgtattagtcaagattctccagagaaacagaacaaatagaatgtatatacagaaagaaaaagattattataaagaattggctcttacaattatggagactgacaagtcccaagatctgcaagataagtcagacccgggaacccagaagagctaatgttgtagatccagtctgagttcaaaggcctaagtatcaagagatctatttgcttagtttcggtcccaggaagagctgatgtctcagttcaaatagaaaaaagccaatgacccagttcaaaggtagtttggcacgaggaattctctcttactcaggaaagggtcagctctttgttctattcaggccttcaactgactacatgaggcccatccacattagggatgagtaatctgctttacttaatgtgctctacttaattaagatttaaatcttaatctcatccaaaagcacgcccataataataattatttaaattaattaaataataatatttgactgaatgtctgggcaccccatgacccagtcaagttgatacataaaattaaccaacccaatttcccaaaagctgggttttcataaatctgactcataaaatacagtaagtggaccattagtccacttattttttatcagtatgaaatcctttttcaggagctattcactggagttttaagaaaaatagttgcctgacacaccactaatctagaggtcatatccagagtgacatcattttatgagagatgaccactggtaaagtggtatatgtttcccaactgtcacataaatgggaaaggtgggcctgtttcctttctgaaggtatttcaatgaggggttttgttataagaatatctttctaacctccagagagcccagcacactccaaaggtaaggaatggcatgatgagcaaattcaatccatttaattcttctattccatgacttctaattggttatgttaaactgggaatgcacctcagctcagggttatgattagcctcacagattgctttgtagatgaaagtcctcagaactttcctattaatagtcctctatggagggtattgatctttgtgagaaaactgcttgcatcctgatgcatgcaaaacttatggcttttatttttatctgtacctttggatactaaggcaattaatcctcacaatacaaacaggactgatacacctaatttcttaagccattacctcttccaggtaaaccctagtgagaacttctagcctttatgcaaacctcaaaaaaaaattaggaatactttttaatgactgaaaagtgtacatggatctaaacctccaaggaaggtgagcatggggatttgctcaagttcttccctgaccttctcttggctctggaaaagtttggatcacttagacaattttgcctgagtgtctaattcattgaggacaaaaaggaatcccagccagtgatggcaaaaggggcatcatcacacaagcatgaagctcccaggacaaccctccctacctaccaaagactacaccatttatttattccaatcaatccagaaaaggaggaaggcagtgaaattgcttaaagccaacaccgagagctgaacttaaactcaagggacatgtgaaggcctagactttattacaattgcataataaagtggcactattgatttatttaaacattacctcactggcaatagcaaatattctgatattaaaaacattaacctgaacaatgatgataaatttccttcagagagacatgttgtggtctctttataccatcagtaaaaccatgccatccgctggctaatgtaataacacacacccagacacccccatacatacacttaaactacttttggaggatatgagaagcttgtttttcaaacaataagtcgataagattccactctgagaatcatcaacatccagaaagagcagctcactccttttaattcaagtcccagatatttatagatcaaggaaaagattcatcacttaggtagaaagctgctttcagttacttttcttctttttttcttaaatctcttttaaatggaaagcagccatcttttggctataaatagatagaagatagatagaagatagatagatagatagatagatagatagatagatatcattatttacttttgaatttaattaaaaacataaaagattaaaaagccaacatgcttttactgccattttgttattgtacatcagataagaaaaaggagaacacagatctctgcagaataatgcagagagtggcttgaagctgtgtgtgaggtggaattatgttgtgagagtgggggtcatgggaagaggaaccattgtaaactaactggctagctagagcctgtctaggcatctgtggaaggggaaggcaggaacagagcagaaataataggagaaagaagagagaagcagctggaaaactgaaaaagaaaaacaaacacgctagggaaaacaacacagtggttgcaaagtagaggaaaagtaagtccaaaaatggtaaagtgaggattattatccaagcacctctgacaataagaacttactgaaaaagttgaattaatgaaatcaaatatttcttcaagtcaatcaaaatatgaaactgactcttgttccttgtcagaaatcaatgtaattttaaaagactaagtccttctttgggaacagtactctcctagcaatgttgagctattttttaaaaaattatcatcaataaaacacaaactaaaaatctcattggcaatgaaaccagtcaaaaaccttaggttgaaaatcatttaatgtgtctgttttaatgatttatgctaagcttaaataatgattggataaaaaaaatctaaataaggctgagattttacaaataagaccttcaacagaacatgttacagagaagagaaacatacattctcagctcgaagagtttttatgtgaattacatgtaaaccccaggaaaaaatgagatgttctgagatttagtaaagccatcttggatcctctagcaataagtagaagaccgtctcaatgattacttccaaaactctattctttaatgggtatggaatatttatttacttcagcttaactgttttaataaagggttttatcttttttttttttcctttagaactgctcatggtctactcataaatgtgactcttgtcagaaatcaagctatactatgacatctggtggtcacatacctaaattgaatgttctatattttggagaaatgaatgttattccacaaacttaaataatagaatggtaaaagaagtaatagaaaataccattaatcaaagtcctaaaaataaacgtttgcataattgggctcactaaaagaaggcgtttttaaagttccattttgaggggcccagttcagaagcagtctgaaatctgatgcaatgttatgaacgacttcatgtcaactgatcagaccctcagaagatggtgctggctgaggccctgagagtcagaaaggaaattatatacttggaatatgtctctcatatataactcattctatgaggccagtatcttcctgatagcaaaacctgccagatacacaactaaaatagaaaactgtagacctatatccttgataaacatagattcaaaaattctcaacaaaatactagtaaaccatatccagcagcaatacattagaaagctaggccaccatgatcaagtaggttttatccctgggatgcaaggttggttcaacatacacaaatcaataaatgtgtttcatcacataaacagaactaaaaacagaaaccacgtgatcatctcaatacatgcagaaaagacttttgataagattcaacatctttcatatttaaaaccatcaacaaactaggcattggaggaccatacctcaaaataataagagccaatctatgacaaacccacagccaacatactgaatgggcaaaacctggaagtattccccttgaaagctggaacaagacaaggaagtatgcccattctcaccgctcttattcaatatagtactagaagtcctagcctgagcaatcaggcaaggggaagaaacaaaaggcatctaaataggaagagaggaagtcaaactatctttgagtgcagatgatattattctatacctagaaaacctcttggtctctgcctgaaagctcctagatccaataacgaacttcagaaaactttcaggacacaaaatcaatgtagaaaagtcaatagcatttctttacacaaacaacatccaagctgagagccaaaccaagaacataatcccattccctatagccacaaaaaataataaaatacctaagaatacggctaaccagagaggcaaaaaaatctctacaagaagaattacaaaacactgctcaaagaaatcaaagatgacataaacaaatggaaaaacattccatgctcctggacaggaagaatcaatgttgttaaaatggccatactgaccaaagccatttatagactcaatgctattcctatcaaacaccagtgacattcttcacagaattagaaaaaactatttaaaaattcatatggaaccaaaacagagcctgaataacagaggcaatcctaagcaaaaagagcaaagtgggagacatcacattaccccatttaaaactgtactacaaggctacagtaaccaaaacagcatggtactggtacaaagacagacacacagaccaatggaacagaatagagagcctagaaataacactgtacacctacaaccatctgatctttgacaaagccaacaaaaacaagcaatggggaaaggattccctattcaataaatagtgctgggataactggctagccatatgcaaaagattgaaacaggatcccttccttatattatatacaaaagtcaactcaagatagattatagagttaagtgtaaaacccaaaactataaaaaccctggaagacaacataagcaatactattctgtaaatagaaactggtaaagattttatgacaaaaacaccaaaaacaacttcaacaaaagtaaaaattgacaaatggtacttaaactaaagatcttctgcacagcaaaagaaactttcaacaaaggaaggagatcacctacagaatggttgaaaatatttgcaaactatgcatccaacaaaggtctaaaatccagaatctataatgtactcaaacaaactaacaagcaaaaagcaaacaattccattaaaaagttggcaaaggacatagacactttcgaaaagaagacggacacatggccaacaagcataggaaaaaaatgctcaacatcactaatcattagagaaatccaaatcaaaatcacaatgaaatgcctctgacaccattcaggtttattattaaaaaataaaaataaaaaaacagatgctggtgagattgtggataaaaaggaacacttatacactgctggtgagaatgttaattagttcaaccattgtggaaagcagtttggcaatttctcaaagaacttaaaacaaaactaccatttgacctggcaatcccatcactaggtttatgccaaaaggaatataattattctaccataaagacacatgattgcatatgttcattacagcactactcacaatagcaaagaaatggcattgatctaaatgtccatcaatggtggactggataaagaatgtggtacatatacacgatgatatattatacagccattaaaaagaatgagatcatgttctttgcagcaatatggatggaactagaggccattttcctaagcaaaccagtgcaggaacataaaatcaaataatgcatgttctaacttataagtgggagctaaacattgagtacacatggacacaaagaagagaacaacagacaccagggtctacttgtgggtgaaaagtgggaggagggtgagaatcaagaagcttcctatcaagtactatgcttagtacctgagtgatgtagattatttcatctatacaacaaaccccgatgacgcacaatttagctatttaacaaacctgcgcatgtgcccctgaacctaaagcaaaagtttaaaaaattagaaactaaataagcaaataaataaatgctgaatgtatgaatgacaaagaggctcggggtggttaaatgagtttcccaaacttatgtattaatatttttggtaaatataaagtgtcaagatttcaatccattctgtcttctctaaaacctagatgctctcattgataccgcagtgattggtaggcaaactttaagaggtttaataggttaactgtctcttcatgtggatgtcctttataatttagttaacttactttggcatgaaatctctttcttgagctgcaggaagcccagctgcaggatctattttccacacagtgctagagtccttggaatactttgagacacatatgtcctcctaaactcctaaaaaagaaaaagaaaatcttcattaggaaaatacctgtatcttttccctattctcctaggagtctgataaaatttttatccatttatattcccttgcaaagcaaatgatcatatttagcttcctgatgagatcttttctaattatgattttgtgccttattgcatatcactaatatctaccaatattctacactgagagatttaattcacatcctcacatttgcttctgcattaatccacacttgaggcatgaattctagagtcaatttccttcggatgcattgcagccctttggtctaactttaacccagaatatgccagacctctgaattgtgtctagtttaatccctaaatgttagaatctatgttcaaccttcaaccttccacccagttcttttatctttccatacatttaatttaccatacacccatcatgttctacccagtatttatgggtattaaatacatataacttaaaaaacaaacttgtataaatctcttccttatgtaagtttttagggtagtaataggcctagattaaaataattttcaccatccatggactacctgcctctaaacatgagaatataaacccatgatcaagctattacctacagccggtcctgactgatggggtgaggagacaaaaaaggaaagcaactggagcacattacaggttgcttgcaagaatatataaggtcatcaggacagggttctaaagggaaagaaaacatgtaaaagggagaagatagtcattagagaaaaaacaatcttgactgtgttaatacttgtcccaaggcccggtccaaccccttcaaaagcctgatgactattgaccacagtggggattaaacataagctgcacagcaaaaagcaactctctgagcaactctccctgtaggacaggtttcttacttctccacagaaaagtgttccttgctgccatttttctgtttcattaggtaaaactcatttcataactctcaaactaacttcaaaccatttatcatgtttatgtttcaaaaagcctttttcattgccaagcaaatagaggataataaaaatggctggattcatttcagtccaggagcaatggattctcatttattttcagtactaaatcaaaacatgactgagtttggtttctacttttaaagaaattatactgattttaactacactgcatgtataaaagtgcctgtgaagagatggccaatccttaataaaaacccaagccatggaagtttgctgacttcttaccatctctcctaggtcctggggcagaaaatgtttcttccatatcactagaaggtacaattccctaaactccatgagcacccatgggatcattggtttagtctgttactgtggaaatcatatcctaggacaagtcaagagccaaatcaggggaacagggtgaggcaagagaggcactcacctcaggctcaaaatttaagatgggtaaaaaaataggttattaagataaataatatttatgtgatatttttgaaaaagcaatgacccaaaatccatgatgaagaaaatatcaaagtttttaatacaaacagaatctgaccctgcatgtgcatgacaccttactcatctcatcctaatcccagctctgatatcaagttgggctggaaggtctccattgggtcagatgtaatccttcctgtatttgggggacagttgcaaaataaaagcacagagaaaaaaggcaacaaccattgaggtgtaaccttgggaaggatactgactatttatagagtatgcaaggccccacatggatctcattaatggctttcccagaaaatcagtgccttcctcctcccatcattccatctccagaaacatgttgatgtttacctggcctctgcatgttcaaacatagcctaggatatttccataccaccatgccctcagacaggacatccttgctccagctccactggcagtgatgtgcccctatagcttctgagccttgatgatgcccagagatcccctctgaacccaggcttttctcaggtcccactttatcttgagcccaagcccttctaattctaacatagcgtggttaaaaaaaaaattgatgtcagtaggcaacagtgacctgatatttttctatttttctaatatttggaaaaatataacaccatgattcttttttctgttttcattaaggtaacccaataacatgacttccaattaacagatgtctcattcctcccttaggtgtggccagaaccacccaggctgaataggtcttttttgtgaaaccttcgttagtgcaaatggtacagtaggtaaaaatggaacttcatacccaggtcttgttttaaatatgattgccatatgtacttgtgagtcatacgttatgtttctaggcagtcctgccagcaacaatgccagattaaggaaggtctccaacctgaggcattaactagagaaaataatttcttccttcagttctgtcctcacagagtactatattttgaaaataaaaacaacccatatgcccatgtggatcacacagcagtgtgcattgctacaaaagcaaatgttcccaaaaacttatagaccatatttgaaggcagtcttcctgatctcctgatggttgctctaaataatataattggaccatcactaatgccatttgatttaagcaaaactaatccttgaaatccaaaaagatttctgaagttccctttttagagactagacactataatttttcataagtttatgttaaaatgggcttcaatttgttgttttcctctagtagctttttatatgagtttcttttctaaggccaaacattgaacattatgtcatatttataaggattctgaacacttgcttcataccaaaaatggttatgatgttatggttttcttaactttttatgggacagacacattgtctctccacttctcacatttcaatctttttcttgcttctgaaaaattgtaccaaatagagataggaattgcatctaatttagcttattccttttttccttattatgtatcattattgttctctaccgtggagggagactagctctgcatatactgtggtacctcaaagggaggttggctctgtatatattgtggaacctcagaggaaggctggctctgcatatactgtggaatctcaaagggagggtggctctgcatatactgtgataccgcagagggagaatggctctgcatatactatggaacctcaaagggaagctggctttgtatatattgtagaaccttagagtggggtgcagggctctggataaactgtgaaacctcagagagaaggtggctctgtatatactgtggaatctcagagggaaggtggctctgttcatactgtggaacctcagagggaggctagctctgtgtatactgtggaaattcagagggacttggctctgtatataccgcaatggccatttgctagtacaggaggaggggaaagcatgccttgaagctgactaatagatggctattttgcctttccatcaagcaacacttgagaagctggttgttctcagtaatattgttcatcacattatgctacagtctttaactactgaaggaaattggttgtctaaggtcacaaaggagacaaagtaatcttttattttgcatggggttttaatatttttttttgccccaggcataacagccactcagaaacctgcctcattatccatgtctccttctgccttctgcatcccattttattcatctctccatcttcctccatcttaatttcttgtctcagttaaaatagacagtaagagaaaaggctagcactcctaggatctaagtgagaagtggtggtgaggataagaatggctggggttgaagcattcctatgttttttttcctctgattcaggtgtgggggtctgttagacaggttttcttgttttctgtaacagttacagcaagaagtctgaatatagaacctgaacaaacctgcttctgaaagcagaccgcagattatgattatctggaactccaggctcagtgaatatagtcattgctggtatacagccagtcattcaagggttagcttaggtaaacgcctgcatttggctgcagttagcctggcccagactgatagattcagttagcatgagactatcctcacagacaggtgtctgctttcactgtgacccaactcagagatcaaatacaatcacagctctcctggagtcagcttttcattctgttctgtcactaggctctaggatccttagcaatatcaaagggtattcccacagggcatgataaagaaggccaggctggccctctaattgagctagcaggaccacaggagtgtggaagttatgattcctttgaaatgtgtgctaacctgtgtggtgcagctggggtcccagcagcactccatcactggcctcacttttgccagtttcattctagaatttgtgttccaaaagaaagacttgaataaactcactcatttcatcagagataacatacttatttttaatgtgggataatatgcatttataggcattgtcttagtttctctaccttttaatgaaagcaacttaatctattcattacacatgattgtgctctccattagatacagcctggtgctaatcaggtcaacgacttcattgccagaaggacccattggttttatctctttccaaggcttcattactcacaaattccaaagaacttggaaatgtctgtgtaaggaacatggctgtgctttggtcaaggaataggccaaggtaaacaaccagagtgactcagtgagtttagagcgcaagca

SEQ ID NO: 573 - DNA, 40001 bp, Homo sapiens
agacaaaagattgtgtggttttgtatgaattcctagagaggatgattttaatagtaccagctcatatttattgtgtcttagtttattccaggtgatgcacaaaagtacattttatgcactatcttgtgtattccttacagcaaacctgtacattaaatattatactatcatgctattgaagctactaagctataaaattgtcaaatgactgaacttaaattacacagctcatagtgaatctgtaccgaaacccaggttgttctgacttcaggggtcctgtttttaattagtgctacactgaatttcataattaaggtgctgatattatgggcatctttaatccccatggtttctcaggaatttcagaggtagtcttcatgacaatggcaatcaactgtcattgaggttcctctcatcctcaatcaatgtctattgttgccttgtctctccaaatgaggccacataattaaataaatgaaatatttgtcccttggagcttttgcaatcatgatcatattacaaaataaagttattttgttcagtacaggttcaatttgtataaaaaccaaaaatgggaatttactatttttatttttggaaacttcttaagttatagcagtgaggctgaagtgtagagattttctttgggtttgcagttatggacatctttcaaatcatttaaagagtattttggcacctaattggtcagttaaatatttgcaaataaaaaaatgaaagctttttgtatccttgacttactttttttttttttttaagaaagatgtctcagttatcacatttcgtaatactcttagctggagcattgtttatatattctttagcgttcagaaaagtacattttgagtccatgggtggggggcaagtgtgtgtatgtatgtgtgtgttggggtatagctggaagtagaatagagagaatctgttcatttgcatgatcaaattgcttactgagacttttatttcaccagctatatgaaatttgtgatgtactcaaagtttttttttttcctctgagattgtaaaactacaaaaaggcatacaatgtatacactgctgatgttagtaaacacgatttaatgaattagttcctcaatgacgttgttcctaccacactcaatgaggagaaacatgactgtcagatctgtgttgaaaaggattggtcacactcagtgaatccacttaagggtacacattttacttatatttatctgggtgctacttaagtagctacactttgattaagcaaaattggtctctctattggaccaatgtatagcatgaatttcaaaaggctggaaacactgactttttctactgtaaataaatagtataccttataactgagaaactcattttttttggttaatcctagtgtgatatagtattgaaataattaaatgtgtttttaagcaataaattttggcaacctatctttactactatatagaaacatcaatctattatgcattatcaaaaagattcagtttagatattgtagaaaagcaaaagtggaaacaagtttgcaagcatgcatgcatgcatctgtgtgtgtgtgaatgtgttgtatgtgtttatttaaaatatctacatgtgtttacattttttaactatgtcatatgcattatagaagcataagcttaagttgttctaaaaatttaaaaagtaaatatattttaaggctatcaaagtacaataaataagaatatgataactattaaaatttcttcatgaagaagaaatcctatttgagagagtttgtctggtctatactctctctctaggattttattatcctgttaatgcttacttcttgttgctgatggattttatcttgcaattttattacttttttcttttaattaataatattttagtgttgcttctggaagctttttttggcaagaagaggatttaatgataaaaatgagtaaatgttactaggatgaagtgtgtcattaaaagaagccatttctttcagcttcagtgtgcagagttagagctatgtgaatcacactgtgttcagtgagatttgctgagaaaggacctacttttattttaagcaatattaatattttactcagcttttgggtcatttttcagcaaataataatgaccattaaaggttaatgctgtgttatgtatggtaagcacattgaaattctgttagcatgtttcagagcaaaaattgaaccaggcaaagtaaaacaagtgaaggaaacttattcaggactgttttaataaagaagagagaaccagaataccatctaaactcaatttcgctgaaagaaagggcaggagagtttttaagagttgtcatgtgggttggggagattgtaggttgtctgtgtttgctaattagtcttatccaaaggaaaagtaaactttcttttatcttcatgaaaggaggtaattttacaacatggagtaaggcaaccatggaagttagattcctctcctcttacagagactagtagagagggatcaaccttccttgatgattacatttcaaagggatggcccccaggcccttgagagagacagtcctgggttgtgaaactggctagaggctttaaaaattatttatatctcaatggtagaaaagaaaaatttacaactactattttttataagtaaatgctctcagaagagggaggtcagtgcagagaatctagaaaaaaaggctgttaaaagtttagtcagtttgaaagaaacatgggtcacataataatttttttctacagtgttttataatgaacatacatctcatttatctttctaagacccacgttgataaatgaagcagaggctcacagaacttggcattaggtcataaacatatgcctaattcaaccccaaattcaaaatgctactccctttcatgactgtttctatatctattttttgataaataactgaggcagatgtaactgtctctccttggaagaaaacgccttttattcttaattttcctgtttcatcattgtgttcacctttctggaaaaaacaggcatggaactgaatgccatacttatttttaactctattacacagctatctggaactagcttatctaaaggcacaccattcacacttcagcattctgagccaggaagagatgataatgtgactgatttttctttctttttaattgacacataataattgtgcatatttatgaggcaatagtaatgtaatacatataattgtatagtgataaaatcaagataattagcatatccatcatctcaaacatcaaagaaatatctttgtattgggaacattcagtatcttctctctagctatttgaaactatgtaatatattattgttaacaataatgtttttgctgggaaaaacaaacatggtctggctattcttgagaagtacttccattagagcctgagtcagaagagagcttgccacccactgaatcaccaggagactctctgcaggtcttgaaggctgcctgccagatacacactcaggccaactttgcatagctctgtggatctgacaacaagagaacaagatagtacagttgcttgctatttttaagcatgcataaaaataatgagcaaagaaagctcatggataccattataataattgaggctaaataatgtatggcataaatggcttgagtttatcacagcatatttatgtgaataatttttttagttctaattacattccctgatcctaggtaaatataaacatagtaggagtaaaactcttaaaaataaaggctatgatgaatgagtagccatatgtaaaataattcaaaatttgtgaaaaaataataggtactagtatcaaaacaaggtattgctcatccatgttatttaagttatactttaataaacagaacatcagtgtataaaatattataaatataataatatctaagtgtctgaattcatacccatatcaggtttttagtcctaatactaggtaattatgaaggtgaatggtaaatcacaacttaaaattctaagtaaattttacagaataatttctgaagacaattttgatagtaaataataacatagatttaggacagactttggatatgcaatagagcttttgtactttttttccctcttcactaggttgatcccataagattatcacttcaccatagtgctattactactcagattcattcttcaaatcatgcattgcctagtcagacaaagctgggcttgtatcacaactatagctcttactagttggctgattttgctctcactacactccagtttttctcatttacaaagtatgtagagtacacaaaatttaatgtagaagtttctattgaaattatacatataatgttcttattacagttattgacagttagaatgggtcaaaaaaagttggccattattacaattattctatgctttttaaaaaatgattattattgtcaaattactttttccaatgaaaaccttaaggcagaagcatatcaaattatgtttaggaattgtttaaaaaccataagaattgtttaaaaattaactcatatattagcaagtcttaatctagttacatttttgaaatagaattactcccgatgactgtggaatatctatcaccaaaattaaataataaacattcaagagaataaagtttttcctttttcactatgcttctaaaaattactagaaattaatttgcctatgctttttccttgtattctcatcctttataacaatttttaacaaaactgctcatgtaaatgtccataaattattgtcctaccaattttatctgtatcaaaatattttgtgaatcatagtgactccatattttgtgaaatgaatgtgctgtggtcataatttttatctaatctctaatatcattaagaacaaaaatttgatagctttaaggtatgaattctattctgtatgtaccctggaatatttataaatacaaaatagttcgtaacagaatccccagatttatattttgaactgtaaacacatgaatgctttctaggttttcagctattgtttcagtcaatatttttccagtagtcattactgtatgccttgcctttttctaggttaatactattctttaaaagtaggtgatagaagaaactttttttaaaattttttattttttttagtcctttcttacactgaaggactaagaaaatttaactttggtcttagtgggtaaaagaatgcttcttactgaaaattcatatttagtgactcttgtagtgggcctggactttttcaaatatgctttattacttgttatcagatactcaaattttgttaaatacataaacaaattaataaaggacatactcagaaaccagtagtagtaacatacaataactgatggacatgacatgcgaaatactaactagcaagctgactgtgatatcaagtcacaaggcaaatgattaaactaggaatgaatacttgtttagaaaagtaagaaaaatacttatagtaattttaaaaattctactgtcatgttaattttgtagtttagcaaaaaaattagttttttctttataaataaacctttatgaacgaaattataatttcctaatttaacaacaagttacatttgtggatttatctaacgttctattcttgtttgtagaattttacttagaatacgtaatgcagtattaataccaaaatagtttttttgaagtaaatttgcacatttaattctttttaaaatttactttaatttttaatttttgtgggtacacagtagctgtatatatttatggggtacatgagatactttgatactggcatgcaatgcacaataatcacatcatggaaaatcgggtattcatccccccaagcatttattcttgagttacaaacaatccaactaaacgtttttagttattttaaaacatacaattaaattattattgactaaagctccttgttgtgctgtcgaatacagggtcttattcattctattttttgtacccattagccatccctaccaccaccccccaacccgcccaactaccattcccagcctctggtctattctctatctccatgagctcaaattttgtgatttttagacaccacaaataggtaagaacaggtgatatttgtctttctgtgcctggcttatttcacttaaaatgttgacctccggttccatctgtgttgttgcaaatgacagactcacattcttttttatgtctgaatagtactccattgtgtacatgcaccacattttctttatctattcatctgatgatggatacttagattgcttacaaattctggctattgtgaacagttctgcaacaaacataggagtgtaaatgtcttttcaatatactgatgtcctttcttttgggtaaaaacccagcagtgggattgctagatcatatggaagctctatttttagtttttggaagaacctgcaaactcttctccatagtggttctactaagttaacttctaacaaaaagtgtatgaaggtttcattttctccacatcctcctggcatttgatattgcccatcgttgggatataagccattttaactggggtgaaatgatacctcattttagttttgatttgtatttttttaatgaccgatgatgttgggcacctttttatatgcctgtttgcatttgtatgtcttcttttgagaaatgtctattcaaatcttttacccatattttgattggattattaaatgttttctcataggattgttttgagctccttatatgttctggttattaatccctgtcagtgggtagtttgcaaatattttcccccattttgtgggttgtctctccacttccttgattgtttccttttctgtgcagcagctttctaacttgatgtgatcccatttgttcatttttgcttgggttgcgtgtgcctgtggggtattactcaagatatctttgcccagttgaattgtcttcgagaatttcctcaatgttttattttagtagttttatagtttgagattttagatttacgtcttcaatccatttttatttgacttttgtaggtggtgagagatagatgtctagtttcattcttctgcatatggatatccagttttcccagcaccgtttattgaagagactatattttccctagtgtacattcttggcatcttgttaaacatgatttcactctaggtgtgtgaatttgtttctaggttctctgttatgttccattggtctatgtgtctgtttctatgccagtatcatgctgttttggttcctatagctctgtagtataacttgaagtccagtaatgtgaatttttcagttttgttatttttgcttatgatagctttgggtattccaggtcttttgtgagtctatataaattttaggatgttttttctattttggtgaagaatgtcattggtattttgatacggattgtattgaatctgtagattgctctgagtagtatgaacattttaacaatattgattcttccaattcatgaacatggaatatctttccatttttgggtatattcttcaatttgtttcattagtgttttattgctttcattgtagagatttttcacttctttggttaattcccaggtatctaattttatgtgggactattgtaaatggaatttttttgttccttttttatattgtttccttttggcatatagaaattatagaaattatatatatataaatatatatatttatatattatatataaatatatatatttatatattatatataaatatatatatttatatataatatataaatatatatattcatatacataatatgtatatatgtatttaatatatatatttttttgattaagtcttgctctgttgcccaggctggagtgcagtggcatgatctcggctcactgcaagctccacctcccgggttcacactattctcctgcctcagcctctcgagtagctgggactacaggcgcccgccaccatgcctggctaattttttttgtacttttagtagagatggggtttcaccatgttagccaggatggtcttgatctcccgatctcgtgatccacccaccttggcctcccaaagtgcttggattacaggcatgagccaccgtgcctggcctaaatgctattgatttttatgtggatttcgtatcctgcaactttactgaatttgtctttcacttctaatgggtttttttggtggagtttttaagttttttcaaatatatgatcatataatttgcaaaaaaggataatttgatttcttctttttcaatttgggtgtcctttattactttctcttgtctaattgctctagccaggacttctagtactatgttgaataacagcggtgaataacttgatgacaagtgggcatccttgtcatgttacagatcttgaaggaaagctttcagttttttcccattcaatatgataccagctgtgggtctgtcatatgtggctttcgttaggttgaggtgtgttccttctgtccccagtcttttttaaaagatttttatcatgaaatactgttgaattttaccaaatgctctttcagcatcaattgagattatcatatggtttttgtcctttactctgttgcaatgatgtatcacattgattgatttgcatatgttgaacccttcttgcgtccctaggataaatcccacttggtcatgataaatgatatttttagtgtatttttgaatttggtttactactattttgttgagaatttttgcatcaatatgcatcagaaatattggcctgtggttttcttttttgatgtgtctttctctggtttttgtatcagggtaatacaggcctcatagaatgagtttggaagtatttcctcctctcttatttttggaatagtttgagtagcattggttttagctttttaaatgttggggagaactcagtggcaaagccatcaggtcccaggcttttctttagtgggtcatttttattatggttttgatatctttacttcttattggtctgtttggtctttggatttattcctggttcagtcttggtaggttgtatatgtctatgaatttatctgtttcttctacattttccaatttattggcatgtaattgttcatagtagcctctaatgatcctttgaattttttgttatcagtagtgatgtctgttttttcaaccctgattttatttatttaggtcttcattctttttttcttagtctgactgaaggcttgtcaattttgtttatctttccaaaaaaccaactttttgttttgttgatgttttgtattgttttcttcatttcatattatttatttctgctctgatcttgattatctattttcttctcctaatcttggttcagcttgctcttggttttctaattatttaagatacatcattaagttatttgtttgaagtttttctgctttttttgatgtaggcatttatagctataaatttttcctgttagtactgctgttgctgtatcccataggtattggtatattgtatttctattaccatttgtttaaagacattattcaatttcactgataatttcttcactgacaaaatcataattcagtagcatattgtttaatttgcatgtgtttatataatttctaaaactacccactgttgattctagttttattccatgttggtcagagaaggtactgatattatttcagttttttgaatgttttaagacttattttctgacctaaaatatggtctacccttgagaatgatttatgtcctgaggagaagaatgtgttcagcctttggatgaaatgttctgtaaatatttattaggtccatttgttctatagggcaaattatgtctgatgcttctttattgattttctgtctgggagatctgcccaatgctgaaacacccaatgctgaaagtggggtgttgaggtctacagctattattgtattgggatatatctttctcttgtctcttgtgctctaaaaatatttgctttatatatcagtgttttcctgtgttggttatatatatatatttaccagcattatatcctcttgctgaattgaccactttaccattaaagtggtgatttaccttttttgcctctttttacagtttttgtcttgagatctattttgtctgataaaaaggatagctacttctgctctttttggatttccctagcgtagattatctttcttccatctgtttattttcagtctatgtatgtctttataggtgaagtgtacttcttgtagcaacagataactgaatcttgctgttttggcaattcagccaatctatgcctttgatttgagagtttagtccatttacattcactgttgttattgataagtaggacttctgctattttttatttggtttctcatagttttacagtcttctcttccttctttctttccttcctgtctttcccttagtgaaggtaattttttctggtggtatggtttgatttcttgctttttatttttttgtgtacctgtgtaggtttttgatttgattctaccatgaggcttgcaaatgaggcttatggactattattttaaactgataacaactttacactcactgcatatacaaacatgcaaagaaagctagtaataactctacactttaactttctcccctctggcgttttaacatgagttgtttctcttcatatcttattgtactatgtcttgaaaagttgttgtaattattatttttgattaatttatcaattagtctttctacttacaataactgtagtttacaaactatcattacagtgttatgctattctgtttttctatgtacttactattaacagtgaatataccttcacatgatttctttttgctcattaacattgttttccttcagattgaaggactctatcatttcttgtaggataggtctggtatgaattaattccctcagcttttggtagtcttggaaggtctttatttctccttcatgcatgaagaatagtttctacagatatgctattctagggtaaaagttattttccttcagcacttgaaatagtcatggcaccctctccttgcctgtaaggtttccactgaaaagtctgctgccagacttattacccctccattgtatgctacttgtttcttttctcttgctgctgttagaattctttctttacacttaacctttgggagtctgcttattcaatgccttgaggtagtctttgggttaattctgcttggtgttctataaccttcttgtacttgaatgttgatatctttctttaggtttgggaatttctcctatattatccctttgaataaatttcctattcctatatctttctctacttcctatttaaggtcaataacacttagatttgcccttttgaggatattttctagatctcatagggatgttttattgtttttcattcttttcctctgtctcctctgactgtgtattttcaaatatcctgtcttcaagctcactcattctttcttctgcttggtcggctctgttattaagagaatatgatgcattcttcagcatgccaattgcatttttcaactttaaattttctgcttgattattttaaactatttcaatctctttgttaaatgtatctgataggattctgaattcatttcctgagttatcttgaatttctttgggtttcctcaaaagagctattttgaattttctacatgaaaggtcatgtatctctgtttctctactatttgcccctggtgacttattgagttcatttggtaatgtcgtgtttacctggatttttttctgatacttgttttttgaagcctgggcattgaagagttaggtatttgttgtagttttcagaatctgtgcttgtttttacctgtctttcttggaaaggcttcccaggtgtttgaaggaacttgcatcccaagctccttaatgctgttctttttgtttgtttgtttgtttgttttcagattcatgtaaataccaccttggtggtcttggataagatgtacaataactttctggattactaggcagacactctttaatttaccttactttctctcaaacaaacatagtctatctctgtgctgagcctggtggaactgagagtgtggtgatacatgctcccctgtggccaccaccactgggactgcgcagtctcagacctgaagacagtacagcactgggtcttgcctaaggtccttcccttcagtgcagcaaattcccccaggcctcaggaaggtacagagatgctgcctgggagccagggtttggagtcaaaaaccttggcatttcacttgatgttttattctactgtgggtaagccagtactcacaaaataatgtgaagttcttcctgctctgccctctcctttccacaggcagaagagcctctccctgtggcctccaccactaccagcccatgagagtgccaccaggccaccttcaatgttcactcaaagcccaagggctcttccctcagcatgtggtgagtgctgcccaggttacactcaccctttggggcagtaggctcccctatagcacagggtaggttcagaaatgctgtgcaagagcctaggcctgaatatggggaccctaagagccttcttgttgctctaccccactgtggctgagctggtacctaaggttcaagataaagtcccctttactttttcctctgcttttctcaaacagaagtctttcactatagccactacaccttagaatgtgccgggtcacccctgaagcagcctgtctcagagcccaaggctcacatgtattccctaggtatcactgctggttattcagggtccaagggctctttatttagcaggtgatgagtcctgccaagactgggtcctgtatttcaaggcactgggtccccttttcttcaaaagtgtgtctagaaatgtcccagaattagtgcctggaatgggagccttatgaatctgcttgggctctattctgtggctgatctggcatttaagatgtaagacaaattcctctttactctttgctttcctctccttaaacagaaataagaggtcacttttgttgctgcgagctgcactgcctgcggttggatgaggtatggcacaaacacttctttagccaccccagctaatgtctccctaggtcatgtggcacgatagttcattggctctaagtccagcctagcactaggagttgcctaggaattgcagtccttgtatcttagactgccgttcggagttacctaggaccccagagcactttggcttgtgaggtttgcaagaaactaatgttctgatggctgggacagatgattcccttctggctagggctggtccaaatgtcccctccatttgggcactatctgagcccagcatgacttaattcttcactgtgacagggcagcacttagttcaatgcaaagtgccatagtcactgtgttctctttccccaaagtgcaaagattctctcttgctccacagggacgcttctagggaatgggggaggcttggcattagtgattcaagactatctctcttgtcctcctcaatgcaacttctagcaatatgaagttaaaaccaggtaccatgacttttcatctgatttttagttcttgtgacagtgtttttctctgtacagatagttggtaaagtttggtgttccattggaggggatgaacagtataggcttctattctaccatcttgctccaccccctctcactattaattcttaatttagttgtacagctttgggaaacatatttttgaagtaatgtaacatgctacagagagtatgccatattgaagatagtattctaaacttggcatttctatcaacttcatgtgaagaaatatgacatgtgttttataaaatttaattacataattatgcattatatgtaatttatgcattatacaattcatatcaagttatttacagtttttcatataaattacaatttaaataaaggaaaggtatctatctgactatacaaatggatgtgtaggcatcaacattatattcaacaatattatatatcacatcaagttatacttttttatgacaatgtgacattatatatcagtttcaaacatacagctgagaaatatacatttatagttacggggatagatatgttactacaatgatagctgtattactagtccattttcatacttctatgaagaaatatctgagactgggtaatttataaagaaaaagaggtttaatggactcacagttcctcacggctggggaggcctcacaatcatggcagaaggcaaaagaagggcaaagtcacatcttataaggcagcaggcaagagagaatgtgcaggggaactgtcctttattaaaccatcagatcctgtgagacttattcactatcatgagaacagtatgggaaaaacccacccccatgattcaattacctcccaccaggtccctcccacaacacatgggagctacaattcaagaggagacttgagtggggacacagccaaaccatatcagtagcaatttggataatgatgtcaatagaaaaccaaatataatagtaaacaattaaaatgttaaaaaagggtttatttaagatgtcttttattatgattaaaattttagaatatctaagtatggatagaacatttagatgtggttctatttacacataagatacctttgaataaatgcagctggaaatattttacatttgttacatattttcaacattataataaaatttatttcagattttcctctgactttttatgtaagagtttgagttgtttaaacttcataaaacaatgaccaggtttatattgttttgaactgtacatttaaattaacaccttaatattcaattttttgttgtttatgtcattttatttctgtactttaagatatagacctaaaatcaattcctttctgagaatttttctctgaacacattgctcacaagctaagatcaacctgctttttatctgattacacatatcacttctgatacccaaatctttcaaacagaacctgcaaagaataactaatagaaatctgagctggcactacaaaattctaatgataaagttattgtcatttttcagttttacaaaatttaggatataggaaaccagatcttgctacctcttccttagaaactatgatgctttcatggagttcagcagcatatttgttaaagggaaaaacactaaataataatgatagtacatacccttattttttcagaatccaaataataaataatcttatttcatcttagagtctttaataagtcatgatgccaccaactatgggcagttataatgcctacttttctccaaaattatctgaattggccctaaaaaagtattgaaagtttttttaatagcaagaatgtgttatttttatgttcttcttttctaagaatggcaccattggagcacataggaagaaagacacaccctagatacaagatctgcataattaaatataaagctgaattagaaataaattaaaatattaaaatagtagaacattaacaagaagcctttaatacaaaaaggtaagaaatgattatcactaagtactgctattacaatagtttttattaaggagatttaaagagaagcaaatatgtgtatctcaatgaaattgacaatagcacatgattaaaattaatgtgttttccaaattaaaaaacaatctactagaatttgaaaggatacatttgtaatctaagacagaatgtactctcagagcaacatcaatctcatcctcaatcataaattattaaagtcattttaattaaacagacagtagacaattatatcttcaaacctcctttattatttcctgtatattaggaaattgtatgtaatacaatcagatatgtgaacaatacaagttttcaatattgaaaaggaaaaataatctcaatttatatatataataatcatctacttggaaaactcaaaaagagcaactgagaatattttagagctaataagattagtaaactggtcaaccaaataataaaaatacattacaattaatcagttctctaattaaggtgataaaaattagatattgttaggaaaaatcactctatttacagtgatgtcatactccaaaaataaattcaaatagcctgatgttctttcctataatggactaatgctgtaaatgtaaatactttcagggcctagaatttaattaagtgtgtagttcaacgaaccaaagttgacccagaaatattctggcagcatcttgtctgtcataaaagtcatttgatttgcaagtgaggatgctgtgttaatattcaaggaagaaattatagcctgtaaatagagaataaatatagatcaatatttacgtggaatcatcaggaaatgacaagttctataagagtacgttttagatgataaagattatgaagatgttgatgatactccaaattaaattcagaaaacatttattgcaatttcacctcaatttctgacaatctacaatgacaaatgtgacatcgtgtgtttcaagtatcttaacaaactagagttgaggatacaactgtcaataggcaaactatggtactttcaattataatagaatcatttttttatagttcagagttagaaaaaattaattctgatggtgggacaagtcatcaaattttccaaactggaagataaaatggtagttttgagtcataaaggttgaaaaccacagtgttgcacagttactgccttgagtaggttttagcttaattaataataatactcatatatcttccactcagttgaatactttctacggtatttgaatattttgatattctatatttaaatgaatagggagtatatgaggcatgcctcgtacttttattttatagattaaaaaatagtgccttgaattgctatagagatggttcataattattaggcagttgcaaaatcaataccaaaaattaggcaaagatttttttaatgttcatgtcagcgttttatctcccccatccgtccccttgaataccatggtgacattcagttcaaaaataatattttgaacatatactatgatgatacaaagaactttctggaatgttcaagttatagatctgctctattagtagccttctttatactatgcatcctccatatgtttatatgaatgaatcaggatctgaatattaaagtgcagttgacacagttgatagctttattccatgctattcaacaaatcatatgtcaggaaaaaaatgttatgcattagagtctcctgacagattactattacatgttatccaccatacaaaacttaaagaaaaaaccctcaaatatgctagttctaaaggcagcttttattagcctctaaatgcagcttttattagcaagtgtaatgaggtatgtagaagcaaaagtatacaaaagacatatgtaaggaaaatattagaaaactgtaaagaaacggacaggctacagaagcaggaccattaaaaatgataatggctgatggctcatgcctataatcccagcacattgggaggccacttgagtccaggagtttgaggtcagcctgggcaacatagtgagatattgtgtctaccaaataataatacaaataaaaataataaggtgatgatggttaccaaggactatagaaatcttcgatatgctgtctttttaaatggttatctccctgggtgtcctttgtttgtgatgtcattgtgccagcttagtcatcattcctctcaaagtacagttttaattgactattttgtacattctgtgttatgagaaacagagacccacaattaaaggagacctacaactaaaaataataaccaaatatgagtaaatacattgtcagatcctaaggagacggattcttcttcttttttaataatttcaacttttgtttcagttgtaggcaagcatgtgcaggtttgttacatgggtatatagtacccaggtggtgagaacagtacccaatatgtagtttttcagaccacatcgtccctcctctagtcgtctattgtttattcttcctatgtttatgtccatgtgtgctcaatgttcagctccgacttacaagtaagagcgtgtggtattaggttttctgttcctgtcttaattcactctggattaaggcctccagctttatctatgttgctgcaaaggattttattttttattgtggctgggtagtatatgtatgatattttctttatccaatccaccattggtggggaccaaggttgattctatgtctttgctactgtgaatagcatgctgatgaacatgaggtcttattggtatgatgaatttttctttggccatatactcagtaatgggactgatgggtcaaatggaacctttgtttaaagctttttgagaaattttcaaactgctttccacagaggctaaactaatttacatttccactaacagtatgtaaatgtttactattctctgtggcctcaccggcatctgttgcttctttgactttagtaatggccattctaattggtatgtgatattatctcattgtggttttgattcacattttctttagattgatgatgattagtatactttcatatgtttgttgttcacctgtgtgtcttctttgcagaagtgtctattcatatcatttgaccatttttttttttgcattttgggttatttggttttgcttgttgatttatttaacttccttatagattctggatattagacctttatcaaatgcacagtttgcaagtattttaacctatgctaacctatgctatacgatgtctgtttagtctgttaatagtttttcttgctgtgcagaagatctttagtttaattaggtccctcttgtcaatttttgtttttgttgcagttgcttttagaggcttagtcaaaatttctttgccaaggttaatgttgagaagggcattttataggttttcttttaggatttttataacttgaggtcttacatttgaattttttatgaaaatcagtagcatttcaatacaccaataacactcaggctgagagacaaatcaagaacacatcccattttcaatagccacaaagaaaatgaaatacctaggattacagttaatgaagcaggtgaaagatctctacaaggagaactagaaaacaccgctgaaagaaatcagagatagggcaataaatgaaaaacatacataccgtgctcatgaattggagcaatcaatattgttaacctggccatacttcccaaagaaatttacagattcaacactattcctattaaactactgtcattcttcacagaatttaaaaaaaaaaactattctaaaattcacatgcaaaaacaaaaagtctggttaaccaaaacatcctaagtcaaaagaacaaagccagaagcatcacgttatctgacttcaaagtatattacaaggctacagtaaccaaaacagcatggtactggtacaaaaatacatacacagactaatggaacagaatgcaaaacacagaagtgaagccacacaactgcaactacctgatcttcaacaaggctgccaaaaacaagcaaggggaaaaggactctttattaaataaatggcactgggataactggctagccatatgcagaagaatgaaactggatccctacctttcaccatatgcaaaaattactcgagatgattcttcttaagtaaactttttcaacttaaatgcatagactatatttagtctatttagcctctactgggctttttaacttaatctcttatttattatttttaaagtatatcttacatatttcaatgtgttgtttaatcgagttttctgaaaaaaaaaatagacatttttattttgaagaagttatcacctagatcacatttatgtacccaaaacaatattggctattctttacaaaaataaccatggcactcttttaagtgagttagagaaaattcctaattttattctaacaaaaactaaatgaaataggtattcttattttctgcttgacagacaaggaatgtaaagcttagataggttaaattgctgtccaagatcccacatgtattagtggtagaatttaattgtagaatttaattagaggagtacctgctgtatatgtaattgcatattgataacttttcttcagtgtatgaaggtataaaagaatgagtgctgatctcacatatcagtttcactttgatatttgattctttgatatactttgattattgatactttccgccaaaaatgtgatatgggaaattgactcatgccaaagcccatactttcactctaatgctacactttgcaaacacatgagttgcagatatataggatagttctttataatttttttctaacagaggtcctgaagttcaatgcaataagcttataatttagtgtataatttttaaaaggtttagggatatgaagccttgatgaaattctataataactataatacagtaaaattaaaatggtcataggttatttaaaaagtcattgtctaattacaggagtataaatctagttttatcactaatgaccaacaggtgtttgcaattttatattacttgttagacctcagaaccttagaaataaatgggatcatagaggacagatatttcagtctctactataatataacaaccttttaaaacactcttgacagatgtctagttaaactttgttcagatatttccagtgataaggaactcaccacttattaaggtatcctgttcaattttaaaagaccttagctgctgttcataatctttcataagactcagtcgattatagattttatagctataattataaatactataaattaattctgcagattcaaacataatagccagctatagtgatttaactctattcctgctggttcaatttactgactgatatagacaacatttaatttagaactctaatattctgacttaatgtatctgccataattctgtcttaaatatgtaagagtggcctaatagcttacactactttaatgagaattgcacagtaacccttccatttgcccatttttaggaatctacagcacagaaaataaacctgagacatttttgatagcagtgtcgcaaatatcaaaacattttggggcacaatcaacaaataattcttgactaaattatacagtactaattacatggaataaggaatgttatctatctatctatcatctatctatctatgtgtgatctatctatgtgatctatctatcatctatctgtctatctatggtctatcaatgtgatctatctatctatctatatgtgatctatcaatgtgatctatctatctatctatgtgtgatctatcaatgtgatctatctgtctatctatctgtgtatctatgacgaatacaagatataggtctggagggtcatggaagttatagaatggtgtgggcattacgatgatttaaaagtacttttattgtggctaattatacataacactaaacttaccatttcaactatttataagttgaattggcacaatttaatggataagtacaattttaataacattaagtaaatgcataatgttaggtaactattgccacattaaaaatgtttaagaaaggttgagaaaaacagattataggtattttctcatactggaagagttaaatagtagcagaaagatgagctgagcatgaaatatggtattaatgagaaatatgtgaaaagttgaaaatacgtgaaagtatgtgaaaaatttgaaacatgaacaatagtctgaaaattcttacatcaaggagaaaaatatgtataaatttctccttgttttgaaagaacaagttctcaaatgaaaaggcttttaggataacaaacaagatgaatgaagaaagctatctagaacaattataatcaaacttcaggacccccagtgggcaaatatacaagcattctcagaacataaggttcacaatggttggcattttctttttaatatttaattatctttctttaactcttagaataatactttctttatatataagtgcctattagtgatatttgtgtaatgaatgaataagtgtcaaatctcacatattagttatattttgatattttatgttttatatattttgtttattctttttcttgaggacataggttggagggtgggcaggggaggcataacaggaactttaaacaagaacagagaaaatctataaattgagcattccaataacttttatgtgttgccttagtaaaaaaacaaaatactattttaaaattgaaagtcattagattgtagcaggctaatgagactgaatgaggcaacaaacacatcttttacagtcagaccatcttattattcaaatccagttgattcaacattaagggcactctaaattttaaagggataattttgaagagcaagtggaaatatctgtacctgaattctggtattggttttgcaactgcttgatgatttcaaacaaactttacaacaatgttgtgtttctgcctgaagatattcttcaaccattgaagtattctcactagtaaatggagcaagtcaagaggcagagatgttaaggctctagaagcaaccctcagccaaagaagtacacaaattggtggataaatactccaactttttcacctcttgttggaaaaaattagaggcatattctacagttgcttatagggttcccagtgagattgagcctcagttggccactgtatttaactcactcatgagtgtatgttttactgatttttctccctttttaacttcattttcctgctccattaccaggatttattgagtcatctttcaaataaactatttgtgtccacatcctttcttagacttagactttggtggaatcccaggtaaaacacaatttaatgttataataagaaaaaaagctttaaaatcaaacaaaaatctaaatttctctgaaagaaaaacctagcaagagagtacaccatatatatacatatacacacacatatatatatatacatatatacgtgtatatatgtatatatatgtatacatatatacacgtatatatatgtatacatatatatgtgtgtgtatatgtatatatatggtgtatatatataacctaaaaggtaattattgggaagcagttttcagctttaatatgtaaaaaagcttaggaatcaccactctacccctgtccttacaacaagtgaaaaaactgaacaaatagaaaataacacttctgttggatagattagaaaaatgaagtcacagtgcaaaatgccatatgcaaatcttgagagacagatgagtatggagaatcccaaaagaagtcagcttaaatggagcagaaaccattagagccatgaggtgctaggaacactacaatgatagttctgagaaattgctggtgactgcatatggactagtgtgagtgtgaaaaattcttggggcccactcttaagggaacccacacttttgtgggttttacctctagaacattttgtgttttcttgttgaagatcagagaacagtactcataaaactctggcatggtggagaaaatgttaactattttgaaacacagctaaggcattcttcatagcaaatacctactctccagttaaaaaggaattgtcttatcatacctaggaggaagagcatttgtgcagtgtcaaccatctctgactttcctgttttacctaagagcagaacacagctaagaaacaatcataaagccacagtccagaagcacaggaacaccgagactgtttatcataagattatggaatgcttacttttctctacaccttatctccatatctccatttcttcagtaaaataatagaaggtcacagctgaagaagttacaaggcacaaagtctatttaagaggaggttccttaaggaaatccaaagtagtaggacagacaaaaacactagtgatatttgaagtttctggtgtctacagctacagcaaatattaaacacaacccaacttctacctggattaacataaaatcttacaataaagatctgttttcctcagttcctattatctgaaatatcatgtctcattcttggcacaaaatgtaaaggcattccataaagcaggaaaaattactctgaagagacaaagcatgtatgagaaacatataggtataaaattattcacatagataatttaaaataattataatcaatatgatgaggaccatagtggaaaagagacaaaatccaacagtagatgggtaatataagcagagagatgtaaactctaacaaagaagcaaaggaaatagtacaaataaaaatcactatcataaaaataaagaatgccttttagctctgcagtagactggacatggctaaggaaagaataagtaatcttggagacatttcagtagcaactccataaactgaaatgcaaaaagaaaaaagaagaaaaaaaagaacaaattattcaagaactgagggacaatgataaaggtttaacatacatgccattggaatacttgaaggagaaaaagagaatggggtggaagaaacagtggaagtaataattgttgagaatttttcaaaattaatgatagactgcaaaccattgatccatgaaccccatttatcaaaaaaggataaataccaaaaaatatacatctagccataaaaaaactgaacaaagcctaagatgtaatagagtcttagaagaaccaaaggggggagaaatcttttctgcagggcaaaaagtgtaattacattagacttcttgtcaaaaactatacaagcaaaacagcatgaagtaaatatttaaaatgtgaaagaaaaaactcattaacttataatattccacaaaattcttcttcaaaaactaagaaataaaaaactttctcagaaacaaaagcttaaggaatttaaaaccggcagacctactttctgaaaaatgtgatattctttagggagaaagaaatgatacgagtcagaaacatgaagctacctattgaggagcatcagagaataaataaataaatgaaggcacaacaaagtattttatttttgtgtttttcatagatctaaaagataactgtttttgattaattatagtaacaacatattgaataagtgaaatgaatcacagtaatataagagctgagaaggaaaattgataatatgcttttatgagatccacgtgaaacaatatagtgtttttcaaagataaacttaaaactatttataaatgtatatttcaaaccctaggaactactgttttaaaagaaatataattgatatgctaaaaaaggagagaaaatggaattttatagaactctcaattaaaatcagaaaagacagaaaaaggaaaaaggaaaaaagaacaaatttaataaatagaaagttgttaaaaacatggtagatacaatatttatttatttatttatttatttatttatttacttatttcaatagtttttagggtacagctggtttttggttacatgaataagttccttagtggcaatttctgagatgttggtgtacctgtcacccaagcagtgtgcactgtgccagatatgtagccttttatccctcgcccctccccacccttccttgagtccccaaatccgttatgtcattcttatgcctttgcatcctcatagcttagctcccacttataagtgagaagatacaatatttgggtttccattcctaagttatttcacttagaataattgccaccatctccatccaagttgctgcaaaggccattatttcattctgttttatggctgatagtcttctatggtgtatatatactatactttctttattggttggttgataggcatttaggtcagttctatattttcgcaattgcaaattgtgctgccaaaaacatgcgtgtgaatgtttctttttcatataatagcttattttcctgtgtgtagatagctagtagtggaattgctggatggaatggtaggtctacttttagttctttaaggaatctccatactggtttccataatggttgtactagtttacatttccaccagcagtgtaaaagtgtacatccatgccaacatctactattttttgacttcttaattctggccattcttgcaggtgtaaggtggtatcacattgtgattttaatttgcctttccctgataattagtgaggttaagcatttttattcatgtctgttggctgtttgtatatcttcttttgaaaattttccatccatgtcatttgctcactttttgatgggttttttttttcttgatggtttctttgaattccttgtagattctggatattagtcatttgttgtatgcatagttttcaaatatcttctcccactctctgggttgtctgtttaatctgctgatgatttcttttgctgtgcagcagccttttcatttagttaggttccatttatttagttttgtttttgtggcatttgcttttgggttcttagtcatgaatcctttgcctaagccaatgtctagaagagtttttttctgttattaacttctagaatttttatggtttcaagttctacgtttaagtatttgttccatcttgagttaatttttgaacaaggtgagaggtgaggatccagcatccttttatcagaaaaaccctcaacaaaattggcacaggagtgagatatctcaaagtaataaaagccatctttgacaaacccatagccaacatcatactaaatgagaaaaccttgaaagcatcccctttgagaactggaacaagacagagatgtccgttttgccacttctattcaacacagtactggaatttctagccaaaacaatcacacaagacaaagaaataaagggcatcaaaactggaaaagaggaagttagactgtttctgttcacctatgatatgatcatatacctaggacaccctaaagagtcatccaaaaagctcctaaatatgataaatgaattcagtgaagtctcaggatacaaaatcagtgtatcaagttgataattaaatcaagaactcaatctcttttacagcagctgcaacaaaaccttagaaatatactttaaaggggtgaagtgtgtgtgtgtgtgtgtgtgtgtgtgtatacacatatatatacacacagacatacatataaaaacatatctatgtatatgttcttacatgttaacttgatgtttgttgatacacacatatattaatgaaacggaaaaaaaatatatttttgctgcttaaaaattagataaattaccagcagttcatgaaaattactcagtaattcttgttattagttttttctttttttccaacagttcttcaagaatgaaaatttttcattcacttcttcaaaaatgaaattttttttcacccatgtagtttagcaaatgcacaaaaacacaaactgtcagtctgtaactgactcctcaatttttatagctccctctgcacctgtcttctgtccatgttccattccttgtcctcacttccacatcaaggtctgtagacatctgtgtgtttctttttttttttttttttcctttctttttttctttttttttggggcgggggacggagtctcactctgttgcccaggctggaatgcagtggcgcaatctcggctcactgcaacctccgccttcccggttcaagccattctccttcctcagcctccggagtagctgggactacaggggcccaccagcacgcctggctaatttttttctatttttagtagagatggggtttcaccgtgttagccaggatggtctggatctcctgacctcatgatccaccctcctcggcctcccaaagtgctgggattacaggcataagccaccacgcccggctggacatctgtgtgtttcttattgctctcctgctttgagtatcctgaatgatcatgaggaaggggtaagacttcagtaagacagtgccctggatcctgatggcttggagacttgggtccgagcaaggagatggaagagcttgaagggagtgaaatgagagggtgacttttactaggaagtggaggaggcagtattgagttgaaaacatcagaagtaggagtcagacaaccagaagagctccaggtccgttaccaactaggagcacttcctctttaataaaataacccaaatgcagaggccttcagcagtctacaaaaggaaaattacaaaacactgctgaaagacatcataactgacacaaacaaatggaaacacatcccgtgctcatggatgggtagaatcggtattgtgaaaatgactgtactgccctaagcagtctacagattcaatgcaattctcttcaaaataccatcatcattcttcacaaaactagaagaaacaatcctaaaatgtatgtgggaccaaaaaagagcctgcatagcaaaagcaatactaagcaaaaataacaaatttggagacatcccattaaccaacttcaaattatacttataaggctatagttatcaaaactattaactgttaatttaagtgacatttttataataatttatccagcaacatcagaatacatattcttctcttgctcagatggagcattcaccaagataagccacattctatgatataaatggaagtaaatttttttaaagagtagaaatcaacccatgatattcttagaccaaaataggattaagctaaaagtttataaaatagagacaattgaaaaacactgaactgtttggagattaaacaaaacacttttaaataacatatagatctaagatgtctcaagaaacattaaaaagtatactgaactaaataaaaatgaaaatgtaaaatcaaaatttgtgggatgcagaaaaattagtaattacaagaaaattaatagtcttaactgtattacaaatgaataaataaaatcaacatctgtacatttggaaaccaaagaaaggcaatttaaaaccaaaataggtagaaaaaataaaaaatagagcagatttgtttttaaaaaagaaaacaagcataaaagaaaaattaatgaaacagaaagctggttcttagagcgggcctatgaaattgacaaaattctagccagaataatcaagaaaaaaaaagcaagacacaggctgactatatcagaaatgaaagaggagcatcacttctgatctattgcacaatgaaatcataagaaagtaaactacggacaactctaggcacacaaatttgatactttacatgaaatgggccagtttttttgaagacacaaattgccaaaaagtatgcagggaaaatatataaccagagttggcctatatctatgacagaagttgaatccataattaataaattttcccaaaaaaaatcaggcctagatgattttactagagaattgtactaagcatttgaggaaaaaaattatactattcttcaaaatcacttctagaaaatagaagtagaagaaacatattctacatcattctaggagtccagcattgtcctaattaaaaccatataaaagcatataagaaatggaaactagagatcaataataagcatggatgcaaaaaacttcaacaaaattctagtaacttgaacacagccaagtataagatgaataatacaccacaaaccagtattttaaaaagtaaataatagaaaaaaatttaaaaaggaaaaaataaatgctggttgtgtactgaaaaatcagttaatgtaaaccatagcattaacataataagaaaaattgtgcaatcatatcaattaatgcagaaaaagcatttgacagaatttaacatcccattaatggttaaaacttttgcaaatcagaaatagagggaagtgtatcaattgtgtaaagaatatgtacaaaaattcctgcagctaacgtcagcctagataatttatccttaagatcagcaacaaggcaacaactacttcacttcctacaacattcaacattgtactggaagttctagttagtacagtaagacaagaaaagggaatagaaggtatgtgatcgggaaagaagaaataaagctatctttgttcacagatgacaacattacctatgtacgacatccaaaagaactgaaaaaatattttctgcaagtaatgaattaatgtattaaagtcccaggataacaatatacaaaggtataaaaatatacaaaagaatgctatgtcagcaatgaacaattgcaatttgaattaaaaatattatttatgatataaacaattaaatacttaggtataaatataacaatatatatataggatctatacatagaaagctgtaaaatctttataaaagaagtaaaagcatatctaaataaatggagacaaatttcattttcatggattagaaaactcaatgttgtaagaatgtcagttctttccaaattaatcaataggtaaactcaatcttagccaaaatcctaaaatgctatttttctaaacattgacaaactaatcttaaagtttgtatggaaagaaaaaagatctagaacagccaagacaatatgaaagaacaaagttggagaactcaaactaagcaactttagttaaagctacaatgaagctgtaaaaaaggcagcatgatattgttaaaggaataggtaaatcaatagaaaatactagcttaaaaacagacccttacaaatatagtcaacttttctttgactaaaggaacaaagcaagttgtggggaaaaaagatagccttttcaaccaatggtgctagacaaatttgacatttatgaaacaaactaacaaacaaaaggaatctagattagtcctcacacttttcacaaaaattaactaaaaatggatcatagacttaaatggaaaacacagtgcaataatataacacttctaaaggataacaagaaaaatacaggtgacctgagttaggtgacgagtttttacatataacaccaaaagcatgatccaagaaagaaaaaattcataagttgacttaattaaaaattaaaaagtcttctctgcaaaatgcactattaagagaacgaaaagaaataccatagactaggagaaaacatatttcataaaggttttgtatccaaattcacaaatattattaaaattcagaaataataaaagaatctcaccctccaaaagtgcaaatcatctgaacagacacctcaaaaatagaatgtacagatggcaaatatgcatataaaaatactcaatattatttgtcatcagggaattgcaaattaaaacaacaatgaagtattaccacattctgattacaatggctaaaatccaaaaaagtaaaaaaaaaattctaacatagattgctggtgagcatgcaaagcaacaggaaccttcattcattgctggtgggaattcaaaatgtactggtttggaagtttattacaaagaacgtagtcttacctgtgatccagcaattgggctcctagtaatttactcaaatgatgtgaaaatttatgcctacacaaaaatagcaccaagaattttatcgtagctttactcacatatgtcaaaactggaagaaatcaatgaagcaaactttatcttcaaaaggtgaggggatattattcagtgataaaatgagttatcagtcaacaaagagaaatagatggatctgaaagttacattactaagacaaagatgctacaataaatagcctacataccatatgacttcagttatatgacgttcttcaaaatgcaaaattgtacagatgataaaaaggtcagtgactgccagtggttcagggggaggactagcggtttgaatgggtgaagcacagatgaaatctagtacaatgaaatttttctgtttgaaactctaattctggatacatgacatgatacatttttcaaaacgcatagaattttacatcatgaacagttaatcatattgttcaaatgcttccttccaaaaagtacaggatggaaagatgggaaaaaatgatacatttactgtgtagaaactacaatcttccttcctaaaactcttaactcccatctgatcacacacacacacacacacacacacacacacacacacacacaaaatcagacaaatcccagttgaattacatttaataaagtatcctgagcagtactccaaactagcaagatcatcaaaaacatgaaaattctgagaaactgtcatgaccaaggtaaggctaaagagatataacaaaatacaatcttgtatcttagacaagatcctggtacaaaacatgacattaggtcaaaactaatgaaatctgaatgaaatatggctttaataataattcgtcagcagtgttttatcaatctgaacaaatatactatgctaaaatgttactaataggagaaatgagttaagggtacatcagaactctctactacttcctcagttttctaaaactaaagaatctaaaacagaatctaaaacagtcctatacagtcaaatctattttttaaaaaagtgattcttatagttttagaaatcacatataaactctatcaaattaaattgtttattatattataaaactattccgtaattatttttaaaggtttatcctaggattacaagaataatgactcaataaaaatatattgatataataaaatatgtaacgtaaaagagaaagaactatcatttgaatagatgctaaaaaagccatgatcaaattgaaaacagcccttaaaattttgtatggcctagtaatataatcatattttaagattctaaaaataattaaaaacaaataaacagcctgtgcaacactataggagactcattatagtgaagaccaaaagaggtatatgcattatcactgcaatactcaaagtttgtggttgaagtatgagttaattcacccagacacagatattaaaaattagacaataaatttcaactgtttcacagaaaatggagttgtctaaatagactaaaatctattggaaattattagaactgatatgaggattatgtggttgtattgatttcctagggcttgtgtaataaattacaacaaattaagcagcttaaaacaacagaaatttatcgtctcatggttctggaagctaaaagctcaaaacaaaagtttgggtagggctgtgctttctctgaagtctctagaggaagatccttccttgcctcttgtagtatctagtaaccccagtcatattgagttagggtttagcccaacctaaactgatcttggctagtcctcctcctgaaccactggcagtcactgacctttttatcatctctacaattttgcattttgaagaatgtcgtataactgacaacataattccaatctccgctttcaccttcacatggtcatcttccttctgtatctatgtatctctgtgtattcacatggcattcttctccctgtgtcactgctttgtcttataaaagcagcagtcatattgggttagggtttagcccaaactaaactgatctcaattatattcacaaagactttatttccaaataagctcatattcacaggtactgagggttaggacttcaagatatcatttttgggaacacaattcaatctatagcagtggtataaaagagaacaaataaataacagttttcatatacaccaacaataaccaattgaaagcatgtttgtgtgtgagtgtatgtgtccttgtttgtataaaatatatatatatttatatttactcacaaataactaaaacattaaaatatattcatatatacattttaactatatattcatggattacatataaatatacatattatatatttatatagtgtatacttttattaaagatataacatagtggttctatcacatcctagctctatgaccttaggtgcttccagaaacctctcaatatctctgtcaatgtttctggtgttttcaataggcaccaagatattgtagtgatgattaaatgtgtggtatttttttaagatcaagtcctagcacagtatatatttaagatcatgcagttcagtgagtaattgtaagaaattcaagctttatgtgaaggagcacataaaactttatgtgatgcattaatgaataatttattgaataaatatttctgtgtagggaaaataaaattgtaaagatacaaagtttcctcatttaaagtatagatttgtaatgcaaactcaattaaaacctaacttctatttacgaaagaacttgttaatgatactcctaagcattctgatacagaactgtgtaagaactatacagaaatttttgaagaataaaagtagtaagacttgtagttttctttttctcatcgtgtctctgccaggttttggtatcatgataatgctggctttgcaggatgagttagggaggattcccttttgatgttttgtaatagtttctgtaggcttagcatcagctctgtggacatttggtagaattcggccatgaatctttctgattgagggcttttttaggttaggaggtttttttattactgattcaattttggaactcattattggtctgttcagagcttcaatttattctagtccaattttgtaaggctgtatatgttcaggactttgtccgtttcctctagaatttctagtttgtgtccatagaaatgttcataatagtcactgaggatcatttctatttctatggtatcagttgtaatgtcatgttcatcatttctgattgtgcttatttgaatcttctctctctttttatttgttaatctagctggtggtatatcactgatgaacatacatgcaaaaatccttagcaaaatactagccaaccaaatccagctgcacatcaaaaagttaatccaacacaatcaagtagattttattcctgggattcagggttggttctacatacacaaatcaatacaggtgattcaccacctaaaaagaattaaaacaaaaaccaaatgataatctcaatagatgcagaaaaagttttcaataaaacccaacatctcttttgatacaaattctcggaaaagtaggtatcaaagaaatggaactacaagttactattcaaagaaatcagagatgacacaaagaaatggaaaaacatttcatgcatatggataggaagaattgatgttgttaaaatgtccatattccccaaagcaattaatagattcaatgctatttttattaaactataatttacatttttatagaactagaaaaactattttaaaattaatatgaaaccaaaaagttgctcaaatagacaaggcaatcctaagcaaaaaccatacacctacaattatctgatctttgctaaacctgacaaaaacaagcaataagaaaaggattccttactcagtaagtggtgctgggataactggctagccatatgcagaagtttgaaactggaccccttataaaaaatcaactcaagatggattaaagagttaaatgtaaaacccaaaattataaaatccttggaagacaacctatgcagttacattcaggacataggcatgggcaatttcatgatgaagacatcaaaagcaactacaaaaaaaacagaaattgacaaatgggatcaaagtaaactaaagggcttctgcacagcaaaagaaactatcaacagagtaaacagacaacctacagttcatgagaaaatattcacaaactatgcatcaacaaatgtctaatatccatcatcattaaggaacttagacaaatttacaagaaaaaaccccacaaataattcaattaaaaaatgggcaaaggacatgaacagatgcttttcaaaagaagacatacatgcagccaacaattacaaaaagaagttcaacatcactgatcattagagaaatgcaatgcaaaactacaatgagataccatttaatatcactcagaatggctgttattaaaaagtcaaaaaaacagatgctggtgaggttgtggagaaaaaagagtgcttacgtactgttggtgggagtataaattagttcagccattgtgggagacagtggcaattcctcaaagacctaaagacagaaataccgttcaatccagcaattccattactgggtatgtacccaaaggaatataaatcattctattataaagatacttgcatgcctatgttcattgcagcactattcacaattgcgaagacatgcaatcaacctaaacgcccatcaatgataggcttgataaagaaaatatggtacatatataccaggaaattctatgcagccttaaaaaaagaatgagatcatgacctttgcagggacacagatggacctggtggccattacccttagcaaactaacacaggaataaaacactacatactgcatgttctaacttacaagtgggagcaaaatgatgagaacacaaggacacatagagtggaacaacacacactgggccttttggaggttgaaaggtgtgaggagggagaggatcaggaaaaataactaatggatactaggcctaatagctgggtaatgaaataatctgtacaacaaacacccatgacaaaagtttacctatgtaacaaacctgcatttgtacacttgaacttaaaataaaagctacaaaaaaaaaagtcatacctcaacataatgagaaccatctatgacaatccctcagccaacactatgacgaattggcaaaatctggaaacatttcccttgagtactgaaacaaaacacagatatccactcttaccatcctattcaacacagtactggaagtcctggccagagcaatcaggcaagaaaaagacttaataggcatccaaatcagaaaaaaaaaaagccaagctgtctttctttgctgaatatattattctatacctagaaaaccctgaagagtctgccaaaagtctccttgaactgataaatgacttcaataaagtcttagtatataaaatcaatgtacaaaactcagtagcatttctatatgccaataatgttcaagctgagagcacaattaagaaagcaatcccattcataataaccacacataagaaaatacccagggatacatctaactaaggaggcaaaagttctctacaaggagaactagaaaatactgttgaactaaatcagagctgacacaaatagaaaaaatattgcatgctcatgaattggaagaattgatactgctaaagtggccatactgcccagagcaatctacagattcaacgccattcctatcaaactaccaatgtaatttttcacagaattagaacaaagtattctaatattcacatggaaccaaaaaagagactaaatagccaaagcaatcctaagcaaaaagaacaagccagagacatcacattatctgatttcaagctatactacaatgctatagtaaccaaaatagcatggtactaataccaatatgaaaatatagaccaaaagaacacaatagaaaacccagaaatacagccacacatctacaaccatctgatctccaatgaagttgacagaaacaagcaatggggaaagactccctattaaataaatgttactggctacccctatacagaagaatgaaactggatccctacctttgaccacgtaaaaaaattaactcaagatggattaaacatgtacatgtaagacttcaagctgtacaattctagaagaaaacctagaaaatattcttctcagtatcagccttgtcaaagaatttatggctaagtccatgaatcaattgtaacaaaaccaaaaattggtgagtgggacctagttaaactaaagaccctgtgcacagcaagagaaactactgatgggataaacagatgatatggtttggctatgtccccacccaaatctcattttgaattgtagctctcataatccccacgtgttatgggaggaacctggtgagagataattgaatcatgggggtgggtttttcccacgctattctcatgatggtgaataagtctcatgaaattgttttaattgttattgttttataaccagcggttcccctgcacaaactcttgcctgttgccatgtaagacatgcctttgcttcttctttgccccctgccatgattgtgaggcctccccagtcatgtggaactgtgagtcaattaaacctttcctgtataaattacccagtctcagtatgtctttactagcagcatgagaacagactaatacagtaaattggtaccggtagagtggagtgctgcagtaaagatacctgaaaatgtggaagcgactttggaactgggtaacaggcagagggtggaagagtttagaggactcagaagaagatagggaaatgtgggaaagtttggaacttcccagaggtttgttgaatgactttgacccaaatgctgatggtgatagggataataaagtccaggctgaggtggtctcagatggagatgaggaacttgttgggaactggagtaaaggtcactcttgctatgcaaagaaattggcaacattgcaccactgccctagaggtctgtggaactttgaacttgagaaagatgaattagggcatctggtggaaggaatttctaagcagcaaagcgttcaagagtaagcagggcataaaagtttggaaaatttaagcctaatgatgtgatagaatagaaaaccctattttctggggagaaatgcaagctggctgcagaaatttgcataagtaatgaggagccaaatgttaatcaccaagaaaatggggaaacatttccagggcatgtcggagacctttgcagcagccctcccatcagagactcagaggcccaggcgggaaaaatggttacccgcgctaggtccagggcctccttgctgtgtgcagccttgtgacatagtgcccttcatccaagctgctccatctgtggcttcagaaggtgcaaaccccaagccttggcagcttccatgtggtgttggtcctgtcggtgcatagaagacaagaattgaggtttggaaacctccacctagatttcagatgatgtatgaaaatgccctaaatggtcaggcagaagtctgttgtaggggtggagccctcatagagaacctctgctagggcactgcagaagggaaatgtggggtcagaacccccacacagtccccactgtggtactccctagtggaggtgcgggaagaaggccaccctcctccagaccctagaatggtagatctactgacagcttccactgtgttcctggaaaagctgcagaaactcaacccaggagggggtctgtgtcctgcaaagccacaagggcagagttgccaaagtcttgggagcccacctcttgcatcagagtgatctggatgtgagacatggggtcaaagaagataattttggagcttcaagaactgactgccctcctggatttcagacttgcatgaggcctgtgacccctttgctttggtcaatttctcccacttagaatgggtatatttatccaatgcctatagccccattgtatctaggaagtaagtaacttgcttttaattttataggctcataggcagaagaaacttgccttgcctcagattagactttggactgtggacttttgagtcaatgctgaaatgagttaagactttaggggattgttggaaggacatgattatgtttcaaaatgtaaggacatgagatttgggaggggccaggggcagaaagatagtgtttgactgggtccccacccaaatcttatcttgaattgtaactcccataatgtccatgtgttgtgggagggacttgttgggaggtaattgaatcatgggggtgggtttttcccatgctgttctcatgatagtgagtaagtctcaggagatctgatggttttataatgggcagttcccctgtacaagctctcttgcctgccaccatggaagacatggctttgcttctcctttgcctactgccttgattgtgaggcctccccagccatgtggaactgtgagtcaattaaacctctttcctttaaaaattactgtcttggatgtacttattaacagtgtgagaacagactaatacaacagacaacccactgaatgggagaaatattcacaaactatgcatccaacaaaggactaatatccacaatttataaggaacttaagtcaacaagcaaaa

SEQ ID NO: 574 - DNA, 105276 bp, Homo sapiens
actcaatgtgaaagacctaagtagcaggttcttcaagttgtcatcacagcagaaatctcactgggagtcctgttttctattataagcctaatttggcatattgattaatttaatttaattcattaataattaaattggccacctacactatatgaggtgctgaggtagatgctttgggaaatgcaagatttatattgctctcaatatcccacactctagggcacaccttatttgaccacatttcctgtctcagattgtgatatgtctttactccaacttaccaagtcagattcttcaatgcacagccttggggctcaatagttctgtgtgtaccaattcattttttgcttttgtcagcaataaaccttaaaaaaattatctgaagtctaaaataattacttttgttagaaactttacatttttcgtattctaagtggtgtgcatattctaaatcttgacatttttcacattctaaatgatgtgcaaatatagtgaatccagtaattctaaagttttggggatagggtgtttaattgttcaaggaatcatactttatttacatttcaaacatatactcggtaagtataggtgtagatggaggaatcggaagagtaagagggttggaagatgatgaggaagctgtttataatgtatcaggagaaattgcctgtacatttacagtgtgttatggaatagcaacccatatcatattataaaaatctctaggaaaatatttattaaaatatctatttaaaataatatcataattagtgtcttagtcagcttaggctgccataacaaaataccatagactgagtaacttaaacaatggaaatttacttctcacagttctggaggctgaaaagtttaaaatcaaagtatcagcatggtcagattttggtgaagactctcctcctggtttgcagatggccacctttccacactgtgtctccacacggtggagagagtgagctctggtgtctcttcctcttattataaatcaccaaatctattgtattaggtctctgcctttatgacctcatttaacttttagcacctcttcacaggccctgtcttcaaatacattagtggttaggacttcaacatacgaatttcggggagacacaaacatttgctctataacaatatgtaaaaggctattaactgaaataaagattctttgatcccaggagctagccaataacaggccactggaaaaatcaattgaaaaagtgccaattgattatatattgcatgtgactctcattttagtggctatttatattcagagaaagatcagaaacagaaattccaatgaccggggcagggggttcctttgagataacttatatagataataaaaccctgtgaagatggcataaaatctgaattttgaacagtcactatgctttagatgaattaatatggggaacaagaatatattccaaaccatcaatatcttgaaatttagaatcgcttgaagacaatcctattgccaaggaatgtagttgaaaaacttgagccatggattattgaggggaattaccagatttatcaggatggcagataaacgtctagggaaatagtgctcaatgcagccttataaaggtagcaataaaacattagaaggaattggagaattgggatacataaacttcagtcatcaaaaaaaaaaaagtagcagaaaataaggcgaggggattatcctttcactcaccccactgtctttgttattttttttttccccatcacagatctcattttgttctctaccaaatcttatgtttagcttgatgcatttaaactatattgcagtttggttctactaagaatgtatgcataccgttgtactatttgagaagaaggagaaagaaaattagcagaaaaatactttgttgtttcatgttctgcttaatatggcctcaaatcaatatttactttgaaaaattttaaatcgcttgtgtccaaagatattataaatctctagctttcagggatatctgtttttttaactcataaaaataattattaatgctagtgcttgtgggtgcaaattaagatctttattctgctagcttaaaagtcatttgattgctttcattctttcctatatgcacagacaaatgccattcatgcttcttttccatatagtagcctagcaactgcaaatttcaagaactttttataattacattctctgaataattttaaaagtatgtcaccctctcaaatccaagagaatactgctagttggccttgcaaatgaccaaggccatcattcttacttgttagaaatttagcttggtaatctttctgtgttgtcaagaagttcagtctgatgtcccaaaataccaaacctccacttataaaaatattcggaaccaaaagaaaatcaaagaataacacagtttgtactctagaggacagtaatactgctccctggtttctggatttttgaaagatgaataatgcagtcaatgtactcagacaacaaaattaaatcagttacaagctctgagaaatgtacacaaaaatacaaatacatgagcaagactcaaataagattgatttccaaaagtcacaaaataaaatatattttgaatttgagttaacgcaggcttaagaattaatttagaaagataattatcatagatgatgatgaaagtagaaagttgttacctcacatagggaatattttaaattactattttcctagaaagtagagttgctaggaataaaacacaggctctcagttaaagttgaatttcaaataaacaacaaacaattttttagtgcaactatggcctataaattacttggtataaatataccccatgaatatttgacatctacttacagtaacaaagatatttaccatttatctggaactcaaattttactaggctgtcaggtatttttatttgctaaatgtggaaactctacgaatagaagattttaaataggactataaaataaattaactggctatcttgcttacattagggacctaataaatgtctggttagcagaacttataccttttattttaattgatgcatcataagcttaactagatactttaatcaggaaataatatgtgaaacaactatgactcatgagcacgttttagaattataatctctgaataacttatttgtgcatatttttgtttattcaatgaataacaacttctaggaatagttagcacattcagcttttcttagaatcatttttatacttgatagaaataaaaatactgttaaagaaaatgtcatgatgaattagaaaggcaagaacactgcagaaggctataatcctttcagatttgaaggatggaatgagactgtgtctgcaggactagctgcccaattgaattgagatgatgtagctggacatttaaaaaagcacagtagtacatgcagggtcacatcacagattgaaatgaaaaaagtccttgttgtcatttttatttcaccaattggaataagttttcaacttgtgaaaagtgctgcacaaatcctggaaactgaaattctttactaaagcacagggaagtgcagggcaatcaatggcaatatcagattgaagctcatgcctgttaataatgtgacttaatcctgatttggggaaaaacattattttgaggatgagaatatcaaccctgagcactgctctgcgtttctactgaaagtaacaattatttcttatcagtgatgatatggagccttcccaggtgaaggatgtgcaaggataatggccatggtggatggggagaggatgggagcagggtaaaagccaattctgctgcagctaacatgctgtgtctaaacactatgcaagatagcagttgtcatacagtctcagcttctaatgctgggtcagtagcttacttgtgaaacttgtataagtcgttttacctgtcagctcttttttttttttttttttttttgataaatgagaggaactttaagaggtctttcagctcttaccaactttggttatgccattgataaggacctttaagaattagaatatttaatttcattattctaattgctttggctaatgagtatataagtactgaaatttcatttcctgggatagtacatttggggaagatattctgtgtatttctaagtccctatcctatctttttacacactaaattttagtcatttatccaagttgactggacccatgccataggttttacaagaaactggacacttaaagaccttaacagtagttacccaacttaggaacagaggcttctttcaatagacttatgctacaaagcagatgaggaagcatgcacttccagctgttggattcttttgtgcccataacaggtatgaaactgttatgcacggatttcactgtgcataaccttcaacttactgattcatattaaaatggtaataacaagtaaatgaaactcctataaaattggtttcaagttcaggcagacagacatggatcatcgcagctatgtgaacttgggcaaagtatcttgtcatcttgtgcctttatttaaaaataagcataataatttacctaccttatatgatcattgtgaatttaattgtaaacacttgacagaatgcaatcacatattgagtgcttaataaatactagctgttgctactatcattactgccattaccattatcaaaatgattatttttattagaaacctggaagaaacttaagtaagactgttgaaaaaattcagttctgcttttctttttcatgtccactaaccctataatcttctgatgagcatcaagaaaattatgtttaaacaaattgaggaaaaggaaagcattccactttatgagtatttatgagctatttataaaatacacctgaatatgtgagagatatattgagatgtggcctttaaaagaaaagatgaacagagaaagcaaatctatttgcctgtacaagtgcatgtaaccagtagacaatatgcagtaataagtcattttttgcatttaattttagttatctaatataatttttctatgtaagacaaatacctgtagatacattagctaaatatagaatgataatatagacagtcaggttcatcatgggtataatgcttgttaaataaacattaaataaactctctgtcttggttttggctcatgacataattttaggcctgaagtgccttcttctagccagagaaaggcaatgaataaacacgaagtgttaggaagtgaggtaggaggcagggctcagacactggacaaaattgagtactagctaaaacagggacagggcaggagttttctataagacaagcccataagtgtgtcatgtcagtttatcattgccatggcaacaccaggaagttaccactcctttccatggcaatgacccaacaacctgaaagttaccacacttttctagaaattactgcataatctacctcttaatttgcatataactaaaagtggatataaatatgactgcagaactgcttttgagctgctactctgggcacactggctatggggtagccctgctctgcaaggagcagtacctctgctgctgctgtacactgccacttcaataaaacttgtggtccaccaccacctgctcacgcttgaatcctttcctgggcaaagccaagaatcctcccaggctaagccccaatttaggggaccacctacactgtcagaagcttactttctgagttatttcacttaaaaggataataatttacctatctgatagaattgttgtgaatttaagataaaattatcttgcttaagatgaaggtgaaatgactcagaaatagaacatcaaataccacatgatctcacttataagtgggagctaaataatgtgtacacatttatatagagttgtggaatagtagacattggaaactcagcagggtgggaggaggtgagggaatgagaaattatttagtgggtacaacgtacactattcgagtgatggttacactaaatgtccaggcttcatcactatgcaatatatccatgtaaaaaaaactacacttgtaccccttacatttataaaaatttaaaaagtcacattgtaaagtactacattgttagtttcagggtaaaatgacttaaaagacctaactggttccaaatgtctcttgtgtaaagatttcatgatgactgaaattctcgttattagactcaattctttgtgacgtaatagaacttttcaggagcttttattaatagctagagttttaatatagaaatatctgataactattaggagcatcaggagctcctttctttccaatctgtatgcattttgacatttctcaacgttattgcaatggttaattaagacctttagtacaagttgaatgcacatatgagtttgtacatctttatgcttacctgatcttagacaatgactttcagcctcaccatttaataagactttaaagatacattttcgtagatgctctctaccatgttgaggcagtttgcttctattcctagatgataaggtttttattatgcatcatgttaaattttgtcaaatattttctacatctgttaagattatcaaattattgcccttgaaattgtttgatcagtcaatatagtgacttacattaatgaatttcagatgtcaaatcaaacctgctatcttggaataagctatgttttgttgtaacatatcatttattttatatattgctgattataatttgctaatatttttaaaggattcgtgtcactatatccatgacaacagttgtctgtaatgtttttgttggtttatttttcttaataatacctttggtggtttttattatcaggataatacttacctcataaaatgagctggaaactgtgttctccttttttactttctggaagattttataaataatagatattcctttttcctttaacattaggtagaattcaccatggaagctgtctgggtcaatggcttgctatattagatggatttttgtttgattgtttaactataaattgaatttcattagtaaatgcagatatatttaagttatctgttttggggtgaattttgctaatctgcatctttcaaagaatatttatatttcttctaagtttgtcaactatatcaacataaaattgtattactaatttaattcccatagaatacaacatggagccttgtccactctcatcatgatattggtagtttgtgaattaaataataacaattaaaacatacgacatagaaaaattttttgttaagtaatgcatagaaaaaaaacagtatgttcaaatgaagaggagttaaaaatctaatcttcaacctcaagaaggtagaaaattaaattaaaataggttaaaggaaaaaataatgtggatcgcagaaataatattaacagaataatattaataaaatattgacaaactattagccggaataataaaaagtaaaagaaaactaataaagccaaaagtttgctctttgaatacactaataaaattaagccactttcagtacatctaatcaagagaggcagaaaaaatacaagtttattttgaacaagaggacttcattatgtacttacagaattaaagagacagtaagcagttgtgtagaaatttttgctaattttaaagaattataataatataaactgtgttttttgaccacaacaaaattaaattagttgttgaaaaacagctagaaattctgcagatgcttgcaaactatgcaacatacttctaaatttaaaaatatacacaagaaattgaaaaatgcttttaatgcaataatgtttaaaacaataaatcatttttattgtgtctatttgattcttctctcttttcttctttatcagtctggctagtggtgtattttgttaatcttttccaaaaaccagctcctgggttcattgattttttgaaggttttcttcgtgtctctatctccttcagttcagctctgatcttagttatttcttgtcttctgctagctttgaatttgtttgctctttcttctctagttcttttaattgtgatgttaggttgttggttttagatctttcctgctttttcctatgggcatttagtgctataaatttccctctaaacactgcgaagtatacaaacaaacgcttctcaaaagaagacatttatgcagccaacaaacatatgaaaaaatgctcattatcactggtcattagagaaatgcaaatcaaaaccacaatgagataccatctcacgccagttagaacgatgatcattaaaaagtcaggaaacaatagatgctggagaggctgtggaaaaataggaacacttttacactgttggtgggagtgagtgtaaattagctgaaccattgtggaagacagtgtggcaattactcaaggatctagaaccagaaataccatttgacccagcaatcccattactgggtatatacccaaaggattataaatcattctactataaagacatatccacatgtatgtttattgcagcactattcacaatagcaaagacttggaaccaacccaaatgtccatcaatgatagactggataaagaaaatgtggcacatatacaccatggaatagtatgcagccataagaaaaaagaatgaggtcatgtcctttgcagggacatggatgaagctgaaaaccatcattctgagcaaactaacacaggaacagaaaaccaaacactgcatattctcactcataagtgggagttgaacaatgagaacatatggagacacagaggggaacatcacacactggggcctgtcaggggatggggggctgacattaggagaaatacctaatgtagatgatgggttaatgggtgcatcaaaccaccatggcactatgtaacaaatctgaatgttctgcacatgtattccagaacttaaagtataattaaaaaaaaaacaaatttgtggtatgtagctaaaatagggcttgtagatgatttttatcattaagtgcttatgtaagaaaaagaagaaaagtccaaaatacatttttaaacacaatagattttttccattttgttatatactctgattagaaataaataaaatatttgtatctttttacatctctgaaatgcagatttctttgcatgtcaacagtttatatcaatattaatcatctataatgtcttttaccttctctgtgtgcataattttcatttttctctgatcgtcaccttccaaagcgcataaatattcaaagcactgtagcttcctgtgccagctttccccactccccatcatttccccattttacttaactctttcaaatacattgttaatgatattaaatagtaccctggatgaggagatgagtggaagtcagaaagcattgccatctcaggaatggtgttaagctacctcctttggagctcttcagcactagcaagagtgctattgagttggaccctcccttcaaatagaaaactggcaatggggccaggaaaggcaatagcttctcctcttttttgaacactttttaatattcatatcatctctggccaattacctattcaatgacgtatgattcatgcatttacatacttaaatattttttcaggaactatgtttgttagatatgggaataaaataatccatttttacgtattaaaagcactaataaatgccagaaaaaaataattaatcaagtactatacaaataattttttaaagaaaagctaacaaatgaagatctttataaacaatgctgtcttgtaagtccaaattttaaaattcacttctgtcatagtcttcgtaaatagtaatatgacattttctcccattcctctataacacacacatatatagcttttaaggaaaaaaaataagcactttgtccaattataattattagtatactctgctctgtccacatgaaatctttgaaggtaattttttttctcttgtttactaatagaatcctctgattcctctactgtacaaactagtcattttcctttttacgtaacttctcttagatcatactggccattcagttcttttttaaaaaggagagagagagagagagagaagcttttaatacctttgaatactttccctgacttactacaggtaactggatgaccaatatgcctccataaacatttcagcctgaagattattgatactacatagagatacaggggcagaaaaagagaacaactttttaaaattttacatttttggaaaattgttgaactgttcttgttttgtgtaatcactataaatcattttctcatcaaacataccttagatatctaaaaaaaaacccgttccttctgagagactgatatctcacataacgtatttaattgtgacagtctactgatacaactttgttgctctgtcatctagtacatttcgtttttgttacaccaaatattttagcacagttatatatataataatagacaaataccatccaaagtcttccatttttaaaaaataaaatacaattaattctttgatatataatacaaaatttattcaccactgagagtgagctttaaattacttgtgcagaaattgagattgttcatcattacaaataattccatctggcagggattcacaggaaccacttcacaccatgactcttgatgagttgactgttcctaactgtgacatatccttttatcttaactggaaacctcaggaggtaggctatgttcataattgaaaacataattgaaaacaaaatatcacacaatgtcatttggaaagtcaaagttatgattttcacatttactgtattgaagcaaaattaaccatgagccaaaaatatacatgtcaagcttagtagtgttttaataaggcatgaacaacagcactgaggaaaaaagatagttgaaaataaatttcctttttcaatatattgcacggtttgttcataaaaaatgtttttgtttctgaaagtaatttgatcttttctctaggtttatatttagcaatgtttaagcatcattatttctatctctacacttttatagtatagtcattcaaaacactggctctgaaaagtctaaccaaactgctgtggtttgaatactatttccacctcttactaaatgcatgaccttggacaagaatcataatatctttttatttcttttatgtatttctttatttatttactcagtaggttttggagagaacagttggtgctcggtcacgtgaatcagcaagaaaaaaacaagcaatcccttcaaaaaggggcctaaggacaagaatagccaattctcaaaagaagatatacaaatggccaacaaacatatgaaaaaatgttcagcatcactaatgatcaggaaaatgcaaatcaaaaccacaatgtgataccatctttctcctgcaagaatggccataatcaaaaaatcaaaaaataatcgatgtgggcctgtatgtggtgaaagggaacacttttacatggctggtgggaatgtaaactagtaaagccactatggaaaacagtttggatattccttgaagaactaaaagtagaactctcatttgatccagcaatctcactcctgggtatctacccagagaaaaataagtcattataagaaaaagatacttgcatatacatgtttacagcagcacaatttacatttgcaaacttatggaaccagcccaaatgtccatcaatcaatgactggataaaaacattgtggtatgtatatttaacatggaatactactcaggcataaaaaggaacaaaataatggcattcacagcaacctggatggaattagagaccatgattccaagtgaagtaactcaaggatggagaaaccaaacatcgtatgttttcactcataagtgggagctaagctatgaggatgtaaaggcataagaatgatacaatcgactttagctattcaagggaaaggattggagggggggttagagctaaagactatacattgggtatagtgtacactgctcaagtgatgggtgcaccaaaatctcagacatcattgtatttcacattgcacataagcagaatgggaataataatattagctattttataagattgctatgaaagttatgttattattatgttagattagattagattaggtgtgccaattgcctatcaatgtggtacatactaagtgtgtcacagccacaagtaatgaagtcaccaatcccagcagagcagtgagtgacccactgcaaaaacattttctcacctgctttctcaaacactgaagaaactgagacagaataaacagagcaaggtgtttgttacagatttgtaccagtgaaaggtccccagaaagcaggattacatcaaaggcagcggtttgaaatgggtctgcctgggagagaattccagagtatgcagtgcccatttgagttgccttgtgtcagacaaaaatgtcctgtcctttacaccttaccttgccctgtcaccagatgcaggttgtatcaggaaaggcatgacctcaggcaaggtagctctgtggcacagacataccttgaaggggctggctgctatagccagtatttccttgagtggggcacaggtagcacacttctgtgcataccacacttcaatctacttccttttaaaaatgtgcatattttacaaacaatataaaaaattccataaaaacatcgaacagtcctctgctcctcctttccctacccttgaggggaaaccattgtctctcagcacttatttgtatatttccaaataaattatttatagtatattgtcttatttaattatgttggtattaacttactgccaaatatggtcacattctgaggtaatagaggttaggacttcaacatatgtgatagtggttggggcatacaatttagtctgtaacattctcatactagcccacgtatggcctttagcaattcatgaatagtttttgctgaataagtcttctttgcttatgtgttagcacttgtattagtcagggttctcttagagggatacatctatatctgtctatatctatatctatatctatctgtgaagtttattaagtattaactcacatgatcacaaggtcccacaatagccaaagggagcttgaaaggacaactagaaaggctgtactacttgagtgaatagaagagaattaagaaatgtctccagagaaatgagtaagtcttttattaggtatataatttaactctttagaacattttattaagacaattaaaactattgcttactttttttagtaagttggagatatttggattaagataaaccatgcaaagacaagatttatcagggaatcaaatgtaatctttgctttgtttaatattcaattgcctcaattcttaactttagtgttctaatatagatgtgtttagatttaaaaaaaacacacacagcttagaggaaaccaaaatggatattaaatgacaaaaaaagtttcatttataacttgtcctgtaaaccaaaataaaattataagcccccaactaaccaagtggaccctcctctaggctaaggggatccaaagaaacctgagaaactaattcaggccatgagagaaaagagaaagggtcagacatgtctcattatactctcctccctttggagtccaggcacagctgaccagcattaaaatagagatcctaagtcccacagaatagactcttgtagcaataagataccaactccaacctgactctggtataacatcacatgacagataacaggccctaaaaggaaatcaaagcattttatcccgaaatatatttctttgacatattttgaaacagttctgcacaaaactgtctcttgtgggggaaatctcttttccttactaggtctctccagagagcctgacacctttgacaagaaacattcacatctattctctctgaagccttctacagggcagagaagcttcatctacttaacaagaccattggcttccaccctccctgccacccccaccttatcttaactcaagctgattttaactcttcaggcagagcataaactttccaaccaattgccaatcaggaaacttttaaatctacctacaacctggaagaggcacctccgaccctgtacgaatcccttacccactgcttcgagatgtccctcctttttcctttctggcctaaccttaaatatattgatttatgtttgtgcctgtaacttctgtcttctgtataaaacaaatctgttacccaaccacctcaagcacatatttgcagtaccacctgaggctgtatcaggaagggttatgatccttaactttagcaaaataaacttctaaattgattgagacctgtctcagatactttttagtttatggtcccaacagaaagaattccaaatatataagttactgataatggaaaagcaggcaaaaatagggggaaaatatttgctgttttacctttagttatttggatctcccttccataagatgcctattttcagcagtgatttatgccaactgccttaatttcattctacagtgaaatattcaaggaggatcaagtggttcccagatgaatatttctggaaaaaagtagctactgatctgtgggcaggaaaacatgaagtattagtgagtttcagagccaggaggagtgaggggaaaagtcactgaaagtgacagatgtcgccttcctcataggttcttcttgtgacacaatattcacatgagagtacatttgcccatttaatttttaaggaaagaaaataaatagagcaaagaaatgaaaagtaaatcaccccttgccagagaatatttataatgccaatgggatggtctcagtagacgagagaaacaaagggaatctaaatggaatgaataaaataaagagcagagagaggcctgaagaaataaaactgaggtgtgaaaagcaagaccaggacatgaaacatgggatagaaacaagagaaatgagtcagagagacaattaaattcttaattaaaatttagtccaggcagggtggctcacgcctgtaatcccagcactttgggaggccaaggcaggcagatcacttgagcccaggaattcgagaccagcctgggcaacatggcgaaaccctgtctctacaaaaaatacaaaacttagccaggtgtggtagtacatgcctgtagtcccaggtacttgggaggctgaggtgggaggatcacctgtgtctgggaggcagaggttgcagtgagctgagatcacgtcactacactccagcctttgagacagagtgagactctgtctcaaaataaataaattaattaaaataaaatttaggtattagtgagttttcaactattcataaattatttttattattcatatattatgttgtgattttacaactagcataatttttgaaatgtctttatataatctatgtctttttgaagcctattaatttttttaagagatgcaatatatgatacaaatacagttttctgaacacagtattatttagtcattgagaagagattatatcatttggagtaattgaaaatctttcctcaggaagagaatgtgtcactgaaatgcaagccagtctaatatccaaactttataaagcctattggtgaatatcaggtgatagttgtttctctaaggtggcctcatttcagcttcacattgggagatatgtccatatgaaacaatacacccataaatggtaggaggaagctggatccaggttgagggaaagataactaagatggattttagtcaggaaagtcagtggccttgaaaggtaactggggcagatttctattttgggaattaagacagaattttaagttcatagaactaagctatcaaagaagtgtgtgtgtgtgtgtgtgtgtgtgtgtgtgcgtgcgcacatgtgtgtgtgtgtgtgtgtgtgtgtgagaagtggtttaaaatttacaaccacaacttctcggaatttgcccattgagtacagaaaactagctatgctgacagaaaaggaaattggcagctgtgattttctcactataagaaagttgtaggattccagactaaactccatttccaaggccaatcagatgtttacatgtgtggatgtttacatgtggagctgcagacattgttttccttcttcagtcaggaataggaattttaggaactaggtttgagcagattaggtaagggatggacatccagctgggtgatgttaaaaataaagagggagaaaacagaaattagcgctccaaagctaagattttcagttaaaaaataatatagcctgtaatcccagctactcagtaagctgaggcagaagaatcacttgaacccagcaggcggaggttgcagtgagccgagatggtgccactgcactccagcctgggcaacagagtaagactccgtctcaaaaataaataaataaataaataaacaaacaaacaaacaaacaataataaaaataaataataataatataaaaatatattgagcactcattatgtctcatctcctgggctaaatattttgtaactattttttactttaattttcataagcatgctgtagggtagataatattattatttttatttaacatacaagaatatagaagcacaaagagaataaatatcatgcttaatatcacgacttgtaaatgaggaatatgtcagattatagtctatgtctctgtaacaactagtcctactaatccttcaaacagctacaatttcaaagctgtattttaggaagaaacttctctcactgatggttatctttagttgacttcaggaggatagggtggtaagataattttttagctcttttcaacagtacaccagaaagtaagctttatttatttatttatttttttctctcactctgtcgcccagactggagtgcagtggcgtgactcagctcactgcaacagtcgtgagccactgtgccccgcttatcttgccctatttattgttgattgttaaaggcctctaaatgagtttctagaagaaaaaattatgaaactcttgaaactcatggagtatagtaacacaaatagtttaaagatggttgatttaagagacattctgaaaagcagaatggtgtagtagaaagaccttaggctttagaattagacagagtttttaatacaaactttgctgttttctactagcttgaatccaagcatgtcaactcttgtaaaccatagtacacgtttgtgtgtgtctgtgtgtgtgtgtttataatgatatatatgatatatatatttttacttcataatgaagtaaatatatataacatatatagatatagctatatgtcatatgtatatatcatatgaagtaaaaaaattagtctgtaacagagcctcataaaaaatatagaagtttgtattttaaatctgacattcacgtttagctgtctttggtatgcaaccaatctatttgtaatttattttagtataaagctcagaattgaagtcaaattatttttaagatttcaatctcaaagggatatgaaatcagaggcattcaggcttatttaattaaaagacaatttcagctctatgattaaagaaaagtgtttctcacattaaacaatttactatatgtacatcagcatcatggattaatgtatttccaaagtatttactcaatctacaagcatatttttctttgtaagtacttttaaattgctagattcaactttttataatttcaaaaatcccaaatgagaaacaagtacgatataatatcattcatctctgttcaaaggaagggattttgtcagatttaggatataattattcattaggaatgtatataaaccaggaccaaaacttgcttacttgctgagccctcctcatgcagaaatctgaaaactcttctactctaaactcttgtttatgtttccaaaagatattactttaacacatactatgtatgcatcacgtacagcactcactctgctaagctctgtgtgtgttagcttgtgtgtgtgtgtgtgtgtgtgtgtgtgtgtgtgtttaaatacacaagtcgtggtttacttgagaaatagaaaaattaatctactattttaatataaagtgaagaattttgtaatatagtttttcacctaaatataggaggaaatgtctgcaaaaaccttatcaagtaggtgttatatgagttgagtcttaccggccgtggacgagttattgtgttacacttgtccctttattacatcagttatactggggaatggagcaaaataaaatcagggagagagactggaatgagaccacgaatggcattgtatattatgcaggtattttaaacagtattttctagaaaatggaggccattaaaggatttttaggcaagaaagtaacaggacaatattttcagcaatgtggaagatggttgctgggaaggctaaacaagagatgctaatagggagaacattacattactacaagcaagagatgataaggatgtgaattaaaataatggcattaaacatccagaaattcaggcacaaatataagataaatattatagaagccggtgactaattggttgtggggaacaaagagaagggacaaacagttccagaagcaagtgtctgagtaaaagaggttgttaactaagaaaatgaaggatgacttctgtgttgaggtgtgttatgaatgtgtagtcaccatgagcttgatttgactcttgataattcacatggagattcaaagttgtgtcaataaacactagctttagatatataggtgttgatttcaatagtttagatgttggtttttcatatgtattttgagggttgtctccatgaataattaaagcctaattattcaggctgatattgactgatattgactgatattgactgataaatatccagaactgatattgactaagaagagcataaaagcagaggatggaaagcagagaaacattgtaggagcaaataaagggaaacacagaaaacatggtttcagcacagtctggtccaaagatgatagactttttgttagtttgggacctcctctgcagttagtcatagcctcctggaacttccagaatacaattgaggtagaattacttttgaggtttatatggatagtctttatttaccacttggatcagcagtataaggaagctgactgttaagatttacacaggtggccgggcgcggtggcccatgcctgtaatcccagcactttgggaggccaaggcgggcagatcacctgaggtcaggagttcgagcccagcctgaccaacatggagaaaccccatctctactaaaaatacaaaattagccgggcatggtggtacatgcctgtaatcccagctacttgggaagctgaggcagaagaatcgcttgaacctgggaggcagaggttgcagtgagctgagatcatcgtgccattgcactccagcctgggcaacaagaggaaaactgtctcaaaaaaaaggaaaaaagaaaaaaaaaaagatttacacaggcagtccacgcttttaaaaattagggagatgctcgtataaccaataatttactttcttccagaagtctcaaagcaccctgatcttacccaggaccttccttgcattataaaaatataaaccagacagtacattccttctacatgtgtagaatgtttactaatgtaatgtgtatggggacatggttagctttggaaaacaagagctagacacacatacatgtaacagtattgctgttatgatcattgcacttaattcatagtattacctgctatctgggccctgtgctaatttatgaacatctactattagtgatctctcatttgttttcattaaccacctacatgaaactatataatcttgatttatcttcacaccaccctttgtttactattttttctagtaaagataatattgtaattacataaattaacctttaacactacggactcgggcagaacctaaatcagtttctgcatcttcaaattactagtaatccacaatatggcaattcataaaaatttttgaagctttacatatttatgttgaaataatggacataatatctcttttttaggatattaaaagaaaatactggaacattgtaggtgctcaataaatgatagctttgacaatagtaaatgtcattctctgggatctggaaacagaatatagactgactgaatatcagagaagaccaagaatccccctagaattgttaggactgtcactagcaagtactaatttcaaagaagtctggaaatttacatcattcttagaaaagactgcactggcaaggagatcatacgtagtctttaaggattttgttattgttgttttttaagtcttttttcttgtgcagatccttgttcccaaataattgcttggctttaaattatctaattgttttcttaatcaactattcatatatattctgccaactgttcccagtatagctcatttatttatcctctttccaccatgtaagcagtcacaaagattggaaaaaagacttcttaagataacagtgtaacttactagttatttaactaatgtctgtcttccactctatgctttaagccccgcaagggtagaacaagtgtctgttacacttagtctgtatcctcacatccagaaaagtgcacttagcatgaagaagatggttggttggtagggaatacagcaactatagaattaaatcaaaacattttctgtctgtgcagatattttggtcatgtcttcaactgcaaatgtaggaatcgtcccccagttttcttcaatttaccactagtcatcatgctcacttgacattgcatctacaaataggcaaagggcaaatgtgtgcatatatgaggttgtatgttgtataaatccacttttagatgcagttgccagtaaatacgtatttttaaacacaaaatgtttcaaatttcccacgttaaatactctagtgctaaaataagtcagttctaatttgaagggcaaaagtccattctgtgccttacagacaaagtaaaaaacacatttggccattgacagaccaactcactttttaataacacttcacatcagaagacattagagtaatgtatttaagatgcataaggaaagtcaatgtgaaccaaagattttatatccattcagattgaaataaaggtcacagacaatgtgttatgaacatggaaaaactcaggttctatgaccatttttctactagaacacaagcttcaggcaatcaagaaatccaagtacaagcttgaataatacatctaatggcaagaattgaacaaatatggtcatagaaaaaagactaaatcctgtgtataaaagttatatactatataaataatattttttttgtacaaaaatagatataaaagcacacaatggtgaagggataagggatgagaatatgcaaaataaataagcatgctgactgcctcattgtattaaccagaagttaaagactaatattttcaatacaaagtatggagatacatgggaaagaagaatgtattaggcaatttattatagttcatagtagaatattcatatatatcctataaagtacaacttaaatatatacaataaaaataaacaaaacttcactacattaaaaaaataaattttcctaagtaattaaaataaaagagatgataaagagaagtttcttgcatgcgagcctaccctaaagatttcagctctttctttcctccaaatcatatgagtcagttcctaaagtaaatctgttttgttttttttttatatttcccctattggctctgtttctctggagaacactttctgataaacactacatgctatacattaaaatctctgttttcaactatataaattctaagtatgaagcattcttttttattattttttattttttcaagatgaggccttgctctgtcacttgggctggagtgcagtggcacaatcacagctcactgcagcctcaacttcctgggctcaagcaatcctcccacctcagcctcctgagtagctaggatgaccggcatgcaccactgtgcctggatattgaaatattcttgatgaaaagtgagctgaatagattaagtaatggtcaagagactagggagaaggacttgttaaaaatactttactctctgagacttaatattggtacatcagttgtctctggcctcttgtgttgggcagttcttaaagctagggagacctctatgttggagttttggtttgataatcagacaacaactgctatttgaactttattttgatctcagccttcagaagcctaaaaagttgaacacataatttagtgtcatttctggcattcctcgaattgtgcatgaccaaataatttgtggtctggtaagcttccattgtcatatctagtcagtataaaaatatgaaaaatacagctttagtcttaccatttgcacttatgttattacaggaatcttcacaacaaatagatttaaacattccagatataacggggaagtaaaaatctaaatactaaagatgttaacattacaaaagttgagataaaaatatatattacctttacaaaaataaaatgtataataatgaatggcttcttcaaagcgcgtttctgtataaaagcaattatttaaaatgttcacacaatcaaataaatagaaaaagataccagagacagtaaggctatcaaaagagattgcattaactaaatagcattaggaaaaattttaatcatatctcctataagccaacaagagattgtaaaattaatataaatcaaaataatggagatgaaattatatgttaatcctaatatgtgttttgtctactaacataatagccaatattatagctattaaaaattaatctttgtaaagtacattttacattaatttatttaaatccatttcatttcctaaggaacccacagttttttacttgaaaattttctcaagtgatagtgtaaacgaacaagtgaaggcaaaaaaaaaatacacacacacatactcgcataaaaacaaccacaggcacccacacacacaaagacaaaaatctgtacctgaatatagtgtgaaagcatcttttcaaataatgtgcagaagctttagttcttaggttgacttcaataaagttatataatatctttcaaataaaacttaaccaggaggtaagtttgcaccttatgtaatgatatttgaaaagagtaagaattacagcttaatgatttggtggtaacatcaccattgccaattccctctactgaaagaaatagttttaaaaaagaaggcttgctcttcttcccccactgacatcaactgaaagtaagagacccttgtagcaatgcaaatgtttcctataactacagtagcaatttaacatttttattatattttggaactaccaagaaattattgtttcatccttaaaatgaagtctaattagatttgaacggacaaatgtaaaaatacctttaagtgttacataaaaagtgttacataaaagaggctttgttgttcatacatttgtctagatttttaacatgaatcataaatatattaaggacatttttctaaaaatcatccctgctacactgtgccaaagtaacaatacaagcaagaatgatcacgctatgagtgaaattgtttaaaacagtcctacatggttgctaaattttatttatttttattttatttttgagacagggtatagttctgtcacccaggctggagtgcagtggcgtattcacagctcactgcaaccatgacatcctgggctcaattctcctacctcagcctcctgagtagctgggagcacaggcgcatgccacctcacctggctctttttttttttttttttttttttttttgagatggagtctcgctctgccatctaggatgacgtgcagtggcatgatcttggctcactgcaacctctgccttccgagttcaagggattatcctgtctcagcctcccaagcagctgggactacaggcgccaccacctcgcccagctaatttttgtagttttagtagagacagggtttcaccatgttgaccaggttgtctcgaattcttgacctaaagtgatcctcctgccttggcctcccaaagtgctaggattacaggcatgagccaccgtgcccagccccagctcatttttgtattttactttttgtagagatgtgatctcgctgtgttgcccagggtggtctccagctcctgagctcaaaggattcgcccgcctcggccttccaaagtgctgggattacaggagtaagccatggcacctgggctgcaaaattttaaaaggaatgaatacaaggaatttttatatattttataatcagtatcacttatatcagtcagagtttccagagaaacataaccaacggtagagggatgatagagacaaagacagagaaagatggagatagatgatagatacacacagatttattttaagaaatggacttttagaattgtgaggtctggcaagttggaaatccatagggcaggctagtgagctgaaaattcaagcaagatttttatgttaagacttgaagcagaagtcctttcctgggaagcctcacccttttctctttttttggggggtggggggggacagagacggagtttcgctctgtcacccaggctggagtgcagtggcgcgatctctgctcactgcaagcaccgccccctgggttcacaccattctcttgcctcagcctcccgagtagctgggactacaggcacccgccaccacaaccggctaatttttttttttttttttgtatttttagtagagaccgggtttcaccgtgttagccaagatggtctcgatctcctgacctcatgatccgcctgcctcagcctcccaaagtgctggattacaggcttacaggcgtgagccatagagcacagccacccttggctcttaaagccttcaattgattggatgaggccaatccacattatgaagggtaatctttccttaaaactttccttaaaagtttattgcatctacaaaatacactcacagcaacatctagacacacaaacaattgagcaccatatcctattcaagttggcacacagaatttaactgtcccaactacgtacattaattgctacaaatcatattcaaagaatggacataatttttgaaggtacagatattttgtaatgaccatgtgtttttgtgaaacttaatgtatctcagaaaacattttaaaacattactgttacatatattcttcttttggagattatagatgacttcaaatagaaaaaaagccttatttttaagtgtaataaaatattctttttaaaatatagctcagaacatagaaatctagatatattagaatatttatgcttatacctatagcctttcaatattcaagatggatatatatatattcaaggaaatatatttttcaaaattaatatgagatatgctgtaaacaactaccctattaacagataaaatgctaattttaatatacaagtcaaaaattgcttgtcaataaaggactgatgtgcagatatacaaatggatttttaaataattgtttcattgttttgtctgaagtcattactatgaggacaataagtaatagttaagtatgaaaatatgataaatagtagtacaagatatttttctaggttgcgataaaatgtggtctaaactaatcttgcaaccctatgctcattaccatgttctaactaatctctgttataaaagaagttggaaacaggccgtttgatgatataaaggaatttgtttaaaaagagatgtagctctgaaagaaacttcctctcttttacagagttcaggtcggttatttttccacttctctgtgtcatgaacgaccaattgtactttcctcctcaaaccaagcaagagctcagcaaaagaccccatcagagtaacaggaagcatttgtgggaaaggatagatcttactcctagatgaattctagtaaactgcagaaacttgtttactactatcaaggcagagcacacatgggttcttatagagtcaaatcatgtaaaaggaagttacccttgtcaataaggtgaaaagagaagctgcacttcaccagcaatcttgcaaaaagtgaagggggtagctgggctagtcccaacttaaaagcatccgtcataaaaagactgcttatcagggagcagagacccgtgaataataatgctacagggcagtagctgaaagtgtgtcattaaaagtgaccagagaatgaagttcccaggtgtatttcaagagcccaggggtggtgggggaggtttcatggagaaggagccggcaagtgttcaaagattctacagaaatgccctgagaagaaggaactagtgattgaactccttcaacagcaaaaggtattagatattcctccgttgctaagagaggaccacacacaacctctacaaagtataatggcttttgcctctttacctttaaacattatctccactccccatccccctggaggaaacagaagcaacctgataaatgggagacaggcaaaagggcaaggtgcggtgaagggacagatcatgcatttttcccactgtgaaaacagaacagcagccctgtttactaaaggggaaaaagctttgtattgaagaaaggtcagcatactttattataaagacagctgcatatgattgtggcatgcaaatagatatttcatggctataaaaattcatggtgacttcaactaaaccacgtatattatgactctgagctaatataatccaagtaatagtgtattttgaatagtttactaggtatattttattccagtggacactaaaatacttaaaaacagattatgctagccagtggctcaataagaaacatatttatgttttacactgacaataacttaatttcatcatccgtgggtagatgatagattttcttgtgacctattcatgaggaaacctgacatatttgaatacagtataaactttgataaaatttagatgtattgctttgtaagatttctataatttaaatatgaataactcatgttttcatcaaagaggatactgcaaaccaaataccaccgatgttactatattatttatagttgggcatttttcgtatcttcataaataccacataattatacaaatataaatggttaatatctactttcaatcagcaatgggtttatgtttaatatgagggcctcaatttagagactttttcttggggaaaaaagaaagtaacattatttattctactatatatcacctacattttttttaaatttatgtctgcaaacaaactttggactcaaatctggacactctcacttttaataagaagagttaagagtgcatactattgaaacaaccacaggaaatcaggcataaactagaacatgaacttaaatgtatgctcatcccagctatataatctaatctgttagaatttccttaatagtgtatgatttgtaatcagtttctcatattttattacaactgtgtatgtaatgtatattttgatgtcttgtaggattattaacaatatagtatttttcttgtcattgatttttgaccaaggtacacagaaaaagacatgtgcaaaatacatagttaaaacattgatatacaaataaaaataaagactagggaaaaaatttatggattatagtcaataatgtacctagaaatacctaaacggtattacaacatatggaaatattgataacattttcttacacttccctatctaatataaaatgtcattttactgtttcccttcttaatatttcccaaattccttctggctttattctcattatcatcaagttactctcttccctaatgacacaccaagtcactcaccatagcctaccaactaatttctcacctggaggtttctcctttctaattcatcctacacacttctcttagactaatgtctctaatatgtttaatcataccagtcattattttattcatcaacaatttattgactgctctgttttgtcctacatgaagtaaacttgatatctccttcacggaaacttaaagtctactagggagacatagtaaaaaaaaaattatccttataaaaataaaatcattagttctgataactgctatgaagaaattgaacagactgctatgggagaaaggggcctatttgagaaattggaaaagtttgttagaagaaccaacaattatgctgaaacttgaaggatagggaaggaacagccagtcaaggaagatctacagcatagattattgtgtagcttgttatggtggaaatgcccagtacacgtgaggaactcaagtctagctactatagattcctggatcatagtgtgaggggatcttgtgagctgtctggcaaggtggacaaggcttgatcatatgggatttgggaggcaatgttagaggctttttttttttcccctaagtgcattggacctttctgttctcctttgcaaatacctataaatattttgaagttaaacaaaatatagagatagatgtctaaacttaaaacattttattttggaagtaataattgcaatttggggcatacacacagactagattgtcttcagtatgtttaaagaacagtgagaaagctggaggtttaaataaaagcataaatgttatgcattgttttgaaaaatgttctttggcactagtaaagttttggggattggtgagtgaccacggtaggtaaaactagtcttagagcctcagcgggtcattttagtagttagttaccagataaaagtggtttcaggctacagtaggcggtttcagcagctaggcttggaaacaattacattcctggagcaatgttatgtgctgtgagtgtgttagctcctctcgattatgctttggttcagtaggacaagaataacccaatccatatgatcaacattcacaaatctataattatttcaaaataaaaaaataattttaaaaactgtatattagtttgcttccataacaaattatcacagattgggtggcttaaacagaaatgcatttgtttacagttctggaggttggaagtccaagatcaaggtttcataggtttggttttccctgaggcctctattctttgcttgcagatggccattttcttactgtgtccttagatgggctttgccatgcacacacgtacccttggcatctctgtgcgtccaaatattctcttcttataagaaccacctgtcagatggaattatggcctacccagtatctaaattcagtcacattctgagggattgaggttaaaggcttcgacatatgaatgacaggaggacaaaatttagtccataaccattatttgattgaaatcaaacatttattttgagtaaaaatagcaaaatattgttaagtattattcttctcattttctgatggaaaaatcttactagtaagcactcaaacagtatttaacaagagtgtaatattagcaaacattttacccagcctttacatgatgggcttactcatgagtaggtaaacaggaaaatctatagtctacccacagatgatgatattaagcttctgtcaatgtaagaaacataaatatgcttgatattgagctgctggctggcataatctgtttttagaaaaacaaagagggaaatgcagacagacaagctatcataaaaatcaatatgatggcagtggatttttaggttggagtaacaatttttattttcaccatattttcttgccttttttttcctaagttttctacaattaattattattttgtaattaaaatgtatcattacaataataaatcttgtaaaacacattaagaatacatattcttaattacttaatgttttcttactgtaacattttttactattttcttgcttttctataataaatagttattcactgaattattgcttgtgttaaattccaggagttgcactgcttggcaaagaatatgatgacacttcgggaggccaaggcaggtggatcacgaggtcaggaattcgagaccagcctgaccaacatggtgaaaccctgtctctgttaaaaatgcaaaaattagcccagcatggtggcgtatgcctgtaatcccagctactcaggaggctgaggaaagagaatcacttgaatccaggaggcagaagttgcagtgagctgagatcgcgccattgcactccagcctaggcaacagatcaaaactctgtctcaaaaaaaaaaaaaaaagaaaaaagaaaaagaagaatatgatgacacaatttatctattgattacaatcagaaaattgtctttcaaaagaattctatcagatcacattgaaaccagtattgcaacactacctggttttaccattactcaagaacataacatatattattaattggtttttgctaagttagtgaaattgccatcattttattttatttcatttcacttaatttcatttgtttgtacaaagggagcctgatttcgagtatattaggttttgttattgtttctctgatacaaattgttttttcaggtcagtttttatgctattattttttattttattagtgcaggggtgcaattgtggctcactgcagactcaaactccagggctcaaacgatcttcctatctcagccttccacgtagctgggactacaggcatgcaccaccatgcctggctacattttgtattttttgtagagatgaggtttcgccatgttgcccaggctggtcatgaactcctgagctcaagcacccagccagcctcagcctctcaaagttctgggattataggcatagaacctggccaatattatttttaaaaccaatatgggctctaaatataggtgttcagaatattttatagaaataaaaatgttgtaaaatgtaatcagtagcacccacaagtgaatactttcctataaggagcttagatatttctaatgccatattaaccaaataatttgttatatactagaatagagttttcttaatgtactaaagatttcacacttgttaatcctcattcccagctacacagtcattgtaagagtataatctataattgaaacaatcattaaaaacagtcacacaaaaatttgcatattatgaaagattctaattagatcagaattttatacttattttactgccttaccttgtttgcaaagtcttctttgtatattttgtataaaattatagatagaagcaaatatatatcatcctaaattttttattgttatacataaataatccaagaagtttagaatatacatataaggtgatgtaactgattttatgcacaaagagtggagtgagtcctaactctcattcgatcaccttgcccaccataaaattatcaatctacatatacaaactttaaaaataatcagatcttttatactacaattgtaaaatctcaaactaattctaaattaagttttatatttttaggactccagactaacaccaagcccaagggaatacatatttaatcttcatagcaaatacttcatttctgcaagaaagacaatgacattttcttcttttccttttctataaaatatataaaaacccaattacttttgttttttgttttctgggtgtttttttttttttttttgagacagagtctcactctgtcacccaggctgaagtgcagtgctgtgatttgtctcactgcatcctctgcctcctgggttcaagagattttcctgtctcagcctcctgagtaggtggaattacaggcatgcaccaccatgcctgtctaatttttataattttagtagagatagggtttcactatgttggccaggctgctctcgaacccccgacctgaggtgaaccgcctgcctcagcctcccaaagtgttgggattacagatgtgagctaatgcacgcagccaaaacccaattataaatatcagaaacagtatggaaaaaataatttgtctcagcgaggcttcattagatcttgaaatttaaactgccagctttcataaattaatagtggaaaggcaagattaattcaacagatatttctaaacaagtcagatatataggtctcgcatagtagaaaacatctgcagaatgggattgagatgaatttaaatgtgactttcaaatagaactacatttaaaagttctaaatttatttatttgctttcccatttaaaaaaaaaatatggtttttagtggtcttggaagctactaaattggttagctgaccatcaaatttttccagaaaaaaataataagtgcaatgggaaagggttatatttctagaattcctaaatgtgaaccaggaaatgaactcttaaggttgttcattttctttgctagccctgtctgatgtgtaagtactttaatctgtaatgaacatgggaaggtataattgtatatactcaaattgcagttcttgctaagcttctgtccagtgaactagaaattaaacttcagctatagtggtgtttagttattctttgagattacagtagttcagtttcagtaaaaagcaggttgaaagaagttcactggaaatgattgctaaatcctttgctagaataaagtacaatgcaattttggtcaaacatgtcctgaatctgttgttttcagtttagaatccaagcatccttgagaggggtcacccatgtacatgcagcatttacttggatggaaattacacatatactttgacagtaattactgatgcaaatcacacctaagcatgacataatgagcatgtcaaagtcaattaaaatatagagacaaatttctaaattgaaaatcttttatttggggagcaagagttctaattttcagcatacacacagaccagttggtcttcagtatgtctgaagaacaaagagaagttcgggagctttattagaaagagaaatgttacccatcgctttgaaagaaagctcattgacactagggaagattttgggagctggcaagctctgactggtaagtgacagtggtaggtaacagccatcttagagtcacgacaggccatttcaacagctgaacttgtggaaaattaaatttttggaacaggtgctatgtgccccaagagcttttcccctagcccctcatttctgtcttagtgggatatggcaagagtgactcaatttgaataattaactttcacaagtgccacaaacatgatgaggaaagaagaaatgcaaaggaataatatgcacagaagataatgaaggaggaattaaatttgagatggagtataatttctagaggttatgcaaccaaatttaaaaatattatatataaggatatggagtctcagagagagttgtagagtcagactctagtctaaatgttcagtcataaatccagagggaaatagtacatcagggaaaggttagggctagagagagaaatctgtgagtaaatcaaaagacaaaaaagtgctccaaggtagtcaacagagaaaagaagaattaggaagacacaaacctgaaaacaatttatactgaggtggatggagaaggaaaatcaggcaatataaagagaattttaaaataaccatgtttgtagatttctgcagatatttcccaggtcccttactttcaggtttgacttccatgagaatgttagaaaaattaaaattaatgaattaatttttaatgcactttctttgaaatgatcaaatcctaatcttcccaggttagcaatgtagggagaatgtaactgagaacaccctttattttccccaaatttctctttccctgaataatttttttgtgttgatcaattgttacagttatgttgtcttctatggaaaaaaaaaataagtttttgtccagaaggtgtcatactgtcttagctgagttaaagatgaatatttaaacaggactttaatttcactgtggcctccacaaggcaaggagagcaggagaaatttagataactctcaccatcaggcttctgggctctcctggcttctgactttccctttcatagaaatttccattttaatctttactacctgagggctctcaaacatttaaaaacaaatcctcatagtttgtgcctgagaaatcatgatcccacaaggcagttagacttttctctcaaatgccaaagctgaaatttgtatttcagttttgtgcttgagaaattctacaaaattgaccccaggaatatccatctcctcaagatatttccttaaatgtttaaaactttccccatgaaaagtaaaacggagtgcatttgtggttaataaaatataatagcccagttggataaaatgttatgttggataagtgttaatatgtaagaaatataaatgagcatgagttttagaaattaagggattgtttaatcttttattggaaagttaataaacagtacctatctctctgtatctatttctagctcaatttctatctgctcctgaatttggctcattcatgatcatgtcttcctttacagcatgatacccagaactactcagggcattccaactgttaagtagaggaaaagcatcatacaatgtaattcattcaccatatttatcatatgttttatgagagcttattatataataggcagtgttttaggctatacagatccaaaaacaaacatatgtcgatgttgaaaactaaataggtttaaaaatatatttcttttcaaaatttgagtgcttgaaatgcttccataataacacagcagatatttaacatcaaaattcataacatatggtatatttattcagcataatcacattaattacataggtagtagggtgacagaattcatcagtgacaaggccagagtactgaataatttgaatgagaatttaaaaattagatcattaacagtctgcctttatgcctgacaaggtattcacagcaattactaacaaaaggggataataacatatttagaatgggcagagtttaattgcacatagcgtatatagtagaaaactcttcttaaaaaatgggaaaagttaagattaataggaagtgcaggatttattcagttggattttgtcgttaaccaaagaaaaactgcaaagcccatcttgcgtgaaacattgctgttggttgttgacatttacaaaatgtggaatcatttcctgccctagaaagcttattgaatatcataaactttaacccataactgcagatgtgctccttatttctctttagcccctgcagatccaacttccattcttctttactcttttttgtgagacacaatctccaaagaccgtatcagcggcccgcttgcttctggcttgccattacactattggctaaaggaaaacacttaacaggagagggggagaggggcgaagaaagagggatgggatatttttttcccaggcattctcgctccttgagagaagaggaattagatgtgtttctcctgtggcagggcccttccttccacacttacagctatgctttttggattaattcaccactccctgggcttgccacttcacacctagagttggtaatagttccccaacagtccctagtcctaggtacctcatccttccttgtgactaaaggtgtgaatctcacacttttagaaacagcactttcctggtttgtttgcaataatccagcttaaatatgccatttcttctcagtcagacctccgattgaaaaatagtgtcctgcagtgactaggggtccgcactatatacacagagaaaatactggaggatgaaaaaaaattatgaattctaatttaatcctacagcttcttttcaactaacactctgcatttatttttctgtctgtccataaccattctggttctaagtgaacaattcaactttggaatgaaatgaaggatctattccctttccaccataaaatattgcaatgatcctttaccatattaacatttgctaaaaaggtagaagatctattgccatactagaatttccccagatgctggattttattcaaactgtattattttattacatagcccagcaacaaagaaatcatctcactagactcatatttcttttatatagaagtataattatcacttaatttacatgccatggcataattttacttctactaaactaaataaagaaccatattaacatctaaatataatcaaaatatagattattagaagtttttatttttaataactttactttcacttacatccaatactaataattttaaaaataaaagtgctattgtgcatctataaatatagaaaactaggttccatatatatattatatatatatatatatatacaattttttttttttttttgagacaggagtcttgctctgtcacccaggctggagtgcaatggcgcaatctcagctcactgcaacctccacctcccaggctcaagctattctcctgcctcagcctcccgagcagctgggattacaggcacccaccaccacgctcagctaactttgtgtgtgtggatatttttagtagagacggggttccaccatatgggccagggtggtctcgaactcctgacctcctgacccgcccacctcggcctcccaaaatgctgggactataggcgtgagccaccgttcccggccccatatataagtttttagaataacagaaatataaatgtatctggatgtcttaaggaatattttatttctgtctcttaataggtacattcttttaagatttacctatatattgattcaaacattagcatattataaattgtgatccataattagaaacatatagctcctaagctcaaacataaagtcttcatagactttcatacatgattgcatttaaaatttttaacataatataagccattttatttaattcaggtttgcctgcaaacaaattaggtcaagttaattgaggttaggtcatgttttctcttaagaatatttgtataataagctcataaactttctgcaatagtttctagtcccaaatcacaacttttctgttttcaagcataatctgatgtaaaagtctgtatgcatggtatatgtacttgttttctattattattaaattactatatttaatggcttaaaaaaaacacaaatgtttatgacctcacaatttctgtccctgaggaatttggaagtgtcctagtgggatggctctggctcagagtctctcatgaagttgaagtgcagatgatgaatttcatctgaaggtctgactagtgctgaaggattcatttctaagctgacagttccttcctggctattggtaggaggcctcagttcctaaccgtggacctatctgcagaataggacagctgtcttcattctgcagcttgctagagtaagtggtgaaagacatatagagagaaaagctgtgatgttggaagtgacataccatttcttctgccatagtccatggtcaaataggactaatgctgatatagtataaaagggactaatacaaaggtatgaatgccaggaggtggagatcattgggaccatcttggaggctggctagcagagtaagtaactttcaaatcagtgtatgttatcatttgacatcaagttatacaaatcccaataattctcaggtcaggagaaggtcaaaggaaaatgaagcatattcctatttaattttgtgatcctcgatgatgatgcaaacatgcccgcaatataatgaaaaacaacagataatgaaagtcagttatagtgctggtgctaccattgtgtcctgtgttatttcttgttagtctcaaaaaacatatttgcatctgtcatcatcattgtacagaaattgcacagattcaaatattaaataactctataagaacttcaacatttgaatttttataaaaattgtgtaatgaattacatacctcttagatatgaaagtttgacctaccttatttttccctgtgactctttacacaactgttgtttttattcatctagcttatttttaaaaacaagtctaattctgccagttaggaggttttgtgtatccaaggaaatgtcaagaaatgtagatttttgaacttaacactcttttcctcattatggcatttgttttattccatgaacatttaacaacatatttattgaccttcctattattacagtaactgacatattaacatagtcaatgaacttctttgtatagaccttggcaagcagttttaaataatagatttaagttgattaagcacaactaaataatattctctattgatatcaagaagtgggtttatttctgattcctgagagttactcttcttagaagttattttttattttctaaaataaatattgacttttaaatattgatatgtatgggttctcatttttttaaataactttgcatttccaataaggttgcttacagggtgaattatgcaataggcataattacagtgcctatcgttcaaatacggctttgcagacactggaaatttctgacagcagaggaggtatgggttctgatatatgtgtgaggtccaactttatagtccaagtatgtaggttcaagatatatatgggagttagactaataagtttttagcaatagtttccatattttatatagcaaggtaaggaagaaggaagaataaaagatcactcccacatttctaatttgaacatctcagtgaatactgttcactgagatggagaaaacagggtcagttcatttataaaaaattttttctcaaatattttatcttacagttcatagtggaatgtaaaattaatataattttattttctagaactagttaactacatatttgggcaaattggtccaaatttctatgtgagtaatacatacattttctttaaaatatgcaacttggctgggcttggtggcttacatctattatcccaacactttgggattaagagatcagaacatcacttgagcacaggagtttgaaaccagcctgggcaacatcgtgagaccccaactccacacaaaaaaaatgaaaaaatagccaggtgtggtggtgcatgcctatagttccagctacttgggaggctgaaacaggaggatcacctgagcccaagaggtcaaggctgcagggggcaatagtcacatcactgtactccagacttagcaccattgcgagaccctgtctcaaaatattgaaataaaataaataaaataaaataaaataaaaaaacaactctacaactctgttggacatgcctctaaatgttaaatggaggttggataaaatgggaatcatcctctatttaattgtttggattcttagaaagaaaaatggttcttcctcttggagccaaacaaaaataggcaagtcctattgatatttaatatttttaggaagttaatatcctacattaaaggcagtaataaaaggtttaatgaaactttcatgcggataataaatacaaaattacatgtgtgttccattcatggcaaaccttaagcatgtgaacatttctgctctcaatactccaatgtagccatgaaaaataaagatacatcttcagtaatttttcagtatttaaaaatctatgtgtttgtgaatgtctttgtttcttaatgttagaaagtagaggccaggtattttagctcaagcctataatcctagtactttgggaggccaaggcaggaggattgcttgagcccaggagttcaagagccacacagaacaacatagagagaccccatctctacaaaatatttttttaaaaaattagtctggcatagtgatgcacatctgtggtcccagttacttgggagactgaggaaggaggattgcttgaggctgtggcgagctgtgatcacactgctgtgctccagactgggtgacagagcaagaccctccccctgacacacagtaaaaaataaagtaagaaaataggcaatatgaaacaaaatttgaaaatatgataaatgaatgttatctttataaattcgcagtgtgtagatgcttataaagtccttatctcatttgtgttaaaaacaagataatctatattatctacctccttttaaattgtgttttgttttcagacaaagttgtgttttgctttgaggcaactagaccatctatcttgtgttcattcacaataaggaacatcttctattagataaaggagaaatggttagattgtaatgtagtttcaaacctgatcatacattagagacacatgaaagaatatttcatttacttacatgttaaatatttccatttgtagataataaagttcctactcatctttaataaaaacacagggagtttggaaggcccaaaacaaacctataaatagtatttatcttaagtaactctttttaaagctctactccatccacagggaagacttagagaatactagattaggaccaaaattttgggaacagtacagcactatcagtgtgtgaacaataccatcatctgtctcagttatcaaattaagacgtcattcatgcttgtcttaagtcatgttcactagaagtagagtttgggacaggaattcttatgtgaataatttattgggggaacgtaagggataaaatagtgcaggataagaaaagcgaaagacgagaatgtggtctcagacaaagcttggccttggcctgatacataaacataaacctgctcccaatatttctatgttaagaaaaggagccagccttttatctttttttttcttcgttttttttttttgttttttagtctttctggagtgaggtatctcagccaagggcaattctctaaagacagctgttggtaagcaaaacatacagcaggttccagtggatgtgctgccttggatcatagaaatagtttctgtaataccctctcttcctttacatgaaatcaaggaaaattctatccattatttcttataaatatttcttgatctgatcttatcattctttttctcagtgccctaccttagtttaggttctatcttagaccactgcagcagcctcctaaatcatctctgaacctccacattgcagtcaattattttcatagagcacagactattattttctccttaaaatcccattacctaaataattttatttttttaaactgacttgtcctaatccccaccccatatatattatttaaggttgagaaacatttatccaagataaagttttctgccaacggtctctcccctctctttcattttgttgacagaaagtagttagtgtgctttccatctctaaattgcagagctttgcacagcattcaataatacttattgaggacaattaattacagacatttaatgagaaaaggatgaattctgatgccattgatatctgggctcaagtcttactttgggcaaattaagaactctgctttgcctcagattcctcacttgtaaggtaaggacattttcatgaaaatatttttgagataattatgtaatatacattaggagaaattactgatataagcaatagataaattttgtttctaccttcctagaggtgtcctgtatagtgctggtcacataatgtgggttcaacaaatatcagggctttggtccagccaattcaaagtttcattggttttctttgtattttctttcagaattaattcccttcattctatgattatatataaacatcattttgtatacttttgctaacatgaaaattatgaaattattttgaaaatattaagaaaagattgtcattctgtattaattaataaaaaatgtattttctctaacattctttggattacacattatttgcatatcaatacttctgaggaaagagactcaaaaagtagaaaaaagaatttcctttcaaaaaaggtatttaggtaatggtgtgctggagctgactcgcacaagtgcttcagatacaactgtgtatatctcttttcaattgtgtgtagtgtcaccatgttgatggtttgaagtcagccacagtatttataccgtgtaaactacagaaatttttaaatgctgcaaaacacagcttcattccccagcacaacagtgccagttttaaagcacttcccagtacagcactatatttaatccaggagttcaattatcttctcatcgatggcagacaaaggcaaaaggacaaattaacagaattgtatatgcagataatcattgaaaactatgcacactgttttcaaatctccagtatttaaagacaaattaacaatctgtggaggagaatacaaaaatctcacttattctttgcttaatatcaatttctataatattttctatcaaatcggggcaggaaggggctggagaagatggaaagaacacatagagtagtttgcatgtggggacacacagaaaagcacaaaaggctttataaaacaaggaccatgtaattctgtaagtagatgtaatgtggctcttccttaattccacacactagagttaccggcctacccagtgcctccttattatgcagttgtatccttaattaacacactataaacacaagctttttaattcacagttttacttcttgctatttgctttctttaaacctgtatttctggctattatatatcttgaatatcttaatcgtaaagaactagtaaactttttcgagttgcttctcttttagcaagagtaaacattaactgccttagaagtctattccttgtcagacttcgtattatctgaactgctacaaagttttctcaagtagactcttccttccatggttaggagatgtggaacattcgcactggccacattgccaagatttccatattctataataatgtctctgctacaattctgtgctaggcaatatatgaaaaacttcaaaggaaacagaaaaatagagaaaactttgtaaaagaattgatttattcatgtaaaactaactgagtggctttaaaagatttacaaatgatgggaaattaattattttacaaaatagcttttccatatattatggttcaaaacacagcttgtcacaaggagtctactggtcatcaactttttaaaatgactactatttctactattttctattcaaattttagtttttccaagcatatattatggtttttttaaattaacatttcagtaatcatcaacaagaattttcccaaaatctcaatattgatagtgataaagacaagaaagtagaatgtgttaggaaaaatcattgatattaacgaaataaatactagacaattatagacaatctccttggtataaggagattgcttataccagaatctgaagcaaaatgatgtgttgttcatttgccatgaagaatcaatatttcctcttgcctgcctttatcaccctctgtgatctatgacttagcactgctttcagaacactgaaaaatacatacactgtagacactcaatttactttttcaaattcagtcttggatgaagtagagagatggtttccgaaattcagttatacagcacacttcagaatgggtaactacatcattccaatggaaacaattgcttttcttttctcttttttttttttctttttgatttccaacttttattttaagttcagggctatatgggaaggatgtgcaggtttgttacacaggtagatgtgtgctatggtggcttgctgtacagatcatcccatcacttaggtattaagcccagtacccattagctattcttcctgatgctctccctcctcccaccaccaccctctgacaagccccagtatgtgttgttaactaccatgtgtccatgtgttctcatcattcagctccgacttaaaagtaagaacatgcagtatttggttttctgtttctgcattggtttcctgaggttaatcactaccagctccatccatgtccctgcaatggacacaatctcattcctttttatggctgcatagtatttcatggtgtgtatgtaccacattttcttcatccagtctatcattgatggacatttagattgattccatgaagctcttccaaaagagaaggatatcctccctaactcattctatgaggccagcatcatcctgataacaaaacctggcagaaatacaacagataaagaaaacttcagaacaatattcttgttgaacaccaatgcacaaactcttgacaaaataatgccaaaccaaatccagcagcacatcaaacagcttatgcaccatgatcaagtaggcttcatccccgggatgcaagtttggttcaacatatacaattcaataaatatgattcatcacataaccagaactaaagacaaaaaccacatgattatctcaatagatgcagaaaaggcctttgataaaattcaataccccttcatgttaaaaattctcaataaactagatattgaaggaacatacttcaaaataataagatccatatatgacaaacccacagccaatatcatactgaatgggcaaaagctggaagcattccctattgaaaactgacacaagacaaggatgctctctctcaccactcttcttccacatagtattgaaagtcctggccagggcaatcaggcaagaaaaagaaataaaggtattcaaataggaagagagggaatcaaactatctttgtttgcagatgatgtaattctatctctagaaaaccccattgtctctgtccaaaagcttcttaagctgaaaagcaacttcagcagagtttcaggatacaaaatcagtgtgcaaaaattgctagcattcctatacaccaacaacaggcaagccaagagccaaatcgtgaatgaactctcattctttttttttttatttatactttaagttttagggtacatgagcacaatgtgcaggttagttacatatgtatacatgtgccatgttggtgtgctgcacccactaactcgtcatctagcattaggtatatctcccaatgctatccttccccccgccccccaccccacaacagtccccagagtgtgatcttccccttcctgtgtccatgtgatctcattgttcaattcccacctatgagtgagaatatgcggtgtttggttttttgttcttgcaatagtttactgagaatgatgatttccagcttcatccatgtccctacaaaggacatgaaatcatcattttttatggatgcatagtattccatggtgtatatgtgccacattttcttaatccagtctatcattgttggacagttgggttggttccaagtctttgctattgtgaatagtgccgcaataaacatacgtgtgcatgtgtctttatagcagcatgatttatagtcctttgggtatatacccagtaatgggatggctgggtcaaattgtatttctagttctagatccctgaggaatcaccacactgacttccacaatggttgaagtagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcaagctgataaacaacttcagcaaagtctcaggatacaaaatcaatatacaaaaatcacaagcattcttatataccaataacagacagagagccaaatcatgagtgaactcccattcacaattgcttcaaagagaataaaatacctaggaatccaccttacaagggacatgaaggacctcttcaaggagaacgacaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgagttcaaactatactacaaggctacagtaaccaaaacagcatggtactggtaccaaaacagaaatatagatcaatggaacagaacagtgccctcagaaataactctcattcttaattgcttttctaaactctataaatggaactagtaagttaaggtgtaaacaaggggcctcccttgccaggcagccaactgaaggtgcatgaaaccagatcttcaactaatcacaactggataagacaaactacaaaaggaaatgagaaaaaatctcaggaaagcaaatggatatgttaaggatgatatgctatttcaataaacttttcaatctgttattacagtccctctgcaagcacgaagaaaggaaaataatgatgtgctgaaatattctaattcttttcctgcaatcaatgtagcagacctagtataaatacccccaattttttttttgaaatttcaaatcaaactcctttaaaaatattctgtaatttaggaaatcctctggatttattccagttaagataaagaatacctccactgttttggtatcctagtgtttctctcctcttatttcttccaatacagttcaattctgaaatcctctggggaatctacgcttcttcaacctcaatcttttttgagacaatatataaatctcattcttaatattttcatctttaccagagtggtgatttgatatgcttgtttgtgtgtgtctttttttaaattctaaatgaattgggcaaaaaatattctaaatacagttttcattaatgatgtcatacaatatagtacatttggggcacattttctggcaactgaatgtaataatatggggatattttagtgtttttgtctctaaatgagttagataaactatataacacctaaacacactggtgttaggttatatactggtctgtatataccactacaataaaataaaatatttactgaagcatttttttcctcctggcatgtaaaaaaacttgtaactactttctaaacaaacctttctacacatcatttactttcttagatgcaaagttggcatcattattaaacatgtgaacagtggagcaatatgttctgaattacttacatatctgttagaagctggagtcttttccctcatcatttatagtagctgtacatacagagtaaccagcaatcttgggcaagcagtcagaacagtcagaacaaacgggctcgatccttcctccaatggcttcatgcaatgtatttctttctttcttaagaaattccctataaaacatcacattcatgaagtatagaaacatttcatgggaggccgagatgggtggatcacgaggtcaggatatcaagactatcctggctaacacggtgaaactccatctctactcaaaatacaaaaaattagccgggcatggtggcgggcgcctgtagtcccagctactcaggaggctgaggcagggtgaattcaggaggcggagcttgcagtgagccgagatcgcgtcactgcactccagcctgggcgacagagcgagactctgtctcaaaaaaaaataaaagaaacatttgaaaatttctaattgagcattaggaaattatctgtctttaaaaaaaaagaagagacaaacagatttacataggcactgttttgaggatttttatatagaaaactccaaggctagtctgctgatattttttaaaagattaaaaacacaaaaactgtacattcttgataaaataggattaattcaaaaaataaaaaagtcctcttctttttagaaagtgatgttttatttgattttaaatttgtctaatcattgataaaataactgatatattcaactgtctcatttgatatgaggacataattagttcagacaagcaatctgtgaaaacaaatgcccagaatggccagaataatcagggttctagatttagtaaatgctccacggcatattgcatataagccattataataagaatataagtgaaaatttaattgataatagttacgagccagcagtagaaggtgatgggggattttatgtaataagaacctttagaaagataactttaatattttatgaatatatacatagacaatatgtactttaaacaaattttagataataaaatttttctcaaggtactttataaggaatttaaaagtttttaagctcttagaaatattaggaatgtgatgaggaagagagctatacattccaagattaattcaaattatgccacattttgcaacagacataaaaagaaaaattcaagtgttaacaatcatccagctaaaataagaatgtcaagccaaagtctttatgtccttacataatagaattttttatttgggtaatctggatgattaaataatgttatgatactttattttcttaacatatgtaagagaataacttataaaaatgtttacaaaatacatacctatttgattactgaaaattacaagaacacaatgcactttagaaaggatgttattaaaacataaaacagcttttataaaaaagacaatgacaattatagtataataaatatcatatcctgttcactctctattatgttgtgggtggcagagaggtggctggcatcacacttttctgtacctttatgtttataatttcagtaagctacatgagctgaaatatttaatgcttgaattatttgcacactataaaatggttttcatttgcaatcagttttgaatattagatttttaataaggaactgctgggtagaactacactaattacatcttatttatgtctgctgaagttaaaaatagcttcatcttcataaaattgtaccatttgtctggtgttctgttctggcatgtttgtgtattttttaaacactttttttatattattcctgctgatattcaaatagtgctattatcttagcttagcttcgcccttcttttgctatctaccaatttatcatgtttattttgcccaaaaaaagtctctatattgctatcgtatttttcagacaaagctacaatttctttcatagaagtttagaactatgaattgggactaaatgtagctactgaaaaataataatatgtaaggggtaaaatgtctagtttgcacgttgttaaaagagctacaaatattttggggttgctaaggaataaatacaggaaaatcttgaaaaaacattaacatgtggtagaaaaagtagtgaagaatcaaatagacaataatcagaaataaatttcagatctatttctatgattgggagctaaaatattgtcctttcttttgttaacaaaaaggcataaatgccaagcaatagttggaccagcaagataaagaaaatggaggatgaacatacgctggtactgtaactatggagacagaatttcttccctttgaaatccaaagcatgtacacaaaagtaaggcctctcacatgtcattaaaatttttattttacatttattccttaatcaatagaaaaaaatgtacattacaagataaatttgaggattaaaaagtaactggctgggtacggtggctcacacctgtaatctcaggactttggaagtccaaggagggcagattacttgaggtcaggtgttggagactagctggccaacatagtggaaccccgttgctacttaaaatacaaaaattagccaggggtggtggcatgagcctgctatcccagctgcttgggaggctgaggcaagaaaatcgcttgaaccagggaggcggaggttgcattgagcaactgcactccggcttgggcggcagagcaagactccgtctcaaaaaaaaagtaatttaagtaaatattagttcgaaaattataaaagcatgtgtaaataaatttctaaatatttggcgttttctatacattgaaatcaatttttcaaggatttttgaatgaatggaaatactcactttgaatctttggtatgtttactaatctactatcccttgctctgaagtttgattttctgcttgttaccttaatttctttttttttctgctttttaacactacaaatgtaatatactttacgtataagaaaaagttgaggccaggcgtggtggctcgtggctgtaatcccaacactttgggagtctgaagtgggtggattacttgagctcagacaagtctgggaaacatagtaaaaccctgtctctaccaaaagtataaaaattttttgggcatagtggtgaacacttgtaatcccagccactggggaggctgaggcctgagaatcacttgagcccaagaggtggaggttgctgtgagccaagcactccagactggatgacagagtgagactctatctcaaagagaaagaaagagagagaaagaaagacagagagagagagaaagaaagaaagaaagagaaagaaagaaagattgaagtaacacatttttgtgtaatatagtcagtttccactttctttttcttttttctttttggtttgtttgtttttttgagacggagtctcgctctgttgcccaggctggagtgcagtggcaggatctcggctcactgcaagctccgcttcccagcttcacgccattctcctgcctcagcctccagagtagctgggactacaggcgcccgccacaacacccggctaatttttgaattttcagtagagacaggatttcaccatgttagccaggatggtctcgatctcctgacctcgtgatcctcccgcctcggcctcccaaagcactgggattacaggcgtgagccaccgcgcccgaccctcttttttttttttttttttttttttttttttttgagatggagtctcgctctgtcgcccaggctggagcgcagtggcgtgatctctgctggctgcaagctccgcctcccaggttcacgccattctgtctcagccgccctagtagctgggactacaggtgcctgccaccacgtccagctaattttttttgtatttttagtagagacggggtttcaccgtgttagccaggatggtctcgatctcctgacctcgtgatcctcccacctcggcctcccaaagtgctgggattacaggcctgagccaccgcacccggcctgtactaaaagtctactaatgttaattaaaccttataaacaaaaacacaacaaaaataaaaactttgctcttcaatgatttcatcttatttttaaaacataataaaattggattgaacaattgttatacattcagactagttgcttaatttggtagctttaatttgaaaatatatgcaaaattcaataggacccaggtaaaatggaacatttatataaactgacaagcctttacatttagtaattctaattattttattttattgtaaaatataaacggacaagtactagctcaagttgtaacactgctttaaatgttgcttttgaactttggcttccagaaaagatgagtaacatggacctaatttttccttcttcccgaatcaactatgaaatttaacaatatatatgaaataacagtttcaagacactggacatcgggcaggcattaatccctgagagatggggcacaaatgtactggactatatgatatccgtaaattatgggctagagtgagtttccaggctgcaactcttcgaaaagaggaatgcaggtaaagcctggtggcctccctgaattgagaaggcagagctggaaaattagggagatcaaagcagctatacttcacccagtggagtacaagtgcagagaaagtggcaaagacctacataaagcacccctaggttcttcagctgacttcagctgactactgatgaacagataagtgcaaggaaaacacctaaggccagggaaagaaccatcaggaaacagactcatgaatgatggagttaagaaaacagggacactaaatagttattacaactacattccatatattcaaggaggtagagcaaagagtgaacatgttaaatagacacaagaaagatataaagatacatatgaaacttaaagagatgaaaaatacaattgagatataaaatagacttaatgggattaacaacagattagaactggaaaagagtagtaaacttgaagaaatagccatagaaattagaaaaagaacatctgaattaaaaataaacagaacttaagtgatctgtggaaaaacttgaactggcttagtatatagtatatatgtagttgaaatttcagaaaaaaaagagagagtggtcagaaaaattaatggccacattttccagatttaatgacaactacaaacctgcagatgaacaaaacccaatgaactacaagcataagaaacatgagcaaaattacaccaaaggtgatcataatctggataataaaaaccagagataaaaataaactcttaaagccaatcagaagaaaaaggagatatgatatacaaaggacgaaatataagaaagacttattctctgaaaaactgcaaatcagaaaacaatggagtaagtaccttaaagtaatgaaagagaaaaaatgtcaatctggaattttatatctggctaaaatatttgtaagcaaggaagttgaaataaagacattcttatacataaaaagttgtatgtattcatctacagcagacatgcacaacaaaatattctaaaggaagttttccaagttgaaaaaatgatatctgaataaaaatatggactgacataaaggaatgaagacagaaggaaatgtaaatataacataataatataaatatataaataatataaatattatgtaaatataacatccatttttctatatctctttaaaacataaatgactctttaaaacaagataataatacaatgttgtgtgtttcatatcacgtagaaaataaaaacgtgataacaatagaactggtaatggaaaactgaagtgtgtgattaaagtttattttactagacatgaagtgatccaatattagcttaaggttgactttggtaagttactggtgtatactataaacatcacagtatagccctaagctgctaaaaaataaagttaataaaaattagagctaacaaggcaacaaaagacataaaatggagtcataaaacatacccaattcatccaaaagaaggcagaaacatgaagacagagaatagaatgatagaaaacagaggctggaagggtgtgtgggtgggggaaggggatgaagagaggttagttaatgggtacaaacacacagttagatagcacagaagggtaattatgactaacaatgtattatgtatttcaaaacagctagtagatagaacgttcccaatatgtggaaatgacaaatactgaagctaatggatactctaaatgccatgacatgatgattacacattctatgcatgtaacaaaatatcacatgtatcccataagtatgtacaaatattatgtttcaataaaacaattaaaacaaaaaagtgcatgtattcaaatcatggtagatggggaggtttcttactttctcagtatgaaaacctgggcaagttacttaagctctcattgtttaaacgtatttgctaaataagaataattataataatgcctccctcataagcttgttgaatagaataattaggtatcatttctggaacataataatagctcaatgcttgttagctgttattgatacaggataggggcaggaagtgctaggtagagcaggtgaggtccctggcaagggctccaatcctctcttgggcctgtgcccacatacctaagtgagaacaggcactcctgttttcacgcacaaatgttgcattttccaagaccacttgggcccaccatgccccctatcctgtgcccataaaaacccgagcccctagcggacacacacacaagcagctagacattaagaggagcagaggagcagaagagcccactgacaggcaccagcagatgcctgcaggccatccatggcaggaggacatggaatgtggtcgggggcagtcaaccgctgggcggcccaatgccaggggaagaacatctccatgctacatcctctttctggcctcctcatccacctcactgggagctacctcctctaaataaaaccttgcacccatcttccaagcccaaatgtgatccgatttttcctgcacagtagggcaagaatctgggatacagaaagtcgtttgttcttgtgataaggcagagggtctaattgagctgattaacacaagcctcctgcagatgacaaagctgaaagagcacactgtaacacacgcccgctggggctttgggagctgtaaacactcaactctagatgctgctgtggagttggaacacaaaaacgctccccatgacctgccagtctgcatgctccccttgggggtttgagcagagcaccaaagtaacaagccacacccctgtcaagcacaccctgagagggggataagggaacttaattctgtttcattattattacctaacttaagatcatcagtgttatctatttttattatgtaaacattaatatgtagcattcataagaaataatccagaaaaacaggaaaacaaaaacaataatcaatgttctcatgtaaaaaaaggtacaaacaaagtgaaatttattgattcaacagatatttgagtaactgccatgtaccggacacttactttctaccaatgaaggaatgaaagacaaaaaacaaataaggaatgattattgtatgttagaaatgacaagggtgagctatgtcagaatataaattagaaaaggggtctgatgtggaatttcatgtaagcttgtaaagaaaacttttttgagagggtgactttagataaaaacctaaggaagtaaaggagctaatcatgtgaacatgtgtaaaaagcagattctaggaagagagaatggcaactggaagggtccttagttaggaacatgctagtttgttctagaaacagcaaggacaatcagtttttttcttttattttttttattatgtttaataagcccttaatggccaggagatgggactaatatgagacaaatctggatggctctaagctttgttttctcatagtgtgcttttggttttatgtccagcttgctggctctggtcatggcctccctgctggaacactggctgtggagcacatagaacatctgtgtgcagtctgtcttccaatgacagaaatttgaaggacaacaagcactccatttgtaagcaccaccccccacctcccacatcaacacacacataacataaactatattatatacgcactgcgtggtgcgctcatctgatacatgctaaatcactggactatcagatatctcatgcaccacatgtaccactaaaggtgttatgtccatgacctctttcacaaatagtggtggaagcaaaggaagggttgatagcattttccaagtcctgttttgagttggctggccaacattatcagttacccaaactatcaataacagatacttaaaccttctgttcatagttggggctttctttacaatcccttcattctgcaattcacatgaaccttacgtatgtccacttagccaggagatgtttactagccatgccccctcctgaaataagttggaccccctaaaggcagtgcagctcttaagagacctttttatgcaccattaagaggaacaggatcaatattcctacaccatttttttatcctcttctccctacatgtgtctagcttatcacaaactaaagacttcttgtgactttgtgtatttattcattcaggtatatttattgagcatctactatgagctaggcatggttccagtttctgggaatagaacaatgacaaatcagacaaaactccaactccttgaagcttacaggctagagaagaaggtaatcaacaagataaataaataaatgtaaataaatgaacatatgctaaatagtattaagttttatgattaaaaacatgcagcagggaagtaagacacagaagaaagagaagttgaaattacatatatggtatttgaagtaagtgagggatatctgaggagaaactattccagaaaaaaggaatggcaagtggaaatgaatgttcctaaaatgattaataaaagagctaagagagatgaagtagggggataaggaggcaggtggtaagaaatgaatgcagtgaggtaataaggattttgggctaactttacttaagtctgtttttaccgcgaatgagatggaaagccattagagagtttttagaataaaagctacatgggtgttttgaggccgggcgaggtggctcacgcctgtaatcccagcattttgggaggccaaggcgggcagatcacgaggtcgggagatcgagaccaccctggctaacacggtgaaacccggtctctactaaaaataccaaaaaaaaaaaaaaaaaaaaaaaaattagctgggcgcggtggtgggagactgcagcaggagaatggcgtgaacccaggaggcggagcttgcatggctaacacggtgaaacccagtctctactaaaaatagaaaaatacaaaaaaaaaaaaatagccgggcgttgtggcgggcgcctgtagtcccagcactttgggaggccgagacgggaggatcacgaggtcaggagaccgaggtcatcttggctaacacggtgaaaccccgtctctactaaaaatacaaaaaatcagccgggcgtggtggcgggctcctgtagtcccagctactcgggaggctgagacaggagaatggcgtgaacctgggaggcggagcttgcagtgagccgagatcgcgccactgcactccagcctgggcgacagtgcaagactctgtgtcaaaaaaaataataataataattgctacatgggtgttttgatagaaccactatggattctgtgctgagaatggcaatgactgttttggggagggaaagcagaggatgggagagcataatcaggaaaaacagtaatgaggctattgtaattactcaggttagagaagatgaaccagggtgttagaagtggagtggagaaaaaatagtcaaattctgagtttcttttgaagataaaaactaatataatctactaatggactggtgtcaaagatcaccccaacgtttttcccccaagcaactctgagaatggaattgtccttaattgaaacagagaaatttcaggagaagctggtgggtagtgtggttaatgggaggtcctttttggacatattagtattgcaaatagtttatcaaagacgtcaaggagagcagcagattgtacagtggagctgtcaccagcccatcaaatgcatagctagaacctgagcttcctccaataaaagaataaaggtagcaggaataaaaataatcttaaaaacctaaagtgttattttttgaagtaatcttaaagatctaaagtttttaaaagaatattacaatttctaagtgttgaagatatacaccatttatgcaacgttacataactaggcttaacctctatattacatctgcatacaatgtgaacataatataacttagctatttcaaatttataaatattttatatggagacttattacaatgaaatgtgccaatatgtagaaattaaactagttatatttcaacagaatgtaggaaaaatatttttaaaagatacctattacagttgacatttgagcaacatgggtttgaactatgcaggtccatttacctgtggatttttttttctaagttacatcaagtatgcctgcctttcctgttcccctttcacctcctccacctcttctgcctctctcacccctgcacaagactaacgcctcctcttcctccttcttcttggcctcctgaatatgaagaggacaagaatgaagacccttacaatgacccacttttacttaatgaatagtaaatatattttctctttcttatgattttcctaataacattttcttttctctagcttactttattgtaagaatgtagtatataatacatgtaacaccaggaatatttgttaataggctgtttatgttatcagagaggcttctggtcaatagtaggctattagtagttaagttttgggggagtcaaatgttatacagatttttgactgcacaaggagtcagcttccctaacccttgcattgttcaagcattaactgtagttttatatcaacatgtcccaggtaactaccttagagtgataaattccaaaaatatggaatgttgaaaggttattgtattaaataaaatttatgtagaaaaatgcatgcttctctgatagctttcgtatattgtaataaatataaaagcattttaagcataaagcaaatatgaaattcttagataaacattattacaagtacttaaaggaagattatattgaattactctttaggtttacatatggtttaggagatactgtgttcttacatgagaataaactgccaagactttgttataaaactaaaggcaaaaataataatagttaaaaagaaaagaaaaccacagctacttcaactgattaggaccagacttcaaaatcccttggagtaaatccttagatgctttgatttgataatttcaagaatatacaattgttaaaatcaacaaccctaatgaccaaaaacaaatagtgataaagtttgaatcagttattcttttttaaattcaaaaggtaaactaaatttatgaacagaaaagttatttctgaagccatatattgttaaataatgtattctgataaagtttgaaataaggcattatatttcgtctcagtctccttctttaaattaattgagcgaattgtactaataacaaatctatcatcacttcattaaaatctactgcagtttttgacaggccattctattcccatgtttttaattaactttgatgtaacttgttgatttagaaaggtttattccccctaatcacctctggtattctaattcatgacaggaccacccacaaaggtttctgttcaacgggattgtaaaaagtttttttaaaaaataggaacaagaaaaggtcatttgccttattaattttcatctttgatagcagtttctaagcatagatgttatttaaacatcactgaaattatctaacaccttagccatttgggatttttttttcaaatcactgccaagttccacaagaaatatactttagtctttctagaatgaaattggaaggggtttgcttttcatgagtcttccataattttacaacatgacttttgtcccttctttgatttatcagtggaatttctgacctaatgaaatttgttttctttttttttcatataccttcttccctgtggcatccatacttcaaaacgacaagcagtttggaaacttgctttcacctttgggccataataatataaaacagctaaaacctatttttcaatctaccttacagttaaatctaacagcctttgtaacggtcagttaccctcatgggtgagcaaagctaatgcgcatggaggtcagcaacagttctgtgatggattttgttttactatggtttcttaggcctcaaatatgcttgttcttataagattcctggaataggcttgtaaattaatttctagccatgggaaacctccgttactttatattaaatctcatcatcttcctaaaagaaaatacctagagtaagttttctacattattaaatgttttgttaaggtccattattatttccattgagaaaacatcttttatattaaaccgcacctgtgtcaaattgttccttaaacagtttggcaggccctatgaatgggaagagaataacaagttgttggatacttaaactgttgaaatagctacccagatatgcaattaattgctgaatgacatccctgtaaataataaataataatgttaaaatctcatcctaatcataaatgggtttataaatgcaaatgagaatgtttagatgaagtttttttaatccctaagaagaatataccagttaatcagctgcatctttatgctcttgactgaaaacacggattttcagttctctttagattcagggccatgtttccagctgcttatgtcgcaggacccaaataaattttggtccttaagatttgcttatgaatacaaatttacattataagtttgtttaggtccactacctaatttaatttagggctaaaacccataatttcctaaaaggtttttaaagatattcaatatttcaaaatgtttctgagatagagaaaatagattttggattccaaaaatatttttatttgtaggcttccaatattcatatagaattcacattcagctgtcattattaaaattaaaacttactgatagtggataatatttttatcttatttgaattcttatgcatttcaaaaatattttaaattttttacagagaaacaaaactatatgaacaaaggagatttaaagtcaaatgaattcagggagaagaaagagaaaacatttctcatattttttaacagcaagcgctaattttgtcacaaaatactttgtatacttatataagacatggatatgttaaacaattaaaattagattctagcaaatcacctatgtatgcaaccttgtaaatagttttattactgaccctcacataacctggaaacttgtaaagatgtataatacgaactagtaataatgtttagcatgagttagatttaacacaaaatactttttttaaatactaactgcttaattcaaatttgcttattctaaagttaatgcagtattgggcagaacatctaaatctgttttatgtagcaataaaaggaaacactgtaccattttacaaaagtcaaacatcagatgatgacccatattaaaaggccaatcactttataagccataaaatgaatacaattgattattgatgatgatttcattcctttttgaaaatagactcaagtttattaccctatgttaatatgccagggtaaagcaggcttaggtaattacactgtgagtattttatctctgaattattaaacttgtttctgcctccctacacattaatgttagagggtaatagcaatgttctattttatccagtgctttacttcacttaatgcaatgatgcatggttttcattaaagcatgaagcaaaggaattgcaaaaagaaaaaaaaagttaacatctaaattcaggtctaaataaccttacaaaaaagaattcaatggtggtaacaatctctgtcatgtttaggtaggtatataatgcagttgtaagataaactatatgttaaactttagcatataaaagagaacatcaaatctttgatgttcctattacaatattttcaaggtgatatctctagggttgctttttatacataaatatctgttaaaagtatcaagcaggtacaaaacattctactgccagtcaatcaactttagagttgtgcttttaccattctaatcagctttagagttgtgcttttaccattctaatcaggtgaattgctcaataaagcagttactgctaatgatgctgaaataaaagatggtgtaattgcctatgtgtatttttttgtctcactttaaattataaacactttattcttgtttgtgccaaatgaataaaatcagttatcatttgcttctgtcttttttggagttatacatttcatttttaatgtacaacaacaacttgattatccagaatgtttgggcactgaaatttttttgtaggttgagggataaaatataatttctgcctttagggaagactcttttctattctggccttaactgtgagctctgtgttacacctctgctcacaatgttgtgatggcatattattatcatggctttcataattttattagtgaacaaatgaaacaggcaaaagtaggacactgattgaagttgactgccctctcacctacagccacgcactgctctttgtatattagttttgcctatttttgaacttcatataagtataatcatactatatactcaccatagtacttttgaaacttcgttttttgagggctaggtatagtgcattttgttttattaatgagcagtattcatgtgtatacgaatataccaaagtttgctttcttactgatgtacaaaaacagtgcttcaagtttttaaatattatgaacaaagctggtataaactattgaacaaggctttctatgaaagtttgtatttattcctcttggggaaaaacgtataaatggaattgctgagttatagtctaaatatatatttacctttataacaaattgccaaacagcttttcaaagtggttgtactattttacatatttgcccaggaaagtgtgtttcagttgctctatccttgctaacagttggtgctctcagtgtttttcatcaaagccataataatggcttcttttttgaccgagtttcgctcttgttgcccaggctggagggcagtggcgcaatctcggctcaccgcaacctcggcctcccgggttcaagcgagtctactgcctcagccttcccgagtagctgggattacaggcatgcaccatcacgcccggctaattttgtatttttattagagacgaggtttcccaataacggctatgatttacagtgtttactaattactgtggtgtaagttctctcaccatggctgatatcaagttaccaaggtggtgtctgtgaaaataaagaaacaagaggtctggacaatcagctcttggcagctagtgcacattgtcttgagcacagtctgcaactcttaagtaaaatttacataattttatgtatacttctcattttgacacaaagaataataaaatggctttgaattaaggatcaaggtgtaataaaataagtattttattgcttccccaaggctattcttaaaacacttaaaacatgcattttgttttaggttttgtgtgtgtgacagtgaacaatacaaaaactaatacagcttgctgccactgcagtgatccatgctaaaaggacagcagttttatccatcactgctttttcagtatctgcaaatgccaacaaagaaaagaaggcaaacactttagtgttattatgaaaataattttgacctaacagatcccttgaaaaggtttccaggactcctagatgtccatggaccacactttgtcagccatttatctagtcatactggaaatattggaaaatcatattatcttggatgtaacccatactgagttattgtgccttcttacaggttttcttttggaaactgaaacatttagaaaagagaaggaaggagagggatggttgatgtaaaaatgaagtcaatataattacactttgtatttcactatactctaacttccataaaattatcagaacactttgtttattaagtattattagtaaacacaagtgcttaaaatgcaaaactaatgaatctttactatttgcttaatatctcttagatttaaagatggtttcatttgaggtttatagtttgctaatgaatcattgcacataccaatgttaaaaatgttaaatctgctatctaaatgcaaaataaaattaatgaggaaaaaatgtacttttactgactatagagaagcagaattcctatgtaaggaaaatgacagcctgagtaatgggactataaagttaaaaatattaaataaaatgcttttagagaaacatcaatttctgtgcaagatgcaaccaatatatataatgatcaaaaactagagcaaaagaaatattaataatttatatgaaaggaaattttcaaaggaaatttcttcagttacattttatgttataatgttatattttatatataaaaatctcacattagaaaataaacataattgctactaaagataaaagtatgatgaaataatctctttacagtgctaacttatgaatcaaagtgtagcagatacttgcaagtaaaaaaaataaagactcagaaatcattaggtaagaaagatcatcacttactgggcagaatattataagattttttttaaagtttgttactccagtactatctatatcagaactattttgggttatgaaacaaaaaagataattattaggatataaaactcagcggttcaggaagaaaaacattaaagctcagcagggtaaaaacagacaatccaaaaacaattaaattattcaattaggtttgaaatagactttgacttttaaaagcaagacatctgaaatatgacctttatgaggtaagtttccatcttaaaattatctaaaataaagtaatgcaaagggcagtgtccagtaatatgcaatagaaataaggtaaattaaataatgtaaattaaaatgatataactaggagctccatgacaccatctgtgtgtgtgtgtatatatatatatatatatatacacacacatatatatatacatatatatgtgtgtgtgtgtgtgtgtgtttgtgtgtgtcttctcaagaaccaagtcattaaaattataggctatgtatattatatattacatatatattaatatcagtgcttttcaaaaaaatgtaaagccttgatgtccaggcaaagaaaataaatcagcaaactaagatctgcgtgttaaatgcagctcagcatctgtttttgtatgatatgaaggctaagagtgttttctacatttgtaaatagttgaagaggaaaacaaattaatgtttcataaaaaatgaaaattatatgaaattcaaatttcagagtccatgataaaagttttattggaacacagccatgcccattcatttagttttgtctatggctccttttgcactgcaatagcaaagttgagttgttgcaacagaggccagatggcttgtatagctgaatatatttactatgtgtccctttatagaaaaaattcaccaacccctgttaaaaaatcagagattatattagtatcataattttttttaaacaatgagttacactttcattataaaattgaaataattctcatagatcttctccatagctgcttgacttaatgataaagctgaattatcatctaagttgcttgtgttcccaaagtagaactgacttaatattagatcataatatttacgaaatagaagtgaaatgaacacatcttcagcagttaaaattattatatgttcaggcattgaagaggaattatttcatttaaaccttagaacaactctaaggcaaatctctgtccctaatgcatagatgaagaaactaaggctcatagaagtcaggcaaataaatggtgtcacctggatatgaatccagttctaattctagagccaatgctcagtttattgaatagattgcatcaagtgtgattagaggggtgttaccaaatacttctttattgtctgtccctgaaatttctatgagaggtatgtagttctctctattaaacatatatatatatatatatatatatatatatatagtaaaatatacgtctgttacatatagcaaaatattttggcatacaaggtaagaatggagaataaagaacattcaattttactattttatgaagtatttacaaatttatgttatttatgtttacattatacagctgaaattttgtgacctgctgggcatttcttcccatctgaaacaatgtcttcattccaaaatattcatcatttcttaattttaaagaacatatttatatatctaaaatatcatattatattattttccaaatattttcaattatataaatggtctattttgcagtatgaggttgcattaacaaaaggaggaagagaaggaagacgcagggagagaagaggatgaggaaaaggatgggggaaggaggaggagggtaaagagaaggaaaatttcaagtctcattggcttacaaaacaaaaggtttattggttactttagacaaagccagctacaggtcagctagagctctgctcctcggggcttttcagtccagaactcaggcagaagggacagtcctaatcagggatatgccactctgaaggcaaggagagaagagcaagaaagttgaagaattagatttagatatttgcttgggtatggtgtaagctcacatttcgctggctaaaccacgttacatggcaaactacagtcagtgtatggggctgtacaattctaattcaaggaaaagaataagtgcggacaataatatagtctaccaggctgctatgtcatatataccattccacattttgagataggatattacattctttagtaatgaccatgatgatcattatttcatttacgacacgtaattccattgtaagaaggacaactcattgttctcacttattgctattaaaatacccacagctagtaggttattatacatatctgcctttgtacatatgcaagagtatcttttagatagatatctaaaagttaatgtcaggataagaatttctgatccctaaaatgtgaatatcttaaatattaccaaactgctctcctgatttgttagtgtttcttattatttatattttctagactatttatatagatattttaattttaatcaatatgatgcctatcgaatgagactgctttcttttctgagagttgcttatttctaccctttccccattattttcttgtgctacatgtctttttctttttttctttttagaactttcaacatattctagacactattgctttattgttgagtgtcacaaataaatgatatttttattatcctttcatcttatagtttcatttgctatgaagaattttaagatattaatttagtcaaatttactagtcttttcttttagatatatgcataagagagcatcttttgaaaaagtattttgttattctcttttcaaaaacttatatccgatattatattttgaaagttgtaaagttatactttattgactttccagtttttaatccatctgaaataaatcagtctgcatgttctgaggtagaaacctaattttctattgttctgtatgaaggaataattgccaaacaccatttattagagtagtctgccccatttagagatcaaagttgcattagcagcataaaatgagttctgtagatctccatcttttttctacttgttgaagtggtgtctataaaaagtgattatctgatccttgaaagtttgacgagtacttttaaaatcaatttgttaaacaaattttgagttccaatttaatttaattaataatttgtgacttagtcacattttctatttcatcttgagtcagatttgacaatttatatatttctagaaaaagtaatcattttttctgtattttcaaatttagtaacttaaagttggttatggacttttaaaaattatgtcatcttccgtcagttatattcaacattcttttattcttaatattgaaattagtgtgttatttatttcattctcttgtgaatcttggtaaatgcttatctattttataaaaattaagaaaaccaacttatgttttatttcaaaattttctgctctttattattttttcttctagaacaagatttattttgttattttcctaatttctttagtggaatattaactttgtaatatctactagtatttccacatttatttttcaataatttagtagtgtatttttaaatttatagacatattttaatttttaattttttagtatggttaatttctaatttatttgaaattgaatagaaataactatggttaaaaattgtggtatatatgatgtcaactatttgaaatctatttaaaccatttatatattaaatataatacatggtcaatttttataagtgctccctacagtactcaaaatgatgtatattttatatgtacacacacagtaaaaattgttaattttgttcaaatttctgaatgtctaataaattggtttaatgtcaatgtttttatatgcttcaaggcaatattattttatggatagtacaaatttatgataatgattatatcttcctgcaggagcatttatttaatttaaactattatttcattttattcctattccattttatttctattccattttatgttaaattctggcttctctggtgttaacattgctaaagttcttttggttattatttggtaacaattcttgagttcataaccaaactcaatcatttattagatagatgactgggcaaattacttaaatattctatttctcattttcttcatctgaattataagctataaagacacatgcatacatatgtttattgtggcactattcacaatagcaaagacatggaaccaacccaaatttccatcaatgatagactggattaagaaaatgtagcacatatacaccatggaatactatgcagccataaaaaatatgagttcatgtcctctgtagggacatggatgaagctggaaaccatcatgctcagcaaactatcacaaggaaaaaaaccaaacaccgcgtgttctcactcataggcgggaattgaacaatgagaacacttggacacaggaaggggaacatcacacactggggcctgtcgtggggtgggggaaggggggagggatagcattaggagatatgcctaatgtaaatgatgagttaatggatgcaacacaccaacatggcacatgtatacatatataacaaacctgcatgttgtgcacatgtaccttgaacttaaagtataataaaaaaagcgaaaaaaaagaaatatttgtaatgtcagaaagttgaggcatgtcgaagaattgtctgcgaaagtcatgaaagagaaaaatgttataaaaaagaatttatgcaaaaaatgttgtataatttaaaagtaattaggcctcctgaatgtaaaactactgaaaaaaaaaaaaaaacagtttatgtacaaggtgtataagaaaagtaaaatatacccttggtaaaaggaaaaaaaaaagaataaaagagaaactatctcagggttgttgaggtaactgctaggttagtgtagttgttagttgcagtgcataggataatgcatggcacctagttaagtattaattaaatactggcgaaggaaaggcagtataataattcacaaaagcaagctgaacatccaagtaattggatcgctgagttgaatggtaattctgttttaagttcttttaaaaatcttcaaactgctttccacagtggctgaactaacatacattcccaccaatagagtagaagcattctcttttctctgccgcctcgccaccatctgttgtttttgactttttaatagccattcagactggtatgagatagtatctcattgtggttttgatttacatttctctgaagattagtgatgttgagcattttttcaagtgtttgttggccacttattttgagaagtgtctgttcatgtcttttgcacgttttcaatggggctattcgtgccttgtttgttgaattgttttaagttccttatagattctagatattagacctttgtgaaatgcatagcttgtgaatattttctcccatctgtaggttgtctgtccactctggtgatagtttcttttgctattcagttctttagtttaattaggtgtcacttgttaatttttgtttttgttgcaattgcttttggggacttagccataagttctttgccatgccaatgtacagaagagtatttcttaggttttcatccatgatttttatagtttttaagttttattcctattatctgactttgaatttttttaatcgtttttttattgtttgtaagtttttgcccctatcctctgccctctgttatatttgactttctatattctctatatttcatcggataggttggagccatacatagtctttctattacttaatcttaaattgactaatatcttaaaactattaaatttaatattatctattaacatttatctaaacatttctgtataaactgataattattatttctatattcatctgtataagagatagcttattttgactattttcttttcttttttttttcttgagatggcgtcttgctctgtcacccaggctggagtgcagtggcgcgatctcgccccactgcaagctctgcctcccgggttcaagccattctcctgcctcagcctccacagtagctgggactacaagcgccggccaccatgcccggctaattttttgtgttttttttttttttttttttttttttttagtagagacggggtttcactgtgttagtcaggaaggtctcaatctccgggtcttgtgatccccccgcctcggcctgccaaagtgctgggattacaggcgtgagcccctgtgcccggcctattttgactattttctaaccgtggcggtagtggtgttacagttcaaaggggtgctctgtgtgttaaggtctttatatttgcatattgtaaacagtctgtatttctcctgaatgaaagattggctaagcataaaaccctgtattggctgttattatcaattgtttgcaatatccattggtgtccattacaggcatgctgcttctctagtaattgttaattattttctctctgaaaggttggctatttattttgcagggtatccaccaatttcactctaatgtttctatgtttaaaatgtatcctgatcaaaattacaagtacgctttcagtctgaggttgataaacattcttaattacataaaattcttatcaattatataattcaatattgtattttcccaatccacttccttatctcattctgaaagtgcttttagatatgtggtagaacttcttaatctatcctcttaatttctccttaattaaaaaaatatattttttggcttacaatgggagattctttatgagttcctcagtgttagcttccaatttactaaatttcccctttgagtccaaggaaaatcagtttgtccattttatcttcttagaaaattctaattctttcatctgagaaaaaaatcacttcttttaatttttaaatttgtctgttcagtttcaaaatcttttttattttgtattagaagttatatctcatttgtcatttgagaatgtttgtcatataattcaataaatttactgtcatctgaagagaattcatgttttaattattggttttggcatatgtttcttaagagaagatttatgttttatgtttcttaggaaaagattaattgatacattttgaaaggtagattttaatgctaattttgtgaggctcagtatttgttaccattgtttgttcttttctctttctctggattttggtaactaggaaatcagcaaagattggcagtagtggtgtttgtttgatttttatttcttttcttttttttttaatgtgagatggcaccatagtctggctcaatattttcttataccaaccacatttccccttgcccaccccacttacctggcaaaagataagctcacagtcatcactgtctgctcccacaggcagagctcagctgcattttctgcttttgatttttgttctgtccataattaacaaatatttttgttgtatataagcccagccagtgttttttggtttctttttttgtaatattttattactgttatgtgttctgaggaaaattaattattggaacataaactcgctattgccattatggcctggaaatcagcataaacacaactgctaattcatacatcttttgaggatatttagtcagcaaaactcaatttgttggtgaattgagcagccaagatttgtggccatttcctcagcatgtgctataagactatgcttggaaaaataaagttatgaaagaaaatagattaatttgggtcccagtaatcccagcacatagtagtatctaaaattaccttgttcattatctgatattggagaggtgaataaatattacttggaaacaaaatatttgaaagaaatacaccttttagaatagtatttgaagttggggaagagctaatttaccagatggtaccattatactctcaaagagttcatttgccttaaattgattatttctttaacacttttattctaattaacaataaaattgagacttctttgcttggctgaaccatgtgaaaaagaacatttgctgaattttacaatgacttgtcatgaagaacagagaaagtggcagtggctgagcaatgtagaagtattcctaaaatgatttgtacattggcatttccctttttttctttgtagacattttttttttggcggggggacagggttttgctctttttccaggctggagtgcagtagcgtgttctctgctcactgcaacctccgcctccttgggttcaagcgattctcctgcctaagcctcccgagtagctgggattacaggcgcctgccaccatgttgggctaaattttgtgtttttagtagagacagggtttcactgtgttggccaggctaatctcaaactccggacttcaggtgatccacccgcctgggcctcccaaagtgttgggattacagttgtgagcccccgtgcccggccctctgtagacattaattccccaaggacattctcccattgggccccgaggttatatgttcgcaaatttgctgtggagcaagttctgtttaagactgaaaaaatcagtgagctctaccttataagtcagtcttctagtggagcctcaatcagtgtggtatacagctctgaaagtgtaggtgcatttagaataatttggcaatctcagaataaatgataaaatgcctttgcatcaaagccaagtactttcatcttgatgttcttattcatcattttagtgagttttgtaaactacaattcttaatatgtttataattattggttcatctacaaataagacacgataaaataagacacaataaagaatggtaagagaacatgaaatgtactaaagagaagtacaatagaaaaagaaaaaaaaagtatggcaggaaagggccaaaacaataaataagtataataaaattattaagactgaaaaaatgactgagctgtacctcataagtcagtcttctagtgaagcctcaatcagtgtggtatgctctgaaactgtagctgcatttataataatttcacccagaaaatttccacaaaatggaaaatattaagaaaaaaacattcagactgcttcagatcttggggtgcacagagtcaggtatagaacaactccaaagtccgttttctaattccaagccatctttggtcattcatcccctttattttgaaacgaaaatattggaaagtagtggtgtggaaactttacaacagatagggacagaaacatggtcagagagataaagccattaagatcatctaaactgtaaactcatttttgtcagaaattgtggcatcttactcatctttgtgtttcataatctaatggttatttaacacacagaaagtgttcaataaatatctgtaaatgaatgctgatgaggaatagagagaagaaaagtgaaaagaactgaagcttgaagaatagggatgagatatccaaaagaagaggcaaggagtaactcattgggtacagatagagatacatagatatagatgatatagctatagatagatatgaaacagaagagagtggcaagtaagactatggaaaatattgaaattaagctatattggtgtatatcttagttaaagatggtacattagtataatgggtagcttcctgaataataggaaaaaagccaaatgtgaagcaaggcacaatacaaaaccctaacagatacgagaataatgtatttgctttcattcaaatttgctaacgtctattataaaaaatcaatatttgatgtaagtttatgaaatccagcatttaaacaaatctaaagggaaaagttaatcttaaactgttgatacctgcaaaagaaaaaggagttatttttaatgcagtttttaccaaacttgaccagaatcagctagttccatttttttaatgtagattcctaggccctaccccttgtgagtgtgattactgagtagataatcatataataataacggtatatctaactagaacttctgatgattagtcacctttgaaaaacaaatataataaattttatcttgacaggcacgaggggcaagatgagttctgctagcaagtggcatttattgtaaaaaaaacattcttgagcactgcttttcaaaaccccaagtcacagcttgaagataatctaggtcaagacaactctcatttaatttttcacagtcaatattatgtgaatgaagtttttgccagtcattaactcaagacaaatataaaattctgaaacatgccctcctaggcaacagcttatggaaaaagacaacacgaagtctaatattcaaaaggtctttagtccatgtattataatcttacatttatgttttataaatatttttctccgtcatgttgttgtagaagaatcttgactcagactacatgtgtgcatgaacactgtgaactttgatttcagtagaaactgaccaatctccctggtggatccattaactgaaaaacagtttttaagaagttaaacttaacttttaagttttggttggcccagccaagtaatatgttgcagattttgctgactgtttgttattttggtttaattatgaagttattttcactataattatattctttgaaatcactgattcaagaacctttcaatattgaaaggaaaattaatcacctacatgaaactatagaagtttttagattacctaaaggaaattggaatatcattttagatgcacaaggataaatggttctaataattatgaaaatttttaaaaattatttggctctacaggttaatcacctataagcagtccaaaatttaaattaggaccacttctactcatcacaaaacatgtgacactttgaggattattcacagaataattacttctaatattttaagagatcatatactctattttgatggcttgcttcctcagtgtagtgaccttgggtgtacatttatcaacttttatgtggtcatatcttaaagttatatgctttatcatccctgagtatttatattgtgtaattatggagattatcaatagtttttacagtatgatggatccaagttcttagagtgtaaaactttgaacctttaactttacattttatttctattatttgacatcagtgaaagaaaaatgaggcttttgaaaggaattcattataaatatctcttcttgttacagttattccacttaactgtttccactatatcaaaggacaagcaagaattatcatttgtaggattttgaaaaccataaaatatattctgggaaacttgatcatttttcagtaactgaactagaactaccacagacatttaatatgttcaataaaagttcagataaaatgaaagcactaccatagtaatatataactagaaactaacatttcaatgacttcttcaagtactgaatataacatcaattgcagaaaaacgatcttaacagctcatcaggcagctagaaaagggaaatttccaaaataatcttgtacattattctcaggtattaggttattaataaaatgacaagcccttctcaggttgtaaaagatatagagaatgatttataaaaatagggttatttaggttgcaatgacttagaatcacgatttagtatcacttttctgagaacattctacaaagttactcctttaaaggcaggctatcactacatgttttagagttttaagcatacttgtatgcgaacttaattatatattcaattacattttagagagatgtttcttttttaaaaagtaattcaaatgatgaggactaatttaacaaaaattaaagcacactctgtattatggtaaaatacatttttataaactgttaaatttcaattttatatacctaaaatttagacattataatagtgttttgtaatctattattgcaaccttttagattttatactaataaacatgtagaatttcaatccatatggtttcccaggcatgtcttatacagagttttgaaaatactctgaatccttaaatattgtacatgcacacacacacacacacaacacacacacacttaactttcctcactttacagaagttggcaagggaaccatttaaagccaaatagtacacactcctttacttgtattggagatacacaaaacaagtgaggccaacaaaagaaatttccacagtttgtcacaaaacaataagccctatttttttctatgtttttttgttaaaaaaattctaaaaaataaaattattctcacctttaagggatttaaatattgtagagggtaaaagtttatatctgtgtttgtgtagtcactaaaatagttcgtattctgtaaaataaaatcataaaatagttgtattataaagggattgctaaaaagacaaatcagtgacattttgcacattctaaatttttaggaatggttactatacagaaaattcccatatcttgctctcaaaatttttctagtgatctctaaatttctatttaacattattccaactgatattcatttgaagagctggctttataagttagtttctccaacaaataccattctgactctgtcttggagtcatggatgcataacctcaagttggcccatgttcccagagaatgacctagttatcggatgaggaaatagggcattttcatacacttttagtgggtttagaaaaaggttctacttcctcgaatggtaccttgcaacttctatcaaaattagaaatatactctttgaacaagcaattccatacttaggaattcatccaaatattaaaattgtacctattctcaacatgcatgtctgagaatgttttattctattacattataacagcaaaaggtcaattaaaacaactgaaatgtattaatagcaagggactggttacataaattatagttatccttacaataaaataacatgtatctttttttaaaaaaggagaaagtatatgttgtgatatggagagtttttggcataatctattaagtgaaaaagcaatttttaccaaaatgacattgattaggtaaaaaaatatatatttacttatgtgattatattaaatttctggagagataaatagggaaggttacacctgcctatctttgagacagaagcttcagataatttaccattctacatttttcaaagcatatgatttactttgaaaatgttttatctaaaaggtaacttgaaatctttagataaaaatcttcaatcaacctttacctgttcaacccagatgagcacttatctttcagacaacttacctgaaaagacattagtagctttataattggtactgaagtctataatgctattttaatgacaatttaatgtccgtcaacaggcccattgttttcaatagcatagtaaaaaatctcatattctgactaccactttatcttattttttctattccaagctgtcagtgcttctactccttactaattcaggaagagatttccaaatccttaatttaaaaaaattatcctcattaacacccgctacaaaacaaacagaaagtgcacgcagatttatgaccaaagggtagtctaaattctcaaattctcactgccttactacatttttatgcattctaaccttctaatgatttttttgtaaaaatagataatgtacagtaaattacttgatctaagcagcaattaaaaatattcacatgattttcattttcaacaataaaattacataagaatttgggattgtgttggcaatcctgtgaaatcagatgacttgctttggagatacagtgcctaaaaatataatttgaaatttacaaatggctttgataccccggaaaatatctcacttctgaatcttcgtgtttatactctgtgttaaaaatgctatgctagttttcttttttacttgttgatgtttatttgtggctccttaggtattctgtcattcagtgtttacagcaaataaacaaagtcagtaatgtcattcctaaatgtccaagtagagaacttttgcttagaaaacataaatgaattactccacatgccaatttttccgacctaactcacctttcatttctaaaccacttttacctttttttttttgtttttcacatgaatatcttttattactttttcttatctggttagtctggctaagacttccagtactatgttgaacagaagtggtgaaagtgggcacctttgttttgttggtggtctttgatggaatgttttaggcttttcaccattgattataatgttagctatcgacttgttgtatatggcctttactatattaaggtatatgccttatgttagtaatttattgagaatttttaatcatttttttattatactttaagttttagggtacatgtgcacattgtgcaggttagttacatatgtatacatgtgccatgctggtgcgctaatcacaaagaatgttgaattttgttgaatgattttttttgaatctattgagataatcataaaatttttatctttaattctgttgctgtgttgtattacatttattgatttaacatatgtgaaatatccttgcatcgcagggaaaaaaaaagtgtctgttggtcatggtatgtgattgttttgatgtgcttctgaattgggtttgctggtattttgttgagaaattttgcatctatgttcatcaggaatattggcctgtgattttcttgtcttgtagtgtccttatctggctttggtttgagagtaatccaggcctcctaaaatgagtttggaagtgttctccctcctcttcaatttcctgaaagagtttgcgaattgctactaattctttaaatgcttggtagatttcacccgtgaagccatctgttcttggcttttctttgttggcaggttttagaagttaaattgtctctgtttgcagaagacatgcagatgatgttatacatagaagactctgcagaatctgcaaaatattgttacaactaacttatcagtaaagttgcagaatacaaaactaacatacaaaaatccattgagtttatatacttcaaccaaagactatccaaaaaaggaattaagaaaacaattccatttacaatggcatcaaaaagaataagatacatagaaataaatttaaccaaggagatgaaagattagtacaattaaaactataaggtactaataaaataaattgaggaagacataaataaaaggaaaaatatcctgtgttcatcaagcaaaagaattatgttaaacatccatactacccaaagtaatttacagattcagtgcaatcctgctatggttttaataagtttgtcccctccaaaactcatgttgaaacttagtctccattgtaacagaactaagaggatgggaaatttgactatgctttttgagaagtggaacctttggtaggtaactaggattagatgacaaaatgagagtggagcattagtatctttatatgagaagaaagagacacctgcattagcaaactcagctcctcttgccctgtgatgtcttttgtcatgttatgaaacggcacaaggccctcaccagaagccaaccaaatgcagccacttgatcttggacatcctagcctccagaactgcaagaaataaacctcttttctgtataaattacccaatctcaggtattctgttataaccacagaaaatggactaaaataaatacctatcaaaataacaatgacatttttctcagaaatagaaaaaacaattctaaaatttatatggaaacacaaaagaccccaaatagccaaagcgattgtttagtctattatcacactgttataaagaactacctgagactgggtaatttataaagaaaagatttagttgactcacagttccacatggatggggggacctcaggaaacttacaatcatggcagaaggggaaggggaagcaaggcacattttaccatgacaaagcagaagaaagagagagagagacaagggggaaacgccacacttttaaactatgagatctcatgagaactcactgtcacgagaacaccaagggggaaatccaccctcatgatccaatcacctcctaccaggcctctaccctgacacatggggattacaatttgacatgagatttgtgtagggacacagagccaaaccataccagcaatctttttgtttgtttgacagagtctcactctgtcattcaggctggagtgctgtggtgtgatcacagctcactgcagcctcaaactccagggctcaggtgatcctcccacctcagcctcctcagtagctgggaatacaggtgtatgccaccacacttggctatttcttttgtaatttgtgtagagacagggtttcacaatgtttccaggctggtcccaaactgctggactcaaacaagtctcctgcctcagcatcccaaagtgctgggattgccgatgtaaaccaccagtattagccctaaagcagtcttgagaaagaagaacaaagctggaagaatcacactttctgatttcaagatacattacaaagctacagtaatcaagacagtatggtactggtttaaaaaaaaaatacatatagaccataatagagagcccagacaacacaccctggcaaatacagtcaacccctctttgataaggatgtcaagaatacacaatagggaaagtatagcctacttaataactgatgtcaagaaaaccacatatccacatgcaaaataatgacattgtacccttatcttacaccatatacaaaaatcaacttaaagtggattaaagacttacatgtaataactcaaatgtaaaactcctagaaaaaaaaatagggaaaatcctcattgatatcagtcttggcaattattttttcagctatgacaccaaaaacattggcagcaaaagcaaaaataaatgagtggtgcttcattaaacttaaaaaacttctactcagcaaagaaaacaatcaatgaaattaaaagcaacctattgaatgaaagcaaatatttgcaaaccacatacctgataagacattaatatccaaaatatataaaaaacatacaaatcaataacaataaataaataaataaaccaagttaaaaatgaacaaaggacctgaatagacatttttctcaaagaaggcatacaaatggctaacagatacatgaagaggtcctcaatatcactaatcatcagggaaatacaaatcataacctaaatgagatataacctcactgctgttaacaatggctattttcagaaaaaaaatgaaagatagcaagtgtaaattagtacagccattatggaaacagcatggagatgcctcaaaaagttacaagtagaactaccatataatccaacaattcaatcttatgagcatatatccaaaggaaatggaatcagtatcttgaaaagatatttgtacccatatgttctttataacgttatttacagtaagagaaagacatacactgtttgattttaactaatttaagttggagtcacaagctattagacactctaatatgtcaatttctcataaacatcatcaatattacaaatatatgcattattttcctttaacttaacccccaaacataatttttggtgtgccattgtctctatttctaactttcctaaagttttcatggatgaatgtaaggcatgaatctgtaaattaaacaataacattgcacaaaggtagtgtcccagccttagtgttctgaatgtgcatattgatcaaatatatctttgatcaggacatgaaatagattcataccaaagctagtggtagaccaaactgaatactgcttatgattctataacaggaaacccataattcacaaagtgtcttatcccttaacatctcctgtttttaagttacatgactgaattattaaaattagttggagtatttcaccttgccccccaactatttgccaatttattttactgttttactgaatttaccttccttagctcatcttaagacattttaatatattctcaactgccactaagagtaagttaaagacattctatgatattcctctaaaaaaattctaattttgtccttgaagttaagcagcatgattgtttccttttcaaattgcttccagtctggtagggccacagttcttatagatattaaaatgaaatataattgaagtgcaaatatcctttattgtatttatttggttctaataccacaacactaagaataaactaatgagcgatgaaaccatttgggatttactgacctctttggaaatatgatgaaacactggattgtgtccccataacaatgtatatgcagatacacaatgttttacatattgtttcaaagactatgtgaaactcttctatacacttcattacagtggttctccaagcatgatgctggaccagcgcttcaggacatcttgttagaaattctgtcttgggccctgttccagatctactgaaacagaaactcttgggggtagagaccagcaagttgttatataacaaactttcggggtgcttctgataaatgccaaggtttgagaactattgtagagggccaaaatctaagtcttgtatgtctgaattagatcttaaagtatttttattcttttctctttagaagatccaatgatatctgacaaagaatggtaaagtaatgattgcggttgtttaattcattaagaagagaacaattaaatcgactataaattaaatttgtgaaattattaataacaagactatgtaaaacattttttctgctcttttttacctcttcattcagacttctaaatcataattccattacagggaaaagaaaaagaaagaatatcagtaaaacaaatggtctggcctgtgttctatatcaaagaatttgagtttatttggtaagtatacttaggtaggagaacaggataattgtaggagcttaggagagcaccattaggatatgctagttatattatatgaaggataactaattttatatttcaaaataaatcttatgaactgatgtatgaaaaatgatatgccacattattaatcggcctagtaacttcaggcagaaaagaaaaacttccatttttgtttcctagtgactgtctgaatagaaaagtgactatataaatcactgaaaacaaaactgatagttttaaaagatatacctaaccagaatatgttgctgattaataaagtatgatggggcaggaggtggaggacaaagagaagagaagaacatttatagagaatcttggggaatgaccttactttattctcttccttttcccaaattaccttccacccagtcaaggttggagaaaagcagcttcctgcatgcctaaccctcaagtcgggtaacctgagaatcaggagaatttggaatttctgtttttgactttagtttgataagcagcagcaacctcttaaatattaagaagccagtggaatatgtcgtgacatatccaaagggaagatcaggagagtatgttcatagatatactgtgtctcaccacaagcaccctgagttccctgtttggcaaagaatatgctgcaatagtaatttgacagtgcaagttgacttgctggccactgcctccagtactacaaagaggtcaattgtcaaaaaaagggagctttatcatcagagactgtgggatgaacttcctatatgaaggaaaagaagcagtggctgcttggtagtaactacttcgaatgagcacctggccagaataaggatatatccacgctgaccaccttgacagggtagctgtgaggatgaactcagagaaaatgttgaacaaaaactgaaaaaaaaagtggtttaaagaaatccctattttctaactaactttttccaacaaatatgtatggagcatttactacacatatcatgtattcatagcacaagcatgatatgcccactcggtaaccaagaaatggaaatacaaagccctgtgaattattacttttagatattacagaggaattaatagatcatttatctcagggtcagtgagatctcatgaaatacagccaattaagaagtaaaagatgggccgggagcggtggctcatgcttgtaatcccagcactttgggaggccaaggtgggtggatcatgaggtcaggagattgagaccatcctgggtgacatggtgaaaccccgtatctactaaaaatacaaaaaattagccgggtgtggtggtgggcccctgtagtcccagcgactcaggaggctgaggcaggagaatggcgtgaacccgggaggtggaggttgcagtgagctgagatcgcgccactgcactccagcctgggcgacagagcaagactccatctcaaaaaaaaaaaaaaaaaagtaaaatatggcaaggcaacgtttgcttctatggtttgaaagttcattcccttcaaaactcatgttgaaatgtacttgccattgttaatggtgttgaaaggtgggaactttaagaggttattgggctgtgagggcttcaccttcataggtgggattactgccattatagaagggctagttcggcctctttttttctcttggttcttctgctcttctgccttgtgagaagcaatgtggcatttaaggcatcatcttgggagcagtgaccaggccctcaccaagcaagtgttaaacctaccggcatcttgatattagacttcccagcttccagtactgtgagccaagaaatttttatttgttatcaactaccaagtccatgatattctgttacaacagcacaaatggactaagatatttacctttcctgagagatgctttatgacttacagtatttatatgttaaaaaacaacaataaaaacaaaacccacacgttagaatattcttttaaaaaactcagatacttaattttataccatgcctctaattatattgtgatttttagagtaattttaagttaattttgcataaaatgtttaaaatatcaaatatatttattgcttacaataacagtccaagtacatagacataaaaatattttaaagctaagatatattatacatttgaaaagttgtttattctagctatatacacaatatacatacagttacgtatgtttacatttttgcatacttaggtagcctcttttccactggccacttctagcaaatggctcatcaatttctgtttcccttccattacaaaaaatgtctcttccatggacattcacttacatgtacctgggatataacaataaaaccttttagcttttcagcttttccacccatttcatgttctagtttctcatataactaatcaacacagttgtcggagtaaacaacctgtgtttttcaaagttccgcaacgctaaataattgttttcctccttaagccttttatttcacctcaactttatataattaatatttttgctcttcatgctagttgcattcaaaccaagttcccactattcagggtatttaatacagattatgtatttccagttctagaaatgaagatcatcttaatatgctcaagggagttttggtctaatctggacttttcttccagatgctgtggacatttaccgtaccctcaacaactatctagtctaaccagatctggccgtcattagattggcccagtatttcccacatatttgactggattgttcatctttcactttaagcacactctttatcaatgagtgtaactgctggctttgcttacttttgcaattcggtgggctgaataacaagttatctaataatttatctatctctctctgtgtctgtttctgtctccttactaccctgcctgtatattctacattctgtatcacactgagatggtgtggtagtggtatatggtgtaactgtgcgaatgtgtgagagtaagaagtgcactgggggcagagttttaggcagatattcttttggaaagcatctctctcctcttatttcatgtcaaagctgaaaatgaattctccattggatagaaacacagacacttctgaatattgaaactagtaactgccaagctctaaaagctataatatttctatttaaaatttttcatgactaattttgtttaagctaaaataaccttatcagtggatggcagctctgattctaaaactgtgattgtcatcagaagaactttacataaatataataaatacatgcgtcccaacacaaacctaattaatcataatctctgtgagatgattctcaggaatctctgcatttgaaaacccttatttatcagaaataaccaagtttgaaattctctagtgaaaattatattgaaatggtgttgactcttagtttattatgggtaaaatatgtttgaacttatatttatagaatattaattatattttgtcctttgttataccatctctccaattatactgtgatacttttagagtaagatttagctcacccaggcaggaatccagtggcacaatctcagctcactgtaacctccgcctcccaggttcaagcaattctcctgcctctgcctcagcatcctgagtagctgggattacaggcatgtgccaccacacctggctaattttgtatttttagtagagacacggtttcaccatgttattcaggttggtctcgatggtctcaaactcctgaccttaggtgatccacccccttcaggttctctaagtgctgggattacaggcatgagccactgtgctcggcctgtacatgctttctaaaagttttaagaatgcaacttttcatttcctaggttcactggtaaggtttactcttacttggcagtgcggtttccgggtggaaattaagaaacttcagtgtgtttcattattctctctgtccaaatattctgaaaaataatcaaagtaactgcctgaaattattcaagtttgttgataaatctttataagccaaagtaggcaggttgtgaagttttttttctagtcatgccacatcccacttataataaagtattatgcaatgattcacaaggctggttgatccttttcctggtttcaccagacaagcaccttactatactcacctgaagaatggcaacagcttcctaaatcatgacccttactcaattttgatctcaagtcaatgtcccacacagcaccaaggtgatctacaaaaatttaaaattaaaaaaagcacgtaatataaatctaaatcagattatatcactcactttctttaaactctccaatgatttcccatttgaattaaagaaaattacaacttcttagcacagccaatggaatcccaaattatctggtccctgactttatcttacaccactaccttctcactcactctgctcccacaacaaaggccttttttttttggctcttaaaattatcctgtagatccaaaactatgtaattccaagaagaaaaggtaagggaaaatatttatgatattggtttggcaattatttctttgatgtgacatcaaagttcaggcaataaaagaaaaagtagacaagtaggactacatcaaacttgaaaacttttgttcaccaaaggatagaatcattgtgaaaaagcagccaacagaatgggagaaaatatttgcaattgtatatttaacaaggagttaatatccagaatatataaagaacatgtacatctcaacaacagaaactcaactcaattttagaaatgggtgaaggacttgaatagacatttctccagtgataatataaaatggctgtattagtccattttcacactgctgataaagacatgcctgatactgggaagaaaaagatgtttaattggacttacagttccacatggctggggaggactcagaatcatggagggaggtaaagggctcttcttacacggtggcagcaagagaaaatgaggaagaagcaaaagcagaaacccctgaaaaacccatcagatcttgtgagacttagtcactatcacgagaatagcatgagaaagactggcccccatgattcaattacctccccctggttttctaccacaacatgtgggaattctgggagatataaatcagtcgagatttgggtggggacacagctgaaccatatcaatggccaacaagcttataaaatgatgtttaacatcactaatcattacacaaatgcaaacacaaaccacaatgagatgtccactcacacttactagaatggccactttcaaacacacacagacacacacagagagagagagagagagagagaaaataacaagttttggcagagatttggagaagttagaacccatgtgcactgttgatgggattgtaaatggtgcaagcactatagaaaacagtatggcagtcacccagaaaattaaaaatagagctaacatacaatccaacaataccacttctgagtatacatccagaagaaatgaaagcagggtgtctaagagatatttaaatattcatgtctacagcagcactatttatgactgccaagagttagaagcaatgcaaatgccatcaatggataactgaataaacaaaatgtgttatttatatacaatagaatactacgcagccttaaaaaggaaagaaattctgtcacatgttacaacatggatgaaacttgaggatattatgctaagtgaaataagtcagtcacaaaaggacaaattctgattttatttatatgaagtatctaaagtagtcaaattcatagatacaaaaagtagagtggtagttgccaggggctcagggaaaggggaattatacaatgtgtatatagtttcagtgttgcaagataaataagctctagaaatctgttgcataacaatgtaaatatacttaatactatggaactgcacacttaaaatgcttaagatgacaaattttatgctattgttgtaaccacagtgatgcaaaaatacctaaaattttttctctgcctggaaagtcttgcccttgaatcttctcatttctgaccccttcatggcattcaccttagctcatgtttcctctgtccaaaagagatgtctcttatacccaatgtaaagtagcctgcctaagtcaccttcacatacgatctccctaatttgttttcctaatggcacttattatcatttgaatttatcctattcacatttacagtattttctgctccatctctgccattagaatgaatttctatgtcttatacgctgctatatgttcaatatatagaacttggaatgaatgatagagtcttctcaataaatacttgtgaaataataaatgaaatattttaagaaggattgagcaatgcattaattcttgctaacctctgaacaaataaatcatattcatttcagcaagatgtgaaagttgtgtcatgtcgcagaatgtgttttgtaaacaaattgaattatttgactaatgtgggcaaagaagagtgataacacattaagcggagagtgagtgataggaaaaaggctaaatgtggacatataaaggattcagtaaaatggaaaagctgaataagtagttagaataaggtaaagtcacgtttagatgggctcatttgtcatgagtgtgagagggaacagagaaccaagtgaaatagttgggaactaatacaggtatggaggggaaagaacaaaatacagaggcagaatggggaagtgtaaatcttagatgataacctaacatgcaagcagaagtacacttaagacacatgtatatctgaattatttggatcagaggaaacatgccatccctttcttcagctatgtgacacattcaaaaccaggatttgttgagattaattagagaatggtaatgaaaaaaggttgaattcaataaattaatttctgtaaatgtttttgaaattaacttataagtgatgaggacaatgatgatgataatgatgattatgatatacatatagttacagagacctttaaaatttactgtctatcaatgaggacaatcactgacagataccaagagccattgttagagaagttattcttgttaaaaattattcactgtgttgaatgaaaatctggaaacttctattttatctttttaatcatattattgcccactaaactaataaagaatgcctgctttttgtgtataagaagtattcaaatatctgataatgccaatctcgactcatattgaataaagtaatttataggataaacctctggtaactccacccatttcgtctgagaacactcagtattctgatactctgtgattttgcttttcaaaattatcttgaaaatattttatgctaaaatgtatgcaatactccagaagtagttgtataattaaggtattatatcccttaattctgaatattatattttatattgctagtttggcaagaagtatcatgaggagagcccagagctatctcattggaacttttttgtgtcaagtcttctacttacatggctaaattgttaaaataaaagcaaaattcttaatttaatctcagaaattgtcgtattgcttttagtccaatatgatagctgtaatatgcaattttatcatccaatatattaggtattcattcacttttatatttgtaaatctcacaacaactaagagtgcttaacaaagtataataggtaactacaggaggtattcctctgtacggaaattaggggcacaacaaattagagcaaacactgcagggaactttagattgctacacgagacaagaactatttgacccagagaacagctccttgtccgacaaaaataaaactcacaaacattgcatttacttattacatttccccttactgcaaagagagagtttattttcagaatctgtattcattgccaaggagagaagaaatctttaaaaataactgaggaaacataccagagttacaaatattgatcaagtcagacattcatttataaatatgtatgtacagttcatctttccaaaaatttgcagaatatttcatatagagtaaatttggaatacactaatattcatttatttagcaaatgtttattgactacccactctgtgtgggcagtcatttttttaaacactaaggatagaaatgtgaactagctaataaggcattagccataaaggtgcaaataaagaaacagaattaatgcaaatgaaagataaattcagttacagttcacaccagctgaagtattaaagagcatttttaacaaaataataacagactgctttagcatgttaaaaatgtgattgataacatacatgttaaagcatgtgaatgataaaaaaatgtgtttagtaaacaacatctaaagggctgaatagttaaacagatatcactaaaaacaaaaatagaaaaccaaatactaagacaagtgattctcacagaatacctgataaaagataaaaagatgaacgctgtcattgtgaagtgttctttgtagatgtacttaaacatggcttctgcgcataggaaagaatatgaagaagtatttctggtttaaaaaatatatttgattattacaatcaccaattcgaaaccttgattatttatagacaaatttataaaaataatttcatttaaaatacatttctagaagtgttttagaattttattaatcaaattcccctttttcaatttcaagctgtgtctaaaatattgtaggtttcatttcttgtttagtgactttattttgctggttaatacaagttgagtattactatatctatgacaccacaattgcaaaattccagacttgacttcatgtgatgggtcacaatcaaaacacaggcacataacacagagattattcagtgtccccaagggaaaaagaccttcctgcccctcttcagctgcaatatttcatttccatacatgcctagattctcccacataagtacgctcacaaaggttaataaaatggcatatgtgcagccctgacacaccaatgattggtttccaatgatgccctacatgggcccaagacctacatgcattactcactgtgttttttgcttgttctcttctttgagttttaaagatattgttgaaaatgtttaaaaggcctacagatacctctacaggtaacaatgacaagaaaagcagaaagcatttacgtttacctacagcacagaaagtcaacctgttggagaaactgttgttccaacagcatgactatttttgctgtagacaaacatagtgtagatagtgatatgcattaaatatgttacagaagagcatggtgctggaatgaccaccatatatgacccctcaaaacagaaggataaactgttgatattctatgctaaaagtgatgaatagaagtaatgaaaaacagaaaacttgcataaagataaaaataaagatcttgattatgtattgaaagagtggatccatcaggatcacagtaaacaaatgtcacttaacagtattctgatcatgaagaaagcaaagatccatcacgatgaactgaaaagtgaagggaactatgaatatcaacaggctcattgcagaaatttaagaaacgataggggttaaatttttaatgatttataatgataaagcatctgctgatcatgaatcaatggatatatttattgacaagtatgctaaggttatcactgatgaaaatttgacaccagaacaagtctataatgttgctgaaatatcactgtttgggcattattaccccagaaagaccctgactacatttgatgagacagcacctacaggaattgaggatatcaaggacaaaatatttgtgctggtatttgctaatgcaacaggcacacataagaaggcacttgctgtgatagacaacagcttgagtactccctgttttcaaggagtgaatttctttctttcttttttcattttatttcattttatttttttgagaaggagtcttgctctgttgccacactggagtgcagtggcgcgatctcggctcactgcaaccttcaactcccacattcaagctattatcctgtctcagcctcctgagtagctgggattacaggcacgtgccaccacacccagctaatttttgtatttttagtagagacggggtttcaccatgttggccaggatggtctcaatctcctgacctcatgatctgccctccttggcctcccaaagtactggaatgaatttcttaccagtcctatattaattatgctagcaaaaagttgtggataaccagagacatcatttctgattggtaccataaacattttttactagtagctcatgctcactgcaggaaagctgattgaatgatgactgcaagattttgttattgcctgacaactgttctgctcatcctccagctgaaattctcataacaataatgttcatattatatatttttcccaaaatatgacttcagcaattcactcatgtggccagagtatctttagatcaatgaagactaaatgtaaaaatactcttgaatcagcaaggtaacagtggtgaacagaggagtaggtgtggaagctttacaaaaggtgtttagcataaaatatgctatctatactgtttcaaatacttgaaactgaagacacaggtgtgcatgtgtaacataatcttatcagtgatcatgatgagcaagatggtgacattgaaggattccacatgttaagtaagcaaaaaagtctgacctccttacctatgccaaatacataccttcagagtctcagtaagctataagaagggaatatcatataatattttaacatcaataatgaaactgttgttgttcatttattgattgatagtaaaaatagctgaaattgttctgaatcaaggtgatcatgataataatgatgataaatgtgacattattaactgcagacaagtgcctataagacatggtacaaatgtgtgatgagcttattgagggactagagcagtgtgcaattataacagaaaaaggaatcatgtcagtttataaaatcaaagggagacttcaaagacaaaaatcattgttaatgaggcaaattacactggaggaaacattgtaaaaagatacccagcaaaatgcctcctcattccagaggatccactttatggttcctcaaatgcttctgatgttttttcttgcctgaaaaaaaaaatacgatttatggcaacattttaatcaaaacacagcattgtaggtggagactgaaagccggctgtcatttgttgttactactatcggaatagctggtacaggtattctggtgatgctactgtgctgcttagttaccctgaacccataactttttcactgcactaatggtatgtcatattttttcttgttaagtacttatgtgtgaataagtataagaaaattattgctaatccatagtatatagcttcatagtcagatattatagtgattccaaacaatcacagactgtccacatgggtcactgaggtagtgaaacatttgctttctgattgttcaatgtataccaactttgtttcatttataaaattatttaaaaatattgcataacattacctaccctgaaggtaaggtttttaaattgtaaaaatacaaaatgagtatatgaaacataaacaaaccttgtgtttacacttggatcccatcaccaagatatctcattatgtatatgtaaatatttcaaaatactaaaaaatctaaaattcaaaacactctcatgcccagcttttcagatgagggatactcaatctgtatacaaaaccttgtaaaaataattatttcttgtaattctaacaagtagacttaaatatagtgattcttaaagttttttttaaatgtcatatcctattaataagctagtaacatttttttgatattaaaaagtataattgattggtattatacttttttattatactttaagttttagggtacatgtgcacaacatgcagctttgttacatatgtatacatgtgccatgttggtgtgctgcacccattaactcatcatttaacattaggtatatctcctaatgctatccctccccccttcccccaccccacaacaggccctggtgtgtgatgttccccttcctgtgtccaagtgttctcattgctcaattcccacctataagtgagaacatgcagtgtttggttttttgtccttgcgatagtttgctgagaatgatggtttccagcttcatccatgtccctacaaaggacatgaactcatcattttttatggatgcatagtattccatggtgtatatgtgccacattttcttaatccagtctatcattgttggacatttgggttggtatttgttattgtgaatagtgctgcaataaacatacatgtgcatgtgtctttatagcagcatgatttataatcctttgggtatatacccagtaatggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgacttttaaatgatcgccattctaactggtgtgagatggtatctcattgtggttttgatttgcatttctctgatggccagtgatggtgagcattttttcatgtgtctgttggctgcataaatgtcttcttttgagaagtgtctgttcatatccttcgcccacttgttgatggggttgtttttttcttgtaaatttgtttgagttctttatagattctgggtattagccctttgtcagatgagtagatggcaaaaattttctcccattctgtaggttgcctgttcactctgatggcagtttctttgactgtgcagaagctctttagtttaattagatcccatttgtcaattttggcttttgttgccattgcttttggtgttttagacatgaagtccttgcccatgcctatgtcctgaatgatattgcccaggttttcttctagagtttttatggttttaggtctaacatttaagtctttaatccatcttgaattaatttttgtataaggtgtaaagaagggatccagtttcagctttctacatatggctatccagtttcccagcaccataacatttaatgtatacatgtgcaacatatgaagtttagaaatactgaggtagtgtgtctgttggctgcataaatgtcttcttttgagaagtgtctattcatatacttctcccactttctgatagggttgtttgtttttttcttgtaaatttgtttgagttcattgtagattctggatattagcgctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttaatggttttaggtctaacatttaagtctttaatccatcttgaattaatttttgtataaggtgtaaggaagggatccagtttcagctttctacatatggctagccagttttcccagcaccattttttaaatagggaatcctttccccatttcttatttttgtcaggtttgtcaaagatcagatagatagttgtagacgtgtggtattatttctgagggctctgttctgttccattggtctatatctctgttttggtaccagtaccatgctggtttggttactgtagcctggtagtatagtttgaagtcaggtagcgtgatgcctccagctttgttcttttggcttaggattgacttggtgatgcgggctcttttttggttccatatgaactttgaagtagtttttttccaattctgtgaagaaagtcactggtagcttgatggggatggcattgaatctataaattaccttgggcagtatggccattttcacaatattgattcttcctacccatgagcatggaatgttcttccatttgtttgtgtcctcttttatttcgttgagcagtagtttgtagttctccttgaagaggtccttcacatcccttgtaagttggattcctaggtattttactctctttgaagcaattgtgaatgggagttcactcatgatttggctctctgtttgtctgttattggtgtataagaatgcttgtgatttttgcacattgactttgtatcctgagactttgctgaagttgcttatcagcttgaggagatttcgggctgagacaatggggttttctagatatacagtcatgtcatctgcaaacagggacaatttgacttcctcttttcctaattgaataccctttatttctttctccttcctgattgccctggccagaactttcaacactatgttgaataggagtggtgagagagggcatccctctcttgtgccagttttcaaaaggaatgcttccagtttttgcccattcagtatgatattggctttgggtttgtcataaatagctcttattatgttgagatacgtcccatcaatacgtaatttattgagagtttttagcatgaagcgttgttgaattttgtcgaaggccttttctgcatctattgacataatcatgtggtttttgtctttggttcggtttatatgctggattatgtttattgatttgcgtatgttgaaccagccttgcatcccagggatgaaccccccttgatcatggtggataagctttttgatgtgctgctggattcggtttgccagtattttattgaggatttttgcatcggtgttcatcagggatattggtctaaaattctctttttttgtcgtgtctctgccaggctttggtatcaggatgatgctggccccataaaatgagttagggaggattccctctttttctattgattggaatagtttcagaaggaatggtaccatctcctccttgtacctctggaatccatctggtcctggacttcttttggttggtaagctattaattattgcctcaatttcagagcctgtcattgatctattcagagattcaacttcttcctggcttagtcttgggagggtgtatgtgttcaggaatttatccatttcttctagattttctagttcatttgcatataggtgtttatagtattctctgatggtagtttgtatttctttgggattggtggtgatatcccctttatcattttttattgcgtccatttgattcttctctcttttcctctttattagtcttgctagcagtctatcgattttgttgatcttttcaaaaaacaaacttctggattcattgattttttgaagggtttttcgtgtctatctccttcagttctactctgatcttagttatttcttgccttctgctagcttttgaatgtgtttgctcttgtctctagttcttttcattgtgatgttagggtgtcaattttagatctttcctgctttctcttgtgggcatttagtgctacaaatttccgtctacacactgctttaaatgtgtcccagacattctggtatgttgtgtctttgttctcgctggtttcaaagaacatctttatttctaccttcatttcgttatgtacccagtagtcattcaggagcaggttgttcagtttccatgtagttgactggttttaagtgagtttcttaattctgagttctagtttgattgcactgtggtctgagagacagtttgttataatttctgttcctttacatttgctgaggagtgctttacttccaactatgtggtcaattttggaatagctgcactgtggtgctgagaagaatgtatattctgttgatttgtggtggagagttctgtagatgtctattaggtccgtttggtgcagagctgaattcaattcctggatatccttgttaactttctgtctcgttgatctgtctaatgttgacaatggggtgttaaagtctcccattattattgtgcgggagtctaagtctctttgtaggtctctaaggacttgctttatgaatctgggtgctcctgcattgggtgcatatatatttaggatagttagctcttcttgttgaattgatccctttaccattatgtaatggccttctttgtctcttttgatctttgttggttgaaagtctgttttaccagagactaggattgcaaccctgcctttttttgttttccatttgcttggtagatcttcctccatccctcctcctccattaattttgagcctatgtgtgtctctgcatatgagatgggtttcctgaatacagcacactgatgggtcttgactctttatccaatttgtcagtctgtgtcttttaattggagcatttagcccatttacatttaaggttaatattgttatgtatgaatttgatcctgtcattatgatgttaactggttattttgctcgtttgttgatgcagtttcttcctagcatcgatggtctttacaatttggcatgcttttgcagtggctggtaccagttgttcctttccatgtttagtgcttccttcaggagctcttatagggcaggcctggtggtgacaaaatctctcagcatttgcttgtctgtaaaggattttatttctccttcacttatgaagcttagtttggccggatatgaaattctgggttgaaaattcttttctttaagaatgttgaatattggcccccactctcttctggcttgtagagtttctgccgagagatcagctgttagtctgataggcttccctttgtgggtaacccaagctttctctctggctgcccttaacattttttccttcatttcaactttggtgaatctgacaattatgtgtcttggagttgttcttctcaaggagtatctttgtggcattctctgtatttcctgaatttgaatgttggcctcccttgctaggttggggaagttctcctggataatatcctgtagagtgttttccaacttggttccattctccctgtcattttcaggtacaccaatcagatgtagatttggtcttttcacatagtcccatatttcttggaggctttgttcatttctttttattcttttttctctaaacttatcttctcacctcatttcattcatttcatcttcagtcactgatagcctttcttctagttgatcgaattggctactgaagcttgtgcattcatcatgtagttctcatgccatggttttcagctccatcaggtgctttaaggacttctctgcattggttattctagttagccactcatctaatcttttttcaagatttttaacttctttgagatgggttcaaacttcctcttttagctcggagaagtttgatcatctgaagccttcttctctcaactcgtcaaagtcattctccgtccagctttgttccattgctggtgaggagctgctttcctttggaggaggagaggtgctctgatttttagaattttcagtttttctgtcctgttttttccccatcttggtggttttatctacctttggtctttgatgatggtgacgtacagatggggttttggtgcagatgtcctttctgtttgttagttttccttctaacagtcaggaccctcaactgcaggtctgttggagttggctggaggttcactccagaccctgtttgcctgggtatcagcaaatgttgatgtctgatcgttcctctggaagtttcatctcagaggggtacccggctgtgtgaggtgtcagtctgcccctactagggggtgcctcccagttaggctactcggaggtcagggacccacttgaggaggcagtctgtccattctcagatctcaaactctgtgctgggagaaccactactctcttcaaagctgtcagacagggacatttaagtccgcagaggtttctgctgccttttgttcagctatgccctgcccccagaggtggagtctacagaggcaggcaggccttcttgagctgcggtgggctccacccagttccagcttcccggcccctttgtttacctactcaagcctcagcaatggtgggcgcccctcctccagcctcgctgccaccttgcagttcaatctcagactgctgtgctagcaatgagtgaggctctgtgggcgtgggaccctccaagccaggcacaggatataatctcctggtgggccgtttgctaagaccattggaaaagcgcagtattagtgtgggagtgacctgatttttcaggtgccatctgtcacagctttgctgggctatgaaagggaattccctgaccccttgcacttcgcaggtgaggccatgtctcgctctgctttggctcacactcgatgcgctgcacccactgtcctgcacccactgtccgacaagccccagtgaaatgaacccggtacctcagttggaaatgcagaaatcacccatcttctgcatcgcttgcactgggagctgtagccaggagctgttcctatttggccatcttggaactgcctcagaaggtttcttagacagtggcctaggcagcttctacatgggcctttgtgggagctgcccaggttttgctcagtgttctgtttctgtaatctgcatccacacctgctctacccttgtttaggctgatcttggtctttagaaagaaacttggccataagtttatggtttcatagcttaattgtccacaagaaagaatgacctggatcaaggatcttctttgattttctttgggaaaagtttgacatctgaccttggacaactgcactcagattctgcggggtgaccctgtgacctcaggtgccctgcacttccttttcctgagagctttcactgctctggactctccagaaccacaaggcaagggtttggctgcaggtgaaggatgtgaaccagtcctggaagacccagtggaaaaggaaagaatccccaggatgaggaatgggaggaagggtgagaggctcttcttagagaaagaaaggtggctggaggatcagagaactctgtgtgtgtgtgtgtgtgtgtgtgtgtgtgtgtgtgtgtgtgtctgtgtgtgtgtccaggatgaggttagtggagttccagagagacagggttgccttctggggctgagaatacggattccttggtattcaggctctggtcctgttcctctcctggtcctactcatcctgcctcccactcctcccttcctcctcattctgtccttcagcctttttgtcaccactcctccttcccctttctgctcccgctcccccatgtcctgtcacctccttttcctttcacacacagaggatgcaggtcaacactggaaagggttgctgcagtctgagaagctgaaggaatgttttacaccagcaggagaagctatacagctatggaaataaatatcatgtgtattgttgaaaaaaatagaacatatatcaatggaagagaagagagaattcagaaatagatccttacatatatgtttaactcatgattcttagacatgaatatagttatatgtatatatataatcacgtttttgatgattatctatctttacctccaaaatagggaacattaagagaacttaaaaagaagccacaatataggagatactatatttatatccaaaaaaggatttttttaatagtatgtatataatgcagtctgataatataaacagcacaatgaaacgatttggcaaaagacttgaatagatacttcagaaaagaagatacgtgaatggtcaattagcacatgcaaagatgctcaactctttagtcatccgggagatcagtcaatacaatgatgagataccattacatatccatgagaacaataaagttaaaaaggctgaaaataccacatgttggtaaggatataaagcacttggaagtcttacacttgtgggaatgaaaaatggtccgacttctttgaaaatctggataacagtttcttctaagtttaaacacatacaaatcagatgggcagtctttctgttatggggggcggggaggggcagggagtgggggggagggtccttgctcccagagctcccaagatggtggtgagccgcttccaagatggtggcaaaccttgtgttctctgacctggggttcttggcttcatggattccaaggaatggaatcttgggccatgcagtgagtgttatagctctattagaagctgtgggtcatggaagagaaccgtggaacccagtgactagtgttcagctcgattaggatgaacccaggcacttagccatgcaggaacaatggcaagccttcagcccgttagggagcggcaatgggtgcctcgctggatcaggagcaaagcagactccgtgccagatccggagggatggaagtcagccatgggtctgcgatggtggcaaacatcagtggtggacagtgagtgaaagctcagcttgagctgtaacaaacacggactagaagagtgtgcagttgcaagatttaatagagtgaaaacagagctccctacaaagggaagggatccaaagagggtagctgttgctggctcgaatgcctgggtttatatcccgatcattgtccctcccactgtgctctcaggcaatagatgattgcttatttctttacctcctgtttttgcctaattagcattttagtgagctctctttactacctgattggccgggtgtgagctaagttgccagccccttgtttaaaggtagatgcggtcaccttcacaactaggcttagggattcttagtcagcctaggaaacaagcatggtgtagccacacaaaggaatactactcagcaattacagcgtattaactgttgatgaaaatactcatacagatggattaatatgatgcatgaaagaaggcagacataaaagaacacaggtctaatttcatttacagaaaatggttaaaaacgcaaactgacctaacttgacacttgctccctggggtggagggttgaaagagtgatgaactgcaaagccttacaagaaactttgggcttatggaaattcccatgtctcgattatagcagttgttccatttgtgtatacatttgtaaatatgcatttaattatatattttaaagtgctgcagtctattgtacttaatttatacctttataacattgacttaataatcttaatatctccatactagcaattaccagatagaaaatgaaattcaataaaacataatagagattaatatcgaaaatcattgcatgcttaagaatacatataatgaagcagatacaaagcccctgaaagctattggtgagagaaattaaagaagagtaaatagagaaatgtatatcatgttcatggattggaagactcaattttgtgaggatatcacatcaacataattctgattaataattctagtaggagttttaaagaaatgtacatgctaatttaaaaatgtatttgaaaatcaaataatctagaataggcaagttggtcttgaaaaagttggaagacttactctgctagatttcaaaactcattttagagctacaataatttaaaagctatggtacgggtgtaagtatacataaataaagtaaaagaatacagattcaaaaaatacaccccctatgtacagttatttaaattttttagaaacaaaaacaccaatgcccttcattggggaaatgagagacttttcaatagaaagtttctgagtgaaataatatttgttgttttaaaaagttaatagtaacagccactttctaccatacattgaaattaacttaagatgtgaaagttagaattagaaaccttctaaaggaaaaaatacaaactattttcatgaacttgacataggaaaatatttcttagaccagaaaatatttcttagactgtagcactgaccacaataagaaatcagttaaattgtacttcatttttaaaaagcttctgcttattataggttagtgtttaacaaggcaaaacctatctggagaccaagaataattatttgcaacatatatgcatgttgcaaataaatatacttatatatattaatataaatataaatatatatatattaatataaatataaatatatatatattaatataaatataaatatatatatattaatataaatataaatatatatatatatattagtcttgagtgggtccaacctctatggtcccctctgtttggcatggggtgaggaagtccactctggccttagaacagcatggactgccaggcattctcagagagggtctcaacttcagcgcttcacatgtacatatatgaaacaatggactcattcaaaatatataaataactccaataggtcacaaagaaaatgataaacaacccagtatatcaatgagtggaaaaatttgaaaaggtgctttacataagaagatatctaaataaccaataagcatgggaaaaccaaaatatccctacacatctggtagaatggctaaaatttaaaagactgaaaatattaagtgtgtgggaatgtagaacgactggaaatagcctatgtttttcatagaaatgtaaaataatataatcattttgcaaaactctgtgtccgttttcagcctttcaccaagaaattccatccctagcgatcgataccaaggagaaatgagtatgtatattcacagaaagaagtgcataagaatattcagttacttatgcataagag

SEQ ID NO: 575 - DNA, 40001 bp, Homo sapiens
caagtaactgaaggtaaggagaacataaaagcagacataggaaagaaagattatctatatataaatttaaatttaaatttaaattagactgtgacttaccaaaattttaaaaaatgacagccagtatagaatgtaatatctttaatgtgctgaagctaaatggctgccaactagaagtcaaataaccagcaaaatgtatttcaagagtgaagctgaggcccagtgtgataggtcacacctgtaatctcagcactttggaaggcctaggcaggacgatcgcttgagaccagcagttcaagagcagcgtgagccatacagcaagaacccctctatacaaaacaaaacaaaacaaaacaaaaaaattagccaggaatagtagcttgtgcctgtagttctagctactcagaagcctaaggtgggaggactgcttgagcccagaagtgtgaggttgcagtgagcaatgatggtgccactgcactccagcctagtgacagagcaagaccctatcttcaaacaaataaacaaaaatgaaaacttgcataaggctgaattaagtacttttcagatattctgaaatctaaagaaaaattaaaataaacacacattactaaagaaacttctaaatacttgctaaaatgaagaaaagtaatcacagaaagtataaaatgtaaaaaaaaaaaaagtaaagaaaataggaatgtatacataaagctaaacaaatgttgaaatactaaatatttattacaaaatagtaaaagcaatttttggtatggaatttaagaacaaaacaagatagagttaacagctaggaaacaagagcaggaaaacagagaactggctaaagagatgttgaataatattagactttatcagatatgcgtcttaaaatttcagataatcgcctgtcaaaaataaaatctgataaaattagaaaaatttttgaaaccatattgttgtacaactaaagaaaccacagattgctatccaggaaacttcaaaccaaaaatgactataataaataataatgcattgtatatttcaaaactgctaaaagaatagatttcacatattttcatcatcaaaaatagtaagaatatgaggcaatggatttgttaattagcctaacttaatcactgtatattataaacatatatcaaaacttcacattgtatcccacaaatatatatgcttattatttgtcagttacaaagaaaacaaaaaacctaaagtcgtaagaaggttacaggctcaccattacagaatggcttgtaaagtgaatgtgagaaagttgattaacactttcagtgactggttactacagtgaagttttcccgattgcagtggattggttagaagttattatattacttgtggaagatgattcaagttttgtttatgattttcagaagcatttacaagaaagaatctaagtttcctttatatgaaaaaaaccaagcatgattaaattttgcttttgtggcctaactggttttgtctgctcagggaaccccttggcctgatctcttttctatttcatttaacacacttaaagaatagattgtatatagcagaggggagaagaaaatctttaatcaatgcaaaatatttcaaagttacagaaaaagaaacaaaatgcagatacttaaaagcacacaaatagatggcaaaaagaaaaaaacataatcagaaaatgtacaagtgttaaagccttctgttaagggacatatgattggatataaaaaatacacatatagataattttcaaaatcctaacaataacaattgctgatgaggttgcagaacaccatgaattcttcatttattgtggtaggaatgcaaaatagtacagacaatctggaagatagttggaaatttcttacaaagctaaacatagtttatcataagattcagtaattatgtttctacatctttacctaaatgatttaaatgtctgtgtccctacaaaaaccaggatacacattcattcataatcataataaattggaaggaattaagatagcctttcactggatggataaacaaactagtacatttatacagtttgatactattaaataataaaaaagaataaaataataataaaaaataaaataaaaaataataaaaaaaccatcaagtcatgttaagacatggataaatgatagatcatattactgcctgaaaaaagccaatctaattatatatataatatatatataatttaaatataatttatataaaatatatatatttatattgtatgaatcctttaacatattgtcttagtcagtttgggttattataacaaagtaccataggtttggtggctgataaaaaacagaagcttggcagggcacggtggctcatgcctgtaatcctggcactttgggaggctgaggcaggtagaagattaagtaattcagtacgttttgtaggattcctgaaggctgaagcaatgttatctatctttgcttctcctttaccactccttgcatctctgttttgtcatcaatatcatgttgctgtatgatcagttgacacaaagcatttaaaggaagagacacatatgtgattagagtccctatactcaatgaattatagttaaattattaaagttgcaaaagactgcaaacaggaatctgccgctactttgcaccaagatcctaaacatgttactgatttccttaaactgaattttttcatttgttaattggaagtaacaaagacatttaattctttcccaaggctctaaagttataattaaataataaaccaaaaataaataaaggatagatgtgaaaatgcttcaaacacaattaataataaagcacttgtttactgtgatgtaagctcgacagccagccatagttgccacttttgcactcgtctttgaggctccctggagttttagcaagtacaggctgtgtccttcttgatggagcattcttcacactgcagggtccttgccaggtccattttacaactttggttttaaatatatggcagaaattttcacatactattttagacaatcggttatagaatattttgctcacaaataattcctgatatatttcttatataagattaactatgacattataatcatatcccatgcttcagctatatgtataaaagcatatgtatatgtatatttgtatataagcgtgtgtatctacatgtttgtgtatgtgtatatagataaatgtgtatctatcatctctgtgtgtgtgtatatatatatatacacacatatatgtatatatgtatatatacatgcaaagattgatatattgctgaaaacactaatactgcagtagagcataaacattgaatttaacttttttttctttttcatgaatgattaatactaattcagacattttgttttacctaagaaacttggcaacatttgccaggtattattaactggcaagtggtataattatgaaactgagagctggaagaagctttaaaatcatcaagtaaaaattaccaaattctcaaatgagctaaattgtgagcaacaatttcaaaaggtttttattccatttattttctgagtcaaatgctaaaataggaattttatgcaatgactttctaaagtaattattatcaactccaattacaattaaggaatgtgaggctgagagagctctatcatgttcaagtttgcccaggtattaaatggcagagccacgttgaatacacatctgtgtgactgaaaagtttgtatgttccctgataagccatgttacatagagaaattaccaaatgattcatgctagaccatgataccagtgagacacagagctgagtctagagctcagtgccatttctatatacactatgtaattggtagcacccaaatatgctaataatggtagttaattcctaaaaatttttattttaatagctctaaccagctacaaagatatgtggtcaataacaaaatggttgtttgtgagcaacagaaattatgtattgtgttacaggtttttgtaactaagttgaaaacttcagagataactaaaaatattactttcaattgcagttcacatgctattctgttcacattttatatttatgcatgggtacatttgacattttaaaaataattatttaactcaaagtagtcataaaaagttttcaattgttttctaaattaagaaataataaatatataaatgtgaatgaacttaatgttcaaaaaataaattttgtataaatattcagagtacttggaaaacaaaaagattgttgtagtacatttaaatataaacatattcattttaaagtttacttgctttgccacaagttttgtaaggagtgctattcacatacaagtattgtaaagagctatttgggatggataaagtgttactttttggctgagcgcgatggctcatgcctgtaatcccagcactttgggaggccaaggtaggtggattacgaggtcaggagatcaagatcatcctggctaagatggtgaaaccccgtctctactaaaaatacaaaaacaaaattagccaggcaggcacctgtaggcccacctactcaggaggctgaggcgggagaatggcgtgaacccaggaggcagagcttgtagtgaaccaagatcgcgccactgcactccagcctgggcgacagagggagacaccgtctcaaaagaaaaaaaaaaaaaaagtgttactttttaacatttcaattacaaaaacttgttttatattttattaaaacaatatggtattattctaaaataacatatttctcttcttgtttttcagcaatggcttctttaaaggtaagaacttataccaataaatctagattagtttcatgtttctggccccacaaatgtcatagacagatttaacctctctgttgtgtctaaatggatccaaaatacgcaggttttaaataaatgttatcaatccaaattgttgctaggcaatctcaaaggtccacatatttggaaacattcaaaatgtgaaaggaaaaattgtaacatgctatgaaaaggaaagtagaagaaccaaagcacctatggtatggatttcatatatttattatcattcattagagtgaaggtttctcaaacccttcttcggaagtaacatcatctcataggaaaaacaagcactcaggtattggaaattaaggagacaaaaaagttaaaatcataattaccacctacttctgaaaatgaaggcaccaaatgtagccctgctatccaaaaagaaaatgcactgttcctccttaagaatgaacccacaccacacaggagtctaacactttatcgacaaaagccttcaaggagtcaaccccagtgggtcacagtgacatacaaagcagcagagtgcagaagccttctttggttctgtgcactagactgcaaactgagaacagagtccaccgatctaacatgaggaagcatgcacggatcagctatacttttgccctacaggtagtaaatataaacccccaacagaactgtatttgtgctgttctcattttttcgttttttttttttaaattacttccatagtccaataatcagtgatttatgaagacagttcattacccagttgaaagagaaaagatgacttttcacttcatgtagttaaggggaaaacataaaagaaacaaaagactaaaactccatgaagtgaaaataacaagataccattacatacataccaataattactacatacctactagaatggcaaaaatctagaacactgacaacaccaaatgcttatgaggatgtggagcaataggaactctcatttatttctagttgcaatgcaaaattatacagccctttgaacatagtttgccagttttctatgaaactaaacttttattttacgttatgttatgttatgttatgttatgttatgttatgtttgttatgttatgttgttatgttatgttatgttatgttatgttatgttatattatgtgatgttatgttattttttggcagggtctcactctgtagcccaggctagagggcagtggcatgaactcagctcgcttcaacctccgcctcccgggttcaagcagtgctccttactcaaacctcccgagtagctgggattacaggtgcacatcactatgctaggctaatttttgtattttaagtagagatgggagtttcgccatgttggccaggctggtctggaactcctgactgcaagtgatccgcccgcctcagcctcccaaagtgctgggattacaggcatgagcccctgcgccaggctaaaactaaacctactcttaacttacagtccagcaatcttgtttattggtatttacccaaaggagtttaaaacttatgtgcacgcaaacatctgcacatgggtgtttaggtgtttacagcagcttcactcataattgcccaaaattggaagcaaccaggatgtccttcagtaggtgaatggataaactgtggtgcatctagacaatggaatattattcagggttaaaaagaaatgcgctatcaagccatgaggagatatggaggaactttaaatgaatgttactatgcaaaagaagccaatctgaagagggtatacactgcataattccaactataggacattcttcaaaaggccaatctatgaagacagtaaaaagatccatggttgttaaggaatggacaaggaaggaatgaacaggcagagcacagaggattcttagagcagtgaaactaccctatatgatactgtagcaatagatacaggtcatcatatatttgtctaaacccatagagtatacaacactaagactgagccctaatgtaaactatggactctggatgttaatgatgtgtcaatggagattcatcaattgtaataaatgtatctctctggtggaaatgttgataataagggaggctatgcacgtgtcaggacagagtaaaccggaaatttctgtaacttctgatcaattttgctgtgaacctaaactgctctaaaaataacatttattttaaaaactatgaaataagcttattttctgatcccaaagcaggatctcacaataactgtttcaatataaggcctatatttggaaaccattacaaacttctaaaaattgtcacatttgataatattttaaattaatcacatatattgaggaaaattacatgaagagatctccaaaatcatgggcttttgtttatttgttctgtgacttatttttggaatttcttttatgatggcttctcttcaggataaaatgaggaagctaattcatatccctggggtgaagaatttcagataattcctcgtgagtgatgttatcttcccaactcttttacccttttcattcaatctgaagagatattgaatattattaagattattatttcaaaaggactttaagacaattattacatctccatcttcaaaagacaaggtccatttcattctccatttgaaggacaccagctcttcacaaaatgattctctgtaccttgaatgttgaatgaggcgcttttctcttctgccttcttcacatactatccagtaaaaaacacagtgctgccacgagaactttgcaaagaaggccaatcattacacagacgaaggctgaaactttaactcacaatattataacttttatttttttttcagttaccttcctttctaaaaataaaatatgagtgtctacttcaggagactctggatcaagcccaattagctttctattatttaaaaacactattgacctttaaaatcctctctttgcaaatattcaaaccagggagtacagcacttattaaacagcattttccagtttgtttcaattattttttttttctgctagatttttaactcgttgagaatagagaacccaaggctggtatatacccacacacacccacctccccaatgccaacataaatcctggtacattgtggctaatcatttatgtttaattgcattgattttatacttaattcagatggtcagatgtagatcagcttgttaaaacagatatatgataatgttgtatctgaatttatagagcgttaatcatgccaacattgagactgttcaagtatttttttaaaaagtttacgtgtttagtcatttctgatattcctgtcaatttagcacatctcttttgaatcagaaaatactttggttcaacttcctctgatttgtttatgctgttagggaacccatgggtaattctatagcaactcagcctgtattctgctgtcccctatatagaatttttctcatcccctccactttctgattaaatttcctttccttaaactatccttgcttcttttctttgctgcctccaaaattaggtataggacaaaactagagggaaaaaaggggcttattttccccaaaacttctataaaatattttagtatatatgtaaggtcatcaggtcaattaatttaacaaacatttattgtctgttctgtgccaaagttgtgtgctaggtggtgtgaattaagaaagttttgctctttaaaaggagtcctaatgtaatggactctattgtacatatctaactattctttttcacaggaaactctctaattattttcctctctgtattattttctgtggttgttttgcggttatctgaaaattccaaatttaatttaattaattaatgatcagacttactaggcttgttatattcctttctagtctacatattaacccattccaccattacataataataataatagtaataatgtttattgagtgtgtattaggctgcagcattaaacacttcatatacaatattccatttagagttgttaataagaaccataatcccaaattttacaaaagctaggtgacttggaaaaatttacacagctggtaacacagctaggtgaagaattccaaacagctatttctgactctggacactttatcctaacacaataaacactcatcttactaaattaaaacaacatgcaacttggtacattttcttctcacccattaaaaaaaattaaactatttttgaaaatgacttttatttctctcctttgcttcccactttcttatggataagtccatttaaagaataatgaatcaaccggaactgagcaaaacaaaaaggccagaaacatgagggggaaagaatctcaagtgccaactgttttgctgtcattgttgtttttaagtgaggagttcagtaggcttttcacatatacattttaaagccctagttacccttgtgagagtaagacccgatgccctctatccaagaccctgtcaaaaatgtctttgataggcatgagactatgccagaatgctttagtttctctttaaaatagacaaaatttgtatgcacctcacaagataaattgagcaattcatcattttctgttgaattcttaaagaaagttgggtgaaaagtgataagtaaatgaataataatagaaaaatgaggcagtgctgtgcatgattggatagcttattcaatcaaacactttatgagataatgaaatttctcattatcaaaagtctgaattcattggatagtcttattcattgtataagtctctattgagtatgtataaatctatgttgagtatagcataatttataccgttatatatatataatacacacattgactatagcatactttataccattatatatatatacacatatagacatatatgtgtgtgcctacatatccatatacttatatatacacatatacatagttttagaatgctctctagtttcacatgttctgtaagttaaaattttattaataactttcttcctcatgtaaacagtgtttcatcaaaatttttggaaagtcaacattttctaaaactttttaggtataaaatataattatgaaagttttgaccaaaataaaaataaaaagccagtaggcaacaaattggaccataattttcactgtattagataagtcaaaactgttcaggacaaagaaatataacagactcagaacactttgaatattaacaaaactttttcttgaacacaatatctattgaaatcatattaaggaaagagaaaataccacaacatttaaaagtgtcaataatggtttaatatagagcatgaatgcaaagggaatagacagcctgtgcaaacataagcttatcattttcttcatatatcaaacaatacacattctgtagaataagtacttggttgatacatacaggttaaacatgtgcataactacacaatcaagaaaatcttaccacttctgtcaatacactctatgcgaagcggcaataagatcacacttaacaatctccagaagaaaatgagagagaatgaaacaccaaaagcaataggtcaggaaagaagcagagttgtgagtgggagaggaggccattatgagtatcagtaagtataacaaaatacatctgaaatctataagctgctcaacacatatatttggaatcacagaaatgaaactaattatttcccgggcatttcaaataccaaaaagtattctcaaagctccatttctcccctttgccttggtacaaagtgtcttttctatccatgtcttcctgtagaaggtttcaagtttgattttttatatgtatatcaacagaagccttaaatattaacttcagacctcaattattactaaatcataatcagagtttaatggaataacccttatgaaaaaataaggcttattctgcatcgattatttcaaagaaataaacatggtaaagggaggcatagtgtcaccaactttgtaagtggtgaaaatacacagacatctaagctgaacaattaaaggaaatccaacagagtattaaagttaatagggaagaatcaataggaaatggtgatatgataggaattgaagttgacacttctaaatcagatagataaagtggatattttgttcagtcgatataccagcacggctttgtgtcagaattacatgttggttagatattttaatgaatcaaatactggttgagctgaaggccagtcatcaacctggcataatatttaaggtcctcacagtatgttacaacattggtaatatttatacaaatagagaaataatctaagaacagtttatcttgattatattgtcaccagtaagaaagagttgattgatgatcagtcactacaaagaaacaaataggaggaaaatgtagtaggctaagctgctaaaaaagagtacaaagaaatatttttaagtattcaagtgaaaaaaatcaaacaattttaaaaaataaacttcagtcataagaactgtgtaaaactaaaacattatgcaattataatcaactctattgattatgtgattatccattttgcagataccagaaccaagacttcctagctggactaagcaattgattaaactcgctacctgccgccttctgctcttgccaccctccatacccaaagaagaaagaaaggaaacaaaccttgtggactatccacaggataacacaagaaggtagtgctcaaccactgcttcaaaaatcatttcttaacctacatgaatattgcataatttaaacatctccatgcatgcaaatcggttttgctagatgataagcatcctgagaagttgagcatctgcaattagcagctgttatctttaaatgattttactgaggtgaaattcacaacacataaaacaatccatttcaaagtgaatatttttgtcatttaatatattcacaatgatatacaatcaccatctctatctcattccagaatatttccatcactccaaagtaaagactcttacccatttaagcatcttctccctattcctccctctctcaagctactggaaatcaccaatccgtattctgtctctttgaatttacctattctggatatttcctataaatagggtcatacaatatgtgaccttttgcatctggcttctttcacttggcacaatgtcttggaggttcatccatgttattccatatatcagtaatttattcaattttatgactgaataatatcccattgtatgtatataccacaatttgtttatccattcattagttgagaaaaatttgggttgttttcacctgttggccattttgaatagtgctgctataaaatgtgtgaccatgtacctttctgagtatctgtttttaattcttttgggtacatatctaggagtggaattgaagggtcatgtgggatttctgtttttaactttttgagaaaccattgaattgtttttcatagcaactgaataattttacattcccaccagcattatacaacggctttaattttttcacatccttgccaacactgtgtgcatgtgtgtgtgtctgtgtgtttacaacctaatgtgtatgaagtcatccctcactgtggttttgctatgcatttccctaatgactactgatatgagcatctttttaagtgtttgatagtcatttgtatagtttctgcggtgaaatttctattcaagtcttttaccctctttttaattaggtggtttgtcttttgttgaactgtgttctttatatagtatgaatattagacttttatcagagatatgattcacaaatattttctcctccattctagattgtcattttacttctttgataacatttttggtacatacaagcttttaattttgatgaaatccaatttatccatatttatgttattgatatcataactaagaattcgttgccaaatccagggttatgaagatttaccccatgatttcttccaaaagtgttaatattcatgcttatatttatgttttcagtccatttggggttaatttttatatatggcataaggtagagattcaacttattttgcatttgaaaatccagttgaaattacatatgagcttgagaattggcatttccatttctgcaaaaagaaaaaaagactattggcatcataataaggatagcattctgcattgaaactgtaaatcactttgggtagtattcatatctcaacattacttttacccttctatgaacacagacgtctttccttttgtttgtcttatttaatttctttcaccaatagctttcaatatattagctaatttaatttctagttattcttattctttggaatgttactataaatgaaattgtttttgtaattttatttttagattacttgttcctgctatatagaaacaaaactgatgttttctgtgttgcttttgtaatctctaactttgccaaatttgattatttgctccagaatcttgtgtgcgggtatgcacactcacaaacgtgtgcctattcttcaagattttctatatatatgatcatacctgcaaacaaacaattttacttcttcctaatttggatacattttatttctttttcttgcctagttgttctggttagaacttacagtacaatgttgaatagccatggtcaggatgggcatccttatcttgttcctgatacagtctttcactatcgagaataatgttagctataggcttttcataaatgtctgtgtttaagcttttataggaacaaatataacagcttgcaaataaaaagatgcctgtgttcaagcttgaaaactctctaacagtttaagctgttacaacaaattaccatagactggaaggcttataaacaacaaaaatttatttctcacacttctgagggctgggaagtccaagataaaggtgctagcagatttggtgtctggtgagctgtttcctgattcaaggatagccatcttctccctatgttctcacgtggttgaaagggcaagggaactctcctccagggtctcttataataaagacactgatgtccttcatgagggatctgtcgtcatgacctaattaatctctaccaaaatcccacctcctaatcacattgggaattagaatttcaatatataaattttgggggacaagtattcagccaatagcaacgtctttcatcatgttatggaagttccttctatttctttttcttttcttttcttttaagacagggtctcagtctgtcacccagactggagtacagtggtgcaattatagctcattgttacctcgaactcctggcctctggcctcaagtgatcctcccacttcagcttcctgagtagctaggactacaggtgtatgtccctatgactggtatgtgtgtatatatatatatatatgatatatatagtatatacagggtcttgctatgtttcccaggctagtcttgagctgctgacctgaagcaatcctcctgctcagtctttctaagtactgagattatagtcatgagccactgcatccaaccacctaatttttcatgagcttttttctttatcataataggatgttggactttgtcaaattattttagaagatgttatttttgagaaattatatattttttaaaaaaacattgactaagaaaaactatctgaaaagctataatgataatctagttcttgtaacttaaaaaaatgtatgtgtagagaattgcatggcaatcatgagccagtaagctcaaactctgagaagataatagaataaatcatctaataatcaatttgtaattatctagcagaatataagttagtagatagcaaattatatgaatttaggaagtacaaataaaatctgaacaaatttaattttttctatgagacaggaaaaagttatataaagaggctagattagttaatattagataatcttgtgtttgagtaatgctgtttttttttttagttcatagaattgccatttataagccagaaccaaatagcattagtttagaagagatttctactgaaggcaatatcaaattttaagtgtcattggtacataagagaaactcagcatgtttgtacatattaaaggagatgtaaataatttccattttgggtagttacaaataaagctgatgtaaacatttctgtacaaatttttatatgatgatgtttttctttctcttgagtaaatatctgatgtattggttttcctttgccactacagcaaattacaacaaatttgtggtgttaaacaacacctatttattatctcattattttataagtgcaaattttacgcacggagtctctcaactgacttgtctgcttagaatctcagaaggttgaaatcaaggtgtcagcagaactgcactgctcacaagactatggaatatttgttgtcaaacacattcaggatgttggcagaaatcagtccactctccctcttttcatgcagtcccctccattttcaaactagcaaggttcattgagtcctcatgctttgagtctacctaattttctcttccttcagccacaataaagctccacatgtaacagatcatatgattatattgctctcctgaatagtttagaattatctccctattttaaataaattgattagtaaaacttagttagatctgcaaggtccaatttaccacataaagtaacattccagagtgtaataccagaagataaagtttatgggggccaaaattctgtctacatgacttgggccatgataattgcatgtgtaacttactgaaaaacaaaaacaaaaaacagagaacactggatagctgttgtctgtcttgcacagtttttgccaagcgatctgctgtaattaatttttgctcctttacaactagtgtgtcttttttttattgtcttcacaatttttctcttaatttctgctttgtactaaatgttttctattaactgtcaccactaccttatcagtttgagtataatgtgtctgcatgtatgttttcttttttaaaaaactattttctgtttgttttggcttggtttgcttttcattctgtgtgaagttctcttagctggaattttgcatttcatgtccctttcattattttagaaatcctcagccatggtcttttcaaatatcttttatcttcttgtttctctctcttcttcctgtaattccacttaggcacatgttcacatttcatattattctgcatctcctgatggtctactctgtcttcttttttttttcctcttctctttctgttttaatttatataattcttattgacctatatacaattttatcaattatttccttggttctgttgaatttaatcatgagcccctcaacatcacactttatctctcttactatgtttttactttaattctagaatgttactcattgttttttcttttttttttttttttttttttgtcttggctgaaatacccatcagtctcttaaggcattttgtcttttcttttaggggcttaaaaatattactcagaaagcattttttaattccttaacttacagtttcaatatctgggtcatctctgaatcttctgttgaatgctttgtttcttgtatgtttggcttttcttctgtcttgtgtaccacataatttttcactgtatgtcagacatagtacatagaacaacagagacaaaggaaagaagtatttgtgatgaaatgggcatacctttttctctactatgactttaatctgggaggtgagttattgccaggaagtatgcattatttgggtattgttttgccatagatacttatagtgaatcatcagctctaaattcccccagtagtactttgtatttagggttttggttgaattatcagggagcttccctttatggtccagctccactcgcagctttatcccttcactgtgcttttgcatctcatggagagtgtctctccatgtgcattatcttaccccactgattacttatttcttgttacttaccctcactggcatagtagtggaaggtaagtaacttatctctttttccgattcagcctcatttttatgtagggccttcatccctggtactcaggtatgggattttctcagttactctaattttcctcctgtgatagatttataatggtcctaacccatctcttagtgacttacttctgttatttatgaaatgttggattgggtatatctctgtgggtttttttgttttgttttttgttttattttgttttttcctgtggtagcttcccttctccaaggcttatctactaaaaaatgctctcctggccaccctcagtatttctcatgcccactcaggaaggttgtaaagttgagcttgccatgtatgctgctctcagtgttccatacttgcatgtgagactccactcagatgttagcaatgtgttaaaattgtagcggacttgtttttatctgtttttaggcttgccttgtctactcctgcctactaacatgggtgttagtacttgtgccctatctttctttaaatttcatgctggctttttctgtgacttcaactctttggattcaagaaaaaataattttatatattacctagttttctctcattgctatggtgggaataacactcttcagttttctatgtatttagaagaggcctaaagccaattattgtgtatatacacatacatatatatatataaaatgaatgatcatatgatcatatgtttggataaataggtccttgaaaacaaggactgtgtttttatttacattctttttgtatacattgtctttgtccagagagtaccacatctcaagaccacaagatggcttccagaggcaatggggaatcaagcttcattaccatattttacaggaaagatgttccataatgtcatctctagactaagcaaattcaacgtaaataaaaggtgagaaatttcattccagtagagatacgaggcaaaaaaatcaatatcaagatgatctgaagattattgaaaatgtcagggaagtgaaatgccttttccaaaattaggtttctttgcaaaagaaaaagtctaatatgatataaaccaaaatattaaataatttgactctataggttggaatcttaaggaattatgcttttatagtaattctacaagtgaattattacttctaaatttcaaaaatgaagagaaaggcagtttcaatggactaaaataagttatttcttttttaagaaaaggaaaaagtttaacagatgtctaacctaaatattctaaccaataaaaagttggtcttattttagtttctttgtttgggtttctttgttttgttttgttttgttttggcctctttcattcacagggtttgcctgagatatatcagcaaatatcctagcctgtgctattgaccttgggtaacactcactcactcacaaatgtatatatttacttcccatcttttaatagacaatctatatttatgctctggcacaactttatttttttggatcttcaacccagaaatgttcatctttgtttttgcatgtaatcttctgcatgcactccctatacctgttgattttttacttcatccaagcctactgactgtaaatattggcattatcccttatttcttctttgtcttgacttttataatcaatcccttatcatgttctgcaaattctatctctagaagggtccgtatttccaagccccattttctacccactacaactttctcctttcatcattcctacctgaatcattgcagtttcagccccactgaccttatcatttttcaaaattactcatcacagaggatctctgtcatttttcaaaattactcatcacagatctctttacaaaataagtgaactcatagcattctatattttaacaaatgcaataatgtctcatatcttgcagaattaagtggggctctaatgtatatagtctttcctagactctcattattttatttgtctgcaagtcttagattgggttatattattcacagactgaatgtttcatgaagactaccttgagctaaaccctaacctcgaaagatctgagctaaatgctcttcctagcattcccagcctttatggttaccaggagagtcaactctgacttcatttctgcaaacacttcttgagtgtttaaaatatgccagatgttgtactaaatattttatgtttttgtcattaattcccacaattgacctatgagatattaactaccgttttcttaatttgattgctgaaatacttattcacagagagattaaatggcctatattcacatagctaggagatggtagagccagtactaacatccaggctgactccaggatacaggctcctcatcacaaaaataccctctaattttattgatcactcgagtgccagagcaaatatttaatacttctaaatattatttattcctctatggtttaatttgaaatgtctaatttttcttcttaatggtttgcaagttttgaaacaagaatttttattctattacttaagtctgtaattcttagcagtacattgtacatagttggtattaaatacatgttgggtgagtcaatcattttattcttacagaatctcctaatcttaattaatgttagagttagctgatgagttaatcctagtgattcttatcatgccactagtttgctcaaaaactttcactgaatctatacttcttttatataaaagccccaatttctcacactagccttgggtaattccatggtctacagctaacattcctttcaaatgtcatattacactacctttctttacaaagactctgctcatccaaaacttgctgttttccttatatacttacttttttccatctttttgctttggctcaacaggttccttacatctaaaaggcgtttctttttctcaccttcaaatgatcaaattcaaaattcgagttttctgttttactcatgtcagccatctaaacagctatgttatctgcaccatttcagtgatccaatgtctaatttatcattgtttctccaatgtgatatatgtcaataccttgcaagtaacaggatattcaataaatggtaaataagacagtgagaggggataaaatcttagtataaattgtacatatcccaaacttaagcaacatgacataacttttataaatgctttaaatgagatagtaaaatatatcattaaaatagagataatagtcttttgaggaaaattaaatggacttggattaaacctagagaatactgtaactctaatatgctttattgcataaattataagtaattttacaacacaatgaattgaaaagaaaagagcattaacaaattatgtctttagaccagagattagaatggagaaagattttattccagtaaggattgaaataattattttgtgggagtatatacaaactccattgctactcttataaatatttctgattagagagaagagtctttctagatatgtagaaggatatgctgtttttcgacagcgtatagtgtaaaacaaacacaggataatataaaatcagaattgagttcacttaaactacaaatcagacttctatttcaaaagttaatgagaaactatatagaagaattatataggtgtattgggggaaaaccaattagtttactgtgctagatggattgttggatttgaattagggaaataagttaaatatgaaaagcaaatgctattactctctttaagatattctaagtttaatcttacaattctaaactttgtactagtaacttgactttgtaggcaattctatgcaaagaggtaaatttcagaggtcagttttggcttatatttctaaactgatgcattgctttttttgctttccagtgatttaagaaggaaagagaaaagattatactcatttatcttcctaacaatatctgccttccacaccatactctgcatctctaagtttaatttttcaaatagcaaataattcagtagagaaacggcctttctaagggaatatttttgtggcaagataatttttgaaatatccatttatgacttctttttatatgttagctatttcttttctagtaggctctgctctgcttgccttgtgaaagatttgtggtgggtcttccaggcttttgtttctgaacaagatttactgagacctattgaggagaacatatttttaaggtaacagaagatccagtgagaataggaaaatgggagaataatgatttatgcaaagtattttctcaaatatcagaataaaataatcacccctattcaaagccatacctcaggctttagaagatagagaaaaggggacagctggggtcatcctcaaagacagaccatatactgaatggtatgtgtagctagaataataatagagaaatgtcctatcaaagccaaccttgagaaacattgctccagaaccatggaatttcatgcaaaataaggcattatttgaaaacataattatattcttctattgactgagctgaggtgtgtgtgtgtgtgtttaaaggtgaatttaccttcatcagcagccatttatctactgactcttatcctccattggctgaggatatctcaactggcattaatatcctcctatatatttaattgtatacatagaattatccagctgccatcctcaaaagtaacatcaaaaaaatatcagaacaggaaacaaggtactttcagagaacacaagtgtagatgaattgttaccaccaaagagtagggagtagggaggggaagcctgcatgcaattaccctttatacatgtgtctgaagccagaaataaagccaagggaacaaggatgttaatacaaccaaattggcagttcaaaagggttctggcagcagtgtggaaggtgggttagaaattttattgcatgttgtcagacaaaattgccaagatatgatgagctcaaaattaaaagtatgacagcaggaaagagatacacagatgaattggaacaattttatggagatgtataagacagccctgagaaacaaatagaaatgagtaacaagagtttacagcaggtttttaagaatctggtagatagttgagatgttctctgacatgaaaagggtagagcactttgcaaaaagtttgtaaatttcatattggacatgttattctgagaaatctgtgagaagtacaaatttaagctttcagagttaaagagagcgttctcagctggacatagtaacattttagatttttttttaatttttgagaaaggaatgttttagtataaataattatcaggaattacaattaaagaagtacaaatggtcataaattgtattgaaactgtatgtttagtgaattaagtcactgaagaaataattaaattgtacaatatctgaaaaatgagaagcttgtgcagaaaagcaggatgtataaagatattttcttatgttggcacacagttttaaatttccagacaacttgggaaatatatccttatttaatatccaaatcagcttattaaaggcactttgggagatattatttttatttggaggatagagaaactggtggccagagaaagcaaaatgtctctctacagttaataaccagagttaattacatagatgtggtgtcattctcacaccatcactccatccattatgctctattttttttcaggaaattatagataatatcatagttactcagtaattagttcttccctacacattataaatgttatttttaaaagccccaaatttttttatctggattccagggtcgatcatttgaatctagcaataacaaactaccacaaacaggatggttaaacacagcagaaatgtttttgtcttaaagtcctagagatatctgaaatcaagagatcttcagtcctaaacatatctgaaatcaagaagttagtagagccatgcaccctctgaaacttgtaaaggaatcctttctttactcttcctaggttcttgtgatttgccagcaatctttggcattacttggtttgtagaagcatatatagctccaatctctgccttggttgtatgcagtgttcactctgtgtaattctgttttcatatagccttcttcttatagagacacaagtcatattggattaggagcacaccctactccaataggacctcatcttaatgtaatgaattacacctccaactaccttatttccaaataaggttgcatcccgggtgattgaaattaggaatttgatgtatcttttttttataacaacaaaactcaacccatagcaccaaccatatctaagtatattagtaaatattgtgtacctctaagtttaatcaaacaaatgtattttaaatattggaagacacgtctagaaaattcagagataaaacttttgtataaattacattaacataacccccccagaattttataatacttaattgacaaaaacaaaagaatgacttatcttcttacattctaatttatataattaatatttttattttccatggtataaaacagcatgctttagttttagtttactttctataattttaaaataatttcatgataaagacataaaaagatcattttcactatgttgatttaaaaaggataatgtaatttgcattttgttttataaacaaaaaaattaccatgagaaaatattatgtatatataaactaaataacttaattaacagttttaaatatatattttaaacaaataacatatttgctatttatacaaacatgtcttttttaatgagatgattaattcatgtaaattcatattatatgcataaaaccatcaaaataatactgactttagtctttacttgattaaggactaaatttaatgtaactctttgtagactgacatagaacatatattcaaaatattttgtaactaaagacatagtcatactgttactaaaagttcattcaaaacattcaaaattttttactgcatttaccatgccattgagaaaagtagatgtttactctgctaccaaggaaaatggtttgaggtaactacatcagaacacagaacaaactaaaaatttaataaatcttacattctatttctctccaaaatacatcaggtacatgtttactcaacaaaagcaatccaaattaatgaggtaattggaaattcagcagttagaaatccatattttttctcctttttcattgtaagtgtaaaataaatgaggtctatatcactgcttataaatcacagttactttaaataatgactattcatgtgcctaatgtataggaattatagtaggaaaatattcatttttataaatttttttcattcaacactatgatatgccaattactgttactaaacgcaagcaacacacataacacagttaaaagagaaatcagcaactcaatgaatgtcaaaggtactatgaacaaacacaattttcaactaattttaattatgttggcgaattctgctcaagtgctaggtatgtggagtcagttgacctttgatgcccaatccttaactattgggaaatgacactaggagagctcttgtcacttcccttatgcaaattaaagaataagcaaggagctatgctatctattctcctctgtgaactattgtttaagggttgtagagccaaagatatagttgctggcttttaaaaattagtactttgagaaaataagatgaatgaaatcaagtcaagttttcctttcatcaattatagattaaataatttttgtgtgatgatctaaaattctaccaattataaatatagtggaaacatggtgaaataggtaaaagctagaaatgcatgggttcacaggtaggctcaatagtctttcatttagattttcttctgtgagccatttaacttctcagtcttcattacctcatcttgcaaatagggaaaataattgtaacttcctcgtaggtctattgttaaaactaaataagacaatccatgtaaagcaactgacagacaataactgctgcatacattttagctgtaataatcataatgtagtggttctatacaactgtttctatgagaaaatattaatacctagaaaatgctcagaagacaattctttcaaattctcaaactgtgtacttttttataacaattattaattatcattatataaatacattattactcttaacacatttctagcttatacctctaccctccaattaataattgtggctccactatgatcccaagtgaccagacagatataaaaatggtcagtatgcttaacataatctaggaaaatgtcacttttagtcccaacttacaatatgtacagaggcaattttaggccaaacttaattcaatttaacagaataaaatatatagaatgtttcagaggatttaagaggttagataatggaatgcaagggaggtgaggctgctggaagaaatgtgggactccagaaaaaaatgagatatttagatggaggatgaggttatatgatagggtatacaaaataattttccttttctgactacacacaaaagttgtcagaagcctgattattgctttttcaatatgataaaatgctaggttctacttcaaagtgtctcctgagtgacagcatgagctgctcatgaggatctggttagatccacaacataaaaaagtgttgttgtttctcataattgtttgtaattcactatactgagggaggatggtgaggtggaggggaaaaaacattaaaaacaaaattaaattttatgttggttttttaattcaagtaagcagctaattttaaacaatgaattcaactgaattcaagttatgatttttattacacaaatctgctcataatacatataagaatttctaccgttaacatctctgttattgatcacaataaaaggcttgcctattaaactacagaagtttttatttaaattgtccaagatattaaaagtaaacatgtttcctaaattataatcagatttaacctttgtagcttacaggtcatggaaactatgtcctataaaatccaatttaatggaaaaatctactcataagagaaaaaaattataatgttactttatgtagattctgtgactgatacatctttaaatcatctcatattaaaatataggaaagtttaagattatttatactctttcaggaaaaaaagataatccagtggatacaaaaaaagagtcaagttatacatttttggattatcatttcctgcccacgatttactattacatgaacttggggtggaagagcatgcatgggtgataaagtggtcgggaaacaaatgacctgtgaagaggtgaattcagttgaatagtctttgttaatatatttttcttccacggataatagcataaattggtctctaacaacagctcgagggccttctggcaaggactaagtgaccacccttcaagacttcagtctgtcaatcaaatcttaggaaaacttgtccttaagaaagaggagaacttaaaaaggaaataaaagaaaacttgaaaagaaaaaagaagaaaggggaaaagtggagcttgaaggacattattgactcagtatacagatcagtaaaaagaaatgaaatagaaaaatataaaataaataaaataatttgaagagccaaaaatgaaataaagttcttgggctgattttaacccactatgctgaatattttatgatttatatatactgtgatttttattatcaggttgcctactacaggtagcattactgaccaagaactcttgctgctacactttgaatttcatctttgtgttttgcactgagaacagttattctagacagaccattccttagaaacatgagcctctttttggactgaatttcacttaagaactgtccactggtgttgccaaacctttcatatactggaaggccatctaagatgcttcatccaacattttctttcttttcccttcactcagagttaggctgcattgcagtctgacagctttccccaactttcctggctacctacttatatgcttttacttatacattttcccttatgtaatccttatatgtttatcctgtcttgatattttgtattagtccattctcacactgctataaagcccacaactgggtggtttatacaggaaagaggtttaattaactcacagttccatgtggcttgggaagcctcgggaaacttacaatcatgatggaaggtaaaggggaaggaagaaccttcacacggtggcaggagagagaagtaacaacaggggaaatgccagacacttataaaaccatcaaatctcgtgagaattcactcactatcacaagaacagcataggggaaaccatccccataatccagcctccctccagacctctccctcaacatctgggaattacaattcaagatgagatttgggtggggacacaaagcctacctctatcatatttgtttctcaaagactaacacaaatttgtctttcacttaattactatattatctatgtattattttaaaatttgccatttcaaatcgggaataggatatgttagcataaataacattgttttgtgactggtctgttttctgagtagaaagtcagataccttgtcagtcacaggttattttcaaatattttttttcagcacctacaacagtgagaatacttcgtttgagagcctggactttaaagatagtatagcccatctccagaaagttaaccacctataccccaaaacacttctcttaacaatatgaagagtttcatatcaatatccctatgcttttatcaacaaaaggaaaaaatatgtggggaaaaatttgttctaaagagaaaacactataaaaagatttttttatttctaggaaaattcaatatctagaaataactaaaaagtcaagaaataatatctatgatctccaatgtaaataactcacttcttggcctctcagtctatattgtgagtcaagaaatataaatatgaataatcataattatttaaaaagttatattggctgtctgctatatttaaagcactgaataaaagcagccatttaaaaaatggcccagaatcctactctaaagagctctcagtccaataggggaaacacaaacatatattattttattatgttacattttatataagtttgtcgtttatcaaagtgttgtgggaagacagaggcattaatcattaattcagacatgaagagttaaagatagtttgacaaataagtttatatttcagctaagccttaaaggaaaagaagaggtttactaggtggtaagtaacattaaaattctaaagcaaatcaaaaagtttaatgataaaaaagacagcctataaaaatcaacaactggattataaattcactttatcataagagacttgggcaaacttttatacatgttctatataaattatattaaaaacaagaaagagaattactcataatatataaagttaatataaataaatgagaggagcaattataaattataaaaataatatattgacataatttaaagaaaaatgaagtatggtagaattctaggcagggctagaaattgtccaaaaaaatagtgaattgaagactacactaagaaattaacttagaacacataacagaaagtcaaaaagttggtaaatttatgtgtatatataattcatgtcttatatgtaacagcagttataagacagaagaaaggaatagagaaaatgttttaaaagaaagcaaaatttaaagagaattttctctaaaaaactgaagactttttaaattgaagaaaggaataatagtattcttacatgaaatgtgtattctgagtttagttcaaataacatagcactcacatacacccccccaatcctgaaaacaatcagaaaaggaaatttttaaaataagaatgaaaaacaaataaaacaaaacaaaataagccaaacactgttctgaagatttggacagctatcaaggaagtcagagttcagaggctaagataccagagagaagggaaactcattgagatgagcctacaattctaggcagcatttaaaaaggcaattaaggattcctaaatagtgtgcactgagagacaaagaagctgagcagtaatgtgacaaccagctgcacagctccagtctcttcaagagaaaggggaagaaaattagaatttagaatccactaagaaggaagggctctctcaatcaactcagaatttctgtttagaattctgaaaaattactctctatgactaaagtaaataagaaataagcaggcaataaagaatgaaagcaaaccttgaaacagcacaattcatggttaaattgaggtgatgtcgttttattcggaatgctcgatagaagctaaggtaactacccatttgaaggaagataagaacttacagaatttctggaatgtatcaaacacaatgctcagcatcattcaaaaattgccagtaataccagaagacagcaacaggagagaaaaaaatcaaacgatagaataaaactctcagtgatttagatattgagagataggcctttaacatatgaatatgttcaagatttaaaaagaactgattaacatcttaaagataaaaagatgaaaaaattaactctgtacaaaatcaaatggaaatactagaagtaaaaatatgtaactaatattaaaaacttaataaatgaagaaaagatttgtgagctaaaataaatatcagtagaaaatatccaaactgaaataaacatgaacaaaaataaaaaatgtaaaaaagagaataaggaaaaattagggactgttgaaatgttctaaaatactataatttagttccaagatgatgaaataaaaggaatgaagaagtaatatttaaagaaataatagacaagaattttccaaaactaataaaatttttttcgtatatttatgaagctctagaaaactcagtcaagataaatggaaacaaaactataccaaggatctgaaaaccaaagacaaagagaaaaatcttaaaagtagtcaaagagtttcaaaaagagtaatgataagatcaaaagatataatgaaagcatatggataattaatctgaccaagccatctttctttctttaacgtgccatcttccagtatagggagagaaactattagcactttctttcctaacccacattctgactttgatactatttcctttacatacttttcaggtgtgtttccatagtttctctgacattttatttacacacaaaaaaatctactaccagtgcaaagaccaccagaatttgaaacataggtagtaggtagtaggaatttgctctacaaggcatgtgaatcttagccacacccacccccaggtcttttgatgttctccttccagttccattaccttttccttcatcacccataacacatgttgatgggaggatttaagagattgtgtgaatttttagcacttaattcgtttcttttccttaccaactggcttccataagcgttaattacatcaattaaagtttccaaattaagttcccccaaaatgttctgattctagagtcattgtctcctataacacagatttttatttaattctctcagtaaatttagtaaacgttggttacagcaaacagctgtggcaactagattaaagtaatatttaactaagttaaaattatagtaacaagggtggcaggcgagaattctaccactgaaccaccaatgctggggcctgttgtgaggtggggggaggggggaggtattgcattaggagatatacctaatgtaaatgacgagtcaattggtgcagcacaccaatatggcacatgtatacatatgtaacaaacctgcacattgtgcacatgtaccctagaacttgaagtataaaaaaaattgtatgtgaaaaaaagaaattaacatataaaacttaatagcatttctataaaccaataacatttggctcttatctgagagccatatcaagaatgaaatccttttacaatggtcaccaaaaaataaaatacctaggaatacatctaatcaacgaggtgaaagatctctattaggagaactataaaagttgctgaaagaaatcatagatgacacaaacaaatggaaagacattccatgctcatggactggaagaatcaatatcattaaaatgtccatacttcccaaagcaatctacattttcaacgtgatttctaccaaactaccaacgttattctaaaattcatatggaaccaaaaatgaggctgaatagccaaaacaatcctaagaaaaaagaacaaagttggatacatcatattacccaactttgaactatgctataaggctatagtaaccaaaacagcatggtactgttacaaaaatagacacataaaccaagggaacagaatacagaaccctgaaataaagccacacatctacagtcgtctgattcttgacaaagtcaacaaaagtaagcaagggggaaaggtcctcctattcaataaacggtgctggaaaaattggctagccatgtgcaaaagattaaaactggacctctgcctttcaccatatacacaaattaacccaagatggattaaagacttaaatgtaagacctctaattgtaaaaatcctagaagaaaagctaggaaacacccttttagacatcagccttgacaaagagtttatggccatatcctcaaaagcaattgcaacaaaaacaaaaattgacaattggaccgaattaaagagcttctgcagggcaaaagaaaactaacaacagagtgaacagacaacctacaaaatgggagaaaatattcacaaactatgcctctgaaaacggactaatatctagaatctataaggaacttaaatcaacaagcaaaaagcaaataaccccattaaaaagtgggcaaaggacatgaacagacacttctcaaaggaatgcatacaagtagccaacaaacatgaaaacaaaaatgctcaacatcactaatcatcagggaaatgcaaatcaaaaccacaataaaatactaactcataccagtcagaatggctattgttagaaagccaaaaaatagcagaagttgatgaggctgcggaataaaggcaatgcttatacactgtatgaatgtaaactacttctgccactgtggaaaacagttgggagatttctcaaagaactaaaaatagagctaccattcaacccagcaatcccattattgggtatataccaaaaggaaaataaattgtatgaccaaaaaaaaaaaaaatatatatatatatatatatatagtcacatgctccattcttatccagtaaaaatgatcttaagggtatatagtcatcctccaatttacatgtttcatttaaatcatacttcttaaaattagatttgaattacacctaatacacacacacacacacacacacacactcacacacactagacatttgtcttgacactgtgaaatctaggggttgagggccaagagctctttcagtcctccaatgttgttaaggtgcttgccttattcagagaaacagagctgtcagagtagcggactggaaattctggcaagaggtgatctcgtagtcttaaatccaaggatagtctggaggcagaattccatcctctttgagagacttcaaccttttttcttaaggcctttaactgattggattaagctcattcacattattgaggataatctgctttacagaaagtcaactgattaaaatgttaatcatataaaaaaaccttcttattccagtctatcattgttggacatttggcttggttccaagtctttgctattgtgaatagtgccgcaataaacatacatgtgcatgtgtctttatagcagcatgatttataatcctttgggtaaacacccagtaatggaattgctgggtcaaatggtatttctatttcaagatccctgaggaatcgccacactgacttccacaatggttgaactagtttacagtaccaccaacaatgtaaaagttttcctatttctccacatcctccagcacctgttgtttcctgactgatcgccattctaactggtgtgagatgatcaccattctaactggtgtgagatggtatctcactgtggttttgatttgcatttctctgatggccagtgatgatgagcattttttcatgtgatgtgacacatatacaccatggaatactatgcagccataaaaatgatgagttcatgtcctttgcagggacatggatgaaggtggaaaccatcattctcagcaaactatcgcaaggacaacaaaccaaacacctcatgttctcactcataggtgggattgaacaatgagaacacatggacacaggaaggggaacatcacacatcagggcctgttgtggggtggggggaggggggagggatagcattaggagatatacctaatgttaaatgaggagttgatgggtgcagcacaccagcatggcacatgtatacatatgtaagtaacttgcacattgtgcacatgtaccctaaaacttaaagtataataataataataaaaacaatttcacagcaacatctaggctgatcttagaccaagcaactgggcatgaagcctagccatgctgacacataaaattaacctctgagtgctacaacttctcagtggaaatgcagttaactttctctgtgtctatgcctttcttcaaaagttaccagaatgactccaccttgttgagtcttttatcattttttcaacatccccagctttctatttccccctttgtgccacttctttttctgcatggtacaagtgtagagttttcataataaagccctatgtataacaactgaggcaacaggtaactctcttctgaatattctcttggcttccttcaagcaagggtacataaggctttatgtataagcaaactaggttatgctgggctaaaaagagctccaaatcctggcccaaacaacaacagagattaatatactttcaactccacttctgttggtgaacaaccacagctcttttccttattaatttcattccagaactcaggctctccctaaagcagcagtccgcaatatttttggcaccagggaccaggtttgtggaagacattttttccatggactggggtagagggtgggtgttggtttcagggtgaaactgttccacctcagatcatttgtcattagattctcataaggagcatgcagcccagatccctggcatgcaaagcagttcacaacagggttcacgctcctatgagaatcgaatgtcacatttgatctaacaggaggcagagctcaggcagtaaagctcactcacccattgctgacctcctgctatgcagcctagttcctaacaggctactgaccattacctgttcatggtctgggagcattacagttcttgaggtagagggaaaagagagattttaaatcatatatgatctctgccctaaaatgacatatgtcacttctgtccacatctcttttgctggaaaaattctgagttaaccagtgagtctttataatattctatttgtttctggtaaattatatgtatttaaagccaaagatcttgtctagataaaatctttaaggctaaagactccattcttctactagtctttgtatactgttcttcccctggcccttagcttaatgaccactgccttaaagcaattttaaaaataggtctttttgttgtgggctcctgctcttgtttagtggaaaacacttaaagaaaagtattctgggaaatcttgccactccattatgccctgataaaattgcagcttcaaaaccaccataataaccattataatttatagtctttttcaacactagaaactgcaaattgtggaactctcagttaattttgactgtgggtcacaaattcagagtgactcttaggaaagaatgtttttccccatttctggctcaaatttgtcttgcaagcctcctcagaaaagaacaagaagtatccaatattctatttttttcttccatttccctaacttttacaacgtcaatcattaccttggtcttcaacccaagcagaacaatttgaccagttgtttcattgatgtatatcaagagtcagtaagtttccactccgtggtggttagaactcttcttctagccccatctcaactgcattccacaatattggttttgatattcattaaactactctttcatgagccaaatcttctttcaagtagggattgtgttcatctgtatatataaaacagaaacttaactatctaaaaaattttccacaactagcatcttctatgtctatataattaggtggaactaggagtcacaagactactcctagttacagaagttgctagaaaatctggttttaagctgagctcattgcccttctgaacacaaagttttctattaacacgagagaattaacactgtgtaggtaaccagaaatcctgccatagtgaccacatgcctttgccaagaacatttaaatgaatataaatctacacaatgataatatggttttagcatcacaactatacatgataataacaacagtttccataaacagagttacttctttctgaacattaccccaattatcttattgaattcttacagaaaatttgcaagcacatctttatattaatttgactgatggcaaaagtgagggtcgtttagctggtaaaaggcagagccagggatctaatccattctaaaaccacagtcaattttatccactatacatgtgctgtctaaatcttataactggaaagagaaaagcttacaagcaactatattgaaaataacaggacctattaaagcaaataatctccacagaactcatttaataagtaaatcaaaactatacaacatcagcacttcaaatatttgtcagtgaattcaagcagaaaaaatgcttttgattcagccttagccaagaattcacttgagacatctgaaggaaagacttaaggaacaagttaactgtcgatttatttggattctttatggtttattcccacattaagaaagaaaatcaggtaatatttctggagtatattattttagctccttgtagaaaggctgtctcatttgtaacccaaaaccatcactaaatgcaatttaatgttgtaaaaagtctatatgatagatatttgtttcattaatataaaagaaagatatgaagaaagatagagctcattttgttacttattaccgattttataagaatcatatgataaatatgtaaaatatggttccatagacagaaaatatttaaagacaatttttagccctatataacaggaaatgctgaattgaaatgccctattgctataactaattacatggataaaagatggcactgttgccaacttctaatgtgttgatctgttttagtatgttaactttcttcttttataatatgagtcactgttaattctttttgaaattaacctatgtaacttacacaggaaaagtaacatatatgacagattgttagacaaatttacttatattcagaacagtcttaagaatataatctgtttgagaagtatgctttaccattacagagtgagctttatttttaaaaaggatagtttgagaatttctctaagaactatttcttttgaataaatccaggtcctgttttcagaatgaaattcctttactatatgattctaaaaatgtacattcttaaaaatttaaaactaagaagagtaaaaggacaaattatcttctagagagcaccctatgattcaattatgtcccaccgggtccttccctcatcatgtgggaattatgaagctagtattcaagatgaaatttgggtgggacacaggcaaaccctatcaataattaaaaacaaaaatcacatgatcatctcaatgaatgcagaaagagcatttgacaaaaatccagcatccctttatgattaaaaccctcagcaaaatcatagaaagaatgtaccttaatgtaataaaagcatagaaaggatgtactttactgtaataaaagccatctatgacaaactcacagccaacataatactgaatggggaaaagttgaaagaaatccccctgagaactgaacaatacaaggctcaccacttctattcaatgtagtactggaagtcctagccagagcaatcagaaaagagaatgaaataaagcatatccaaatcagtaaacgggaagtcaaattgtctctgtttgctgatgatatgatcatatacctagaaaaccctaaagactcctccaaaaagctcttagaactgataaatgatttcagcagagttttaggataaaaaactagtgcacacaaatcagtagctctgctagacaccaacagtgactaagctgagaatcacatcaataactcaacccctcttataatagctgcaaaaacataaaacaaaatacttaggaatatacctaaccaaggaggtgacagacctctagaaggaaaactacaaaacactgctgaaagaaatcacagacaacacaaacaatcataagggtgggtctttcccatgctattcttgtgatagtgaataagtctcatgagatctgatggttttttaaaaatcagtttccctgaacaagttctcattttctctcgtctgctaccatgtgagatgggcctttcaccttccaccattattgtgaggcctccccagccacatggagctgtgagtccattactgtagttccttcaccaaaaagcactacctttgacactactgtgtcaagaagtcacagactgtatctgtttgctactggaaagtcagactatcacatgctaatccattctattatattcacaattaataccaaccaccatggtcaaaaattttatccagcaaatgtttttgcttgttaatacagctggaaagaaatagtcataacacatttcaaaaattgtgcattcttattcattccaatccaaagaaattgctattggagttttctcagatgtttgatacatcattgaaaactaattataatgtttacaattaaatattgatagaaagtatcattaaaatagtcaaactccattacaaattgaaacactgctcagtttcatgactgattaaaatatcttctcagaagatagtctcagaaaagtatccaggaaccacttttctggtaaataattttgatgttacagtatttcagatgttctgtccatttaacacatttatattcataataaataaatacaaaataatcaagagatttgcattttttgaagttacaaatggtagctttaaaaaatttattggaatctaattgattttctaaaataagttattctagtttagtttacggtaaatcatagacatttaataagttatgtaaatgtaatatctagtggctttgtaggtatgtgtttatacatatttctttgtgaagaactttttattttactttctagtgttttgatataatactaaatatatctgcgtgtcttcttggttttatattgaagttatgttttcttaaagctcttcctcttagctacatctttatttgatttggcttcatttgatttgattatttattttttggagacaggggcttactcttgtcacaggctggagtgcagtggtgtgatcagggctgactgcagcctcaacttcccgggctcaagcgattgtcccacctcagcccctcccaagtaactgggactacagatgtgcaccaccatgctggctgattagctgtatctttatatttgacttaatcttcatttaagacattcagattttcaccataaaccctataaaaagaagaatttcttctctattgagtgtctctttttccttagaatctgagagtttcatataataagcactcagtaaatatttactgcattagagaatgaataaaggaatgaacaactattttggaaattcattccagtgccctgcatttacagtgaattctttctattcagtacatattaagcaaaaactccataatttttactcataattttgtgtctatgtacaaaatgttgagcacaaactttgggggaaattttcctcaacacaattctatttgttttctttggaaataccgattaaaatttcatatttccactcaacatcaaaattatttcagaatacaaagcaaataaatttactcatcatatactaatttctataatttaaggatagaaaatggcattcatatagttacatatgcataaatttaaacaatattatattaaatatatttaatatattatatattaaataatatatataatatatatgtaattttatatattatatataatatacatattatatattatatatagtatacatattatatataatattatatataatatacatattatatataatattatatataatatacatattatatattatatatagtatacatattatatataatatattataaatgcatttggataaatgcatttggatactaaatttcaaaatatttatatgaaaacttttactttctaatgtaaaataaaaattgtgagattttttatgtgggaaatatttattttcaaattgtaatgccaatttttccaatgttaaacaaaagagagattgcatttatttaaataatttataagaaagaatttatgttgcctgttcccttttggttgaaagatggcattgttaatacgtagaattgtattcacctggtaaagacatcattcacacactccataaagtttaattttaaattaaaagaatttttgctctgacattaatcctattaacagaatagagaattcaaaattatgtcaagaagcaacacaagcttttaacactgtaataattggcactgttctgtagatgatattaagaagcccaaggttacagaaggatggaaataataactgaatggttcaagttttctcactaattacattttattattacactagggaaaatattccaataaagcaatcaatgaggaaggggcttaaaactatataagaaatatggcttataatttagcagtttttaaatgatcacacacagtaccttgtatgtaagtgctgctcaaaaattattgacttttaaaaaataataatatattttaatattgttgttatttccctaatataaacttgttttaatacaagaagaatgagggcatttagtctttctagtgatctgatacctttgtcacctagttctctgttttatttactcttagttttatcatcatttttgataatttttttatataaagcaataacctactcaaacaccagcccactattttacagttatttttatttagaaaa

SEQ ID NO: 576 - DNA, 110354 bp, Homo sapiens
cccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctttgatggccagtgatgatgagcattttttcatgtgttttttggctgcataaatatcttcttttgagaagtaactgttcatgtccttcgcccactttttgatggggttgtttgtttttttcttgtcaatttgtttgagttcattgtagattctgaatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagctttacggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttggactgaaacaatggggttttctagatatacaatcatgtcgtctgcaaacagggacaatttgacttcctcttttcctaattgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagagttgttgaattttgtcaaaggctttttctgcatctattgagataatcatgtggtttttgtctttggctctgtttatatgctggattacatttattgatttgtgtatattgaaccagccttgcatcccagggatgaagcccacctgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcccggactctttttggtttgtaaactattgattattgccacaatttcagctcctgttattggtctattcagagagtcaacttcttcctggtttagtcttgggagggtgtatgtgtcgaggaatttatccatttcttctagattttctagtttatttgcgtagaggtgtttgtagtgttctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgatattttgaagggttttttgtgtctctatttccttcagttctgctctgattttagttatttcttgccttctgctagcttttgaatgtgtttgctcttgcttttctagttcttttaattgtgatgttagagtgtcaattttggatcttttcctgctttctcttgtgggcatttagtgctataactttccctctacacactactttgaatgcgtcccagagattctggtatgttgtgtctttgttctcgttggtttcaaagaacatcttcatttctgccttcatttcgttatgtatccagtagtcattcagaaacccatctcacacaaaataacctatttctttctatcatttttctttaattttattttttgtcagcctttatctgttttaatgctgtaggacctttatgacttttattatatctattaagcaactcagtcctatttccttgcagtggaatatttttaccttctccaaagtttgcaaagcttaataaaaaaagaaaagtgagttgttgttttatgtgaccacaattgattgctaataataactgttattaatattgattcttatattttcatttgcatatattttgtcatttgcatatattatcatttttagcgattcactacataagcaatcagcaagtgcttgacaaaggaatgaatgaaatgatgaaggacaacagttcagaatagcactgcaattattacctcaattctacagatggatgaacatccataaagaaaataagaacacatgcatgtgtcttacatggctttcagtttaactttcattactttatggtcatattttgtaaggtgctcagtgtctactgaaagttagtggattactcgagactgacgtcattgtctcctgattttcaattccagattttattttgctttgttctatttaacctcagtaggcaacattgtcacttgggaagctgatttgggaaatacaaagaaaactttcttatttcattggttccccaattaataaatatttactgattattttctatttgaaaatcactatactcagcccatggagaatacaaaattaagtagacataaaaccctacttaatatgtatgtatttatgaaaatagaaaatctaacactgcagccatcaaggtttacataaaatttcttaaaaagactacattgcagagatagcctctaacagcgcaggtgtggggtggcagagcaaagaggactgaaaaatagcatagggaatccttagtgagtttgcttgatgattatgagtatatatgggcatatatatatcttggtgcactggatattctgttcaaacacagactttgtttcgatatcctttgatggtaggctgcttttagagaagtgcctaatgtattacgtgtgcccatcaaacttgtttattccttctacccacttcctgtgatgcaagtatcacaggaagaaggaataaacaagtttgatgggcacaggtaatacattacacacttattcacaaaggctgggcagagaccttgggaagtgtagcaaaaacttcttaaaataaaaacatgacagcttacatttgaagttaataaacatcaactataccaaccctgttcattcatttgagttcaatgcagggagacttgaccacttatcttaaccttttgtacaaagaagaaacaactggaatattacccaaaaatgtttatatttgaaatatcattgaaattaattctgtagggaaaatagtctgtcagtgcactggcaagggcaagccctctataaatgggactgtcaatactctgccttcagcatacatcactaagtgtgacatttgaattaaacttcgtaaaaaattaataacagggtattcaaagaggctttgtactgtgaatctaaaaagctttcaagaacactgcacaattatagcctttttataatttatattatcaaacacactttaaactatcctaaaatattattagcatattagttattgctccaagcttgtaaaggattgcaccacagaccttttgtatagctatttatccttctactttgttatccatatacaagttgaaagccaaaatgctttcaagcattatcaaatacccatgcatttacttccctcaaaaataaggcaaaatggtgaaataatacagaagtgtaatgacaaaatttaaaaatggaggatagagtagtttctcatgtgcaaaaccatctttaattaaaacatgtattttaaaataaactctttacttttgaataattttagatttacagaaaagttgcaaagataatgcagagaaatccttcagctagtttctcttcctgttagcatcttacataaccacattatatttatccaaattaagaaattaatattggcacattactattgactaaactaaagacattatatgtatttcagcagttttccaactaacatgttttctctgttccaggatccattcaggggaccacattgtccttcctttaatgtctctttagtcttctctgattagttacaattcctcagataccatttttttgtttttcatagccttaacagttttgaagagtcaagcaggtttccttgttttttgagctgggcagtttgaagagtcacctttgtagaaggtgcctcaatttgattgtctggtgtctttcttgtgaatggactgggctgatgatattttggggaagaataccacagaggtgaagtgtccttctttttacaccatattttgggatatgtgataccgttggtgatgctacactagtcacttggttacatttcttcaattcccttagcaaatttctgagaatatggtaaaaattactaaaaaaatagaagttatcgcatgcatttttcaatcataaattacccataagataatccaaagtatgagttattttataagatggaataataagaattcattggttaaatgatttgatattttacctcattttatgttctttttgtgaaaacattgtctaaactaaaactgtgatttaaataattgtttatagaattcagtaaaattaataatctgcaagatttttgactaattctaatatcataccaaagacatactgtgagctaactggtctcaatgataacacatgtaactaatgatggctttcttatttcagtatcttgataggtaacaactgttcataaacgttgaattgcagctgttcaaatatacagtaccattcccttaccatgtactaaaacaaaaatcagtgagaaggcttccagaagctttgtaattgttgatctatttgataattaagatactaaagttctaaaaatattactataatgcattttagtgcttcattaagtgaattatttgtgtgctggatggaagtaagagaattggtcaacatattctgctttgttcaggtcacatctaaaatatcaggtgttggctttagatcattatgagaggaaaagataaagtaattttcaaacctgtttaatttacactctcctttttctaaaaacattcccactttcaaaccataggtgaagatctgctgtcaagttcatgcaatgtgatctcaactaattgcttgagtcagtaggcatcaatccacagtctagactaagataatttatatgcttgcttcatctccacccccaccacaaaataattagtacacaaagactagtccatttattggtcacttcaacaaggaagtgatggaaagtggagtctgagttaaccatattggtccatgagtaagaggaccagagaaaccagttcttcagagagaaaggagatggaatccaatccactgcaagaatcagaagtaagaaaaataccagaagtgagaaaaagacagacagcacagatatctctcttcctggtgacttttacttcctctcaaaaatctctgggggaacttgtctgcccttcccaaggagtcttagatatatccctgaaatttttctaaaactctaacctttcttatttaaattaattagattttgttctattatttgctacaaaaatgctgtctacacagaggaaaaaagcagaccaatttatttattgaataaagaatggaatgtatataaatcagaagcaagaagagggaagagattgtgataaatgtactctaatggctaaaaggctttcatatgttgtttcagacttggaaaaaaaattgaaacaagggatggaagtcctagttagataaattcaatcttaacataatataaaaatatgcaaataattttcaaaaaatacagtaatttaaaaatgcaaaaggattcctttttatcctcagatttgttcctcactaggagtcatccagaaaagtctgcatgcagccacctgcgagtattttacattgagtaagaagcttgcctaggtgccctctaagtatgctgtaattgtaagtgataataaaatgattaaactgttttggtgggcatttctgaaggatgtttactgacgttgtggaagaaatatcatggtactgtaaaaatgagagacctattttacaagtaagaactgacaagtaagaaaagattcttccttctgaaagcataccttccattacagctgcacagtggaaacatattaattagagcaaagattgctcatactaaaacactgaggccagagagtcagagctgaaacagtggagtcatttctggtgtcaacaagtaaatcttttgttccataaatctgtccttaagcaacctaagaattatctgatatagtaataacagctatgaagaatgaaatatttatagatcaagatctttgtgaaacctcttacccctccccagaggagaatctgcagactcttcacttggccattttgattaagaattgtcattaatgtcttggtgtaaaatacctggatgctgatattaaagtctattgggtattcttcatagcttgatctacttagtatgtattataaaacctatatagcttttcttgcataaaatgggttttatacatctaattaagtcttcacagaattctaaatcaatgagccattgtaaattttgttttaaatattatctaagttttctggaccttacctatctgctaaattcaatatgtggtttccaagggtggcctaatcatgtcagcatccttgtgggcttttggttctgtctgatgtaaatcaaaagacaattcctaaaaaaatatatgagttaagccaaattattaaactaatgggttacaaggaggaggttaacactaaagatagcatttccaaggctatttcacttagaaatgctgatttcttccttaggcaactcttcttttgagaactggttcttgaatgaaattctactgtagtaggctcatttttttgttttgttttgtttaatttgttcctgataatattaaccccactttctccaacttcctgataaaacatgttacacatctcatagacacttgacttcactaagttatgacagatttgatatgactgttagtaatttattgcttatatattataatagaggtgttttattcaattttctgaaaaaaatagataagtttggtgctgtaaaagagttagagagtgtcagtggctccctaaatcactgattcaaaaaatcagagaataagagaccatttttatgagtgtgatgcataggtatatcaccagattacatttaaactgacccaagaactcccactgatcctcgtgaggtccctaacttacagccttaacttttcgccttttcactactcaaagtctctgtgaatttcaaaatcccagctaactgcttttctttctaacccaaattgtattgcttcaggcactctgtgagaatgctgaataacaaaaattgtgtgtcacaagaaacaagtaattatttagttcccaacttgctctaggctatagttcaggcacaaagttttagaatagcctttgcaaggtgcatacagacttcagctctcaaaatctaatagtgattgaactcacacttactaactttcaattgatattgatgctttatgtcatcagtttttaagtatttgtttgtaaatatttataattattgctttttaataaaaaaccacattgaccatttagtatgtcattctttttcaggcttcttttttttttttttttttttttttttttttttttttgagacagagtctcactcagtcgcccaggatggaatgcaatggtgtgatctcggctcactgcaacctccgcttcctgggttcaagcaattctcctgcctcagcttcctgtgtagctgggattacaggcatgcgccaccatgtccggctaaatttgtatttttagtagagacggggcttctccatgttagtcaggctggtctcaaactccttagctcgggtgatccacccactttggcctcacaaagtgctgggattacaggtgtgagccactgtgcctggcccaggcttactttttaacacatttatttacataaaaaaatagtttgtttcataaccttgacttgacgtcctataatttacactatatttacacttctttcaaaatttccatcttcacaacatgttgtattataggacaatgtgaataagagaaaccaagtctgaatgtctcctaaacagcctatgaggagagtctttagagcagaatacatttttcttttatattttctcagaatctggttgaagtcctactacacggtaggcttttattaagaatcttattaatgaatatcaaatgaatcatatctattgccattttattttatacatgtaaatgatcagaagtgtccattttttgtggatttttgaatcttctttcaactctcaactcttgttagaactgtatcttaaaatttgattgctcttacacattaggagtgaaaaaaatagtagcattaacaccaaaatggaaatgagtctttaactgggaaaatgacaaagctttataattgttctgaagtgaaacaatgaaaagaaagctgacagaagccaacaaggagagggcagatgaaacaagtatgccatagcctggactccagcagtttctgtccagaaagctgctgagtctctaattgtgaaaacaaaagccaaaatgtcttcatagcctgaaagagtggccttttgtcaccctgtttttagaacaactgtggtagttgctgcttgtgcagacttcctactagtaaccaaagattggtaagttccatgaatatacctggattttccaatttgaataactggcatatcttgaccattggggcattattgcagccagcgcgatctcttctttaggcatcgccacataagaagagtggggtggcaatatcttttacctaaaatcattgacacctttttactactttattagctcaatatgttacccagaaatgattccactggtttgtatttgtgggtataatacaacttaacttactttattaattatctttactcccttcttgagttttttgagtcagtgattgttttgcagaatgttgacagttgatttctccagaaacccaccagaaaaacctgttgatcaagaaagagtatattagacccactgaagcaatggagaatgctgttttgacaaaatttaagaggataaattaaaaaagagaatttacagggtactggagccttgactggatgatttttttttcaacttttattttagaatcaaggaaaacatgtggatttgttacaaaggtatattgcatgacgctgtggtttggagtataaatgaatccatcacccaggtagtgagcatagtatcaataacaacaggtagtttttcaaccctttcccccctccccctccttctgttctccagtgtctattgttcctatttttatgtctgtgtgtacccaatgtttagctcccacttataagtgagaacatgcagtatttgtttctctgtttctgcattagtttgcttaagataatggcttccagctgcattcatgttgctgcaaaggacatgatttcgttctaggcaagttttggaagatagagtaatcaactgtcctggtttgcctggggctaaaggttttcccaggatgtggaacttatagtgctaaaacttaagtcttgagaaaaccaggacagttttccactctagattgggaacgggcagaggttatgaaatagcataagaaatttggactggtggtcattgaaatgagttttgataccccaagctaatggttttcataaataagctggtgagtgggcttagtttcatttgcagaagcaggtgtgttctagagtagggagctgttatttttgcttgctctccatattgatttaaataggaccaaaaaagtatgcctagtcaccatattattaaaatgagagtgcggaaattatgttgatttccattctaaagattgaatataatctatttgaatgtgactagattctgggtttagttttgttacttaaacattttgcagaagccaacattttaaattctactttcaatgtccttgcatcttaaaacctaagttagttaatactacagtcatcctcaaaagaaaaattatatcttggttgtagagatattcctatgaatgaatcattcgtctaaactacaatgaaaagagaaaattttgctatatacaaaaaactaaaaatctccattgtgatctaacctgcattatgatggaagtaggagacaaaagggaaaaaagcaatatgtctaaatccctaatatgtgcaaacattgctcttgaaatacttgtaaatgaattatgttagggagtcattattgtgtctactttaaatatgaggaaacgaaaactcagagaactaaagtaatttaccgaagtccaccagacagtgaaaggacagttcctggattctagaatagtcctgtctgaatcaaaggctttactatttccaaagcacatcactgtaataatgtgattggccactcttcctgcattccaactctcccttctctttataccaccgcaaagataagccgaaaagttacagcaggaacatacatttaaaacaaccttatctagttgctgtcatatgtaaactaaatctaaaatttgcaggtaaatttgaacttataatctggagattaccagagtagtataaggctaagacaaattttgattgtatacaaataaaaacctgtagcttttggatactcataaaataaagcaatttattttttcataaaatcaaaatagaactaaacagctatgcaacagtaacctttaagaagtaaatagaaaatgtgttctacagcctttctcttgttctaaaggaagatgtagatttagattagagttcctgaaaaagaatggccagaattagaatgaaatttaggagatagtgccaataaagtcaagacagtgaagattcaagaagagttgcagtaagtgaagaactcaaaatcatacactggtttttgtaatagagtctaaagttgtgccatatatctgaatctgaaagaaaggatattagaatggagatacaaaatatttgaaaatggaggagtcatgcagttgtagttcagacttgatgggtgtacactcacatctagtagtgtgctgaagagtgagggagtggagagaaatggcaaagatttagcacattcttgatgaggaatgggattacaaacaagacaaggattgtttcttagaatcaaggatccccttacaactgactacaatttatctgtcacttatatgcatgattgtgtgattttcttttgctgtgcttgatagtttgagcaaaagactggaggaggtgtcatgagatccttggggtgtcactttgccatccagaaacctctatagccagtggcaccttttgccagagttttgctaggggctgctgggctcattcggcccactcggcctgacaggctgcactcagcttgctctacaggcccagatcccacacctgccaagggctagccaggtgcagagtggtgagggatgcgtgagcaggcgagcatggggtctggccactgcacacagccaggcatgcaagctgcagtggctggaccaggagtactacaagcggcttccactgtgggcacagtggaatggggtggcacctggaagcttggagattccaggaactgcagagtcccaaagagggtgtcacagccctggcttagggagctcctaggtctggggtccccagagggccaaagctactctctcctcatcacctgcaatgtgtcaagtggggtgggaaggggcatgtttcagctgtttgtgttatagctctttcagtcctgccatttggagggtcctgagctcttgtcctgcgtccagcatgaatgagatacgtggacaatgtggacaactggagggtgctttattgagtaacagtacagctcccaggcgaccagaagtaggtagctcctttccacaggcaggtcgtcccaacatctgtgcagccctcagcagagaggaaacccagagtgggtagctcctatctacaggcaggccgcaggctgtcccagtgagtgtacagttctcagcagagaggagacacagagtgcgtagcttctctccgcaggcaggtagtcccatcatttgcctgagtctggctgagtccgggggtttttatgggcttcagaggggatgaagtgcatgctgattggattggtggccatgggctggcccagaaaaagcattcctaattttgcactccagtctgtgggactggcagcctggcccccaggcttcaggctgtccctggcttgaaggtggagtttaaccagggacctgctcctttcggcccaggagtccgtctgtctcctgccgctgttcatggcacccaggcggtttatgctgaggggtgcctgcaggctcacaccaagccgccctcagccccctactcagtctccctcccatacttggtgttcaaagtccagacggggctgaagaggcagggagcaggcatgtcagtgccaccctgagcatgtgtacacccagccaggttgtgacaatgcctagactcggccataactttgctctgaaatcagagcaagggtgctgacagcaaggagaggccaggcagcaggagaagcacttctgagcctgttgggggcaggagagcttcccaggcccgcagagcgcagggatgcctgtgtccgcagccacagatgggtggctgcggctgtgtccagaagcacaaggctcctgccccaacaactcacaatgggatggggatcctgcctgatcctggctcctgctggctctgcagagcacgcagccctggctacacttctctgctgtagctggcgccttggcagtagccaccccagacgggccactgctgccattagagacagcttatgggactgggtcagttttgccttacgactatgtactgtctaggaaggggcatgtaatagtaaagagtgtttggcaaggagtggttcatcttattggtgtcagtaaaatatgtaaaacagagagaataaccaagagattaggagaaaatagagaaaggataggaatagtggtcaacatgatataaaatgtagagtaaaatttgggtcacaagagagctggaaagataggaagtgataaaaataatgagatcttggaatgtaggcaagatattggaataaggtttcctcatatgatgtgattatgtatttatttatttaataaccacttagttaagtacctaatatgtaccagatactttattgttgaagacacagtgtttaaccccagagaaactgtcccccacctcaaggagcttattctgcagggtattctgtgtaagaaccagaatgaggtaataaccagcgtgcagctgtatgtgtgagtagctacaatagtgagcttgagagtggacattgtatatgttattccatacacacagcagcaatagggaatagaggggagttgagccagcatccaaaatataaggtgtatccaggacaggaatatagaagggtgttgtgctgtttagtccattaatgggatctcagatatctaaaaatgttagcgtgaggcaaagaagcagcagtgttaagcagcagtgttaagcaagaagtctcaaaagaagcagtagtgttaagcaagaagtctacccatctagtttcaacctgacccctaggtaactagggtgtagaaggttgagaagccacttctgcagaaaactgcagagtaagtaatgttcagtgaaggcaaaggagagcatgaaacattcagtgacatgaataaaaatggcagaaaagggaagatagacagcataactagagaaagacaatgtcctctctcctccaaaaatggagaggtgctggattttttcccagtatattatgtttttggtattaaactatatgagtatatctaactgactcagttatgtgagtcacaactgaattgacaaaagctgaattgtcttctctgcaagagagatttttcttcttaaattaagaaatatgtcgtatatctctatcaaaatttctgtcaagcacattgttagcatttaacaagtgaaaatacaattaaagggatctacacttttggagcctagcttatatttaaaactttgtgcaaaaacataactattttaggtataacaaaatatgcctttgaccttttgaatattttattatgtccttgtccttttcaaaatgacaacccatttttaactccagaagtttgctggagcagagctataatcttgtgtaatacaccccacccttgtcaggacaagcttagaaaacattgtttcttctgaccagcaaggcactatagtgaccgattaaaattaaaataccatgacaatttgtctctagtttaggccacctcccaaaataattttaggacaacaaggagtttaatctacatggtttttacttttctaggtattttttctaaaacaaaactgttttgttaaggggtgctacagactgagtgtttattcccctccctccaaattcatgtgttgaaacctggacccaaatatgatgaaaagtgaacatgcagcctttggaaagtgattaggttgtgagggtggagccctcatgaatgggattagtaaccttataaaataaactccaggccgggcactgtggctcaagcctgtaatcccagcactttgggaggctgaggcggtggatcatgaggtcaggagatcgagaccagcctggccaatatggtgaaaccctgtctctactaaaaatacaaaaatgagctgggcctggtggtgtgcacctgtagtcctagctgcttgggaggctgaggtaggagaatcgcttgaacccgggagccggaggttgcagtgagccaagatcacgccactgcactccagccagggtgacagagcaagactccatctcaaaaataaataaataaataaaataaaaataaactccagagagttcatttatgtgttctgtcatgtgagattacattgacaaggtggctttctgtgagcaaggaagcagaccctcacctgacccaaatctgccagttccttgatcatggacttcccagtctccagaattgtgagaaatgaacatctgttgttgataagctacccagtctgtgttattctgtcactgcaacctgaatggacgaaggggaaataaatgcaagtataaatggaaaaactctggagattattttaaattaattacaatcacatttctttttaattaataaaatagattccttttttaaaagttgtgtttaaaattcattttaactgcaatgaatctttgccattaattagcagctgggcatagtggttaggaggacatatctggagacacgctgccgtgtgttacaacctcagcttcatttttttttttaacttgctgtgtaccttattcaacatccttatttgcggtttccttccctggtaaaactattcaacatctctatccccagtttccctcgctattaaatcatggtaccagcctccttgatctcttgcgaggttttaatgattcatttttaataaaccactcagcgcatcacttggtacctactgagagctgtaacaatattactgtgcacacatacacacaagtacgtgtgaatttgttattaatatagaaagcagtttaaaactttaggaattgaaagcacatatctttcaaaaaagtgcgtaatactatataaaccgaagtatacataagaaaataaagaaaggagccaactcctggctgcttagcatgtgtgaatcatatgttatattgtttaatccttggagccatcttttaattacaactatctcatttaagaaattagaaaactgaggtcgttttaaatatttttcgcaaggtcacatgctgggcagtggcctggatagaattcaaatcatcacatggaagatagcaaaatgtacgctgtttgcacttttgcacattaacaagccttagttgtataaaatgagccatttacaaatggtatttatggaacctcaattaggtaaagtatcacagggtttcttgttcattttttatttcattccagcatttttacaatactgaagatattcacaaacaggaaacgtttatttcctattctcccattaacctactaacagaactacattcttcagtttttcccttttattttcccctagatctgtagttctagccaggtcagggccagagggatataatggaaacagcttgctttcctgcttcagagtcaccttcagggtgaagtagacatatgcttgcataaatcactggttgctaaataaattggatacattgaaagaaattcatcttaccaagaggtagagaatatttctcttccctgtgaacctggggttggtcttgtgactaggtgtgaccaatagagtattagcaaacatgacatgggcagaggagtaaaaagtgcctgtggattggcttttctcctcttttggggctgagatgatttctgctaccatgtgactaagtctggactagccttctgagggttgagagaccacaggaagagagatcagccatcctggccatctcagctgaaatcccatggaccaagtaaaatatgtggaaaacaagacatgagtcagccattctagaccaagccagcacagaatggaagaaatgccaagtcgactcacagaattgtaagaaataataatggtttgctgttttagccactaagttttgggctggtttgccttctgccaaaggctttatgagagatacaatagacatgtaccagagactttgaaaagcactttggggagttcaaagatgagtaggccttaaaaagtgtaattggaatgtttgtaacaccaagaaatgataaatgcataagatgatggatacctcatttaccctaatgtgattattatgcattatatgcctgtatcaaaacatttcatgcaccacataaatatatacacctactatgtacccataaaaattaaaagaatagaattgttgataagatcataaaaaagataggtccttgtcactatcttgtcactagcttaaagcaggttatagttgagacagaaggtgaagatacaaatacattataaaacatctcataaaaacaaatgatcaaataacattgcatccaaatactagaaaaggtatcacagtaaaaatcctaaaattcatttgggagttagggagctatggaaaaccattcttcacaccaatatcaaaatcaaaagaaggaaagaagaatgttttcaaagaattttaaaaataaattttggagacataaataaccttagcctaactctcacactttgtggatgagaaaacagaaaattaggatagtcatggccatgagggaccctcacccatctaaccacttagatttctgcatgtgacagcatgccacccctcctggatctaatcataagcgttacatctgatggctgcctttggatgaaaaaggagatctttctcttttttcctactcctgatttcttgaaagcacaattaattcactcctttattcacttatttcttctttacctttcatcctattcaaattatttaccgtggattacaaatttttacataatcatctggttcctgctctcctcagcaacctcatttcttattactctttctgttggacatcagaatagttgtattacacttgctgtttccttggcctggtgcacactccaggacccgaacctttgactggctacccagaggatgatttaccatgaaactaatggtcattaagatgcaggactccacatatgcacaaacttatttcaaggaattgttacataatattgaatttataattctatcctctttttcctaaagaggactctaataattgataaggaaagtatctgacattattgctcctgctgaccccttggtgtcccagcctaggaaaggcaagaagctacaaggtcagtcatgggcagggtcagctgtgaacacagaaatgaaaggtaggagatgtgagacggaaattcagcctttcggctgtgtcttcttgctacagcattctggacacttactctatgctgtaaatctacaactatttattttattgttctgtaatgttttcaattttgaataaaaatgtttggagagcagtaagtttaataaaacaaaagcatttcatttaaaaagaatacagcatttttgtttcttaagaatacaaatactgtatgttttaatgtaaaatgtttatggacatttgccatccaccaagggcacaggagtaataacaccaacaatgtgaaaaccagaaaacaccaatcagcttaagaagcttagccattttaaaatttattagctattttagtactgtgatcaaagacaataatttaacacatatagctacaaaacttaatttgcatatcactctagaaacaagaccttttatttagattgattgttcttcatctatgttaattttgctcattacaatttcagattttcttacgtaagtgcaaagaataaagtggtgactattaatgcattagcaaaagaagaattgctcaatgatgttagttttatgttaatatcatcagctgctgaaatagaatttagttaatcataataatgatttatttatgttttattcaatttatggaaaaagtaaagcttctacaagttaattcagtcaaaaatgacattattgagaaagatgttatcaattcattcaaaagttaaatgaataaaatagtatattggtaccaattacataaatgaagtttttggtggttcagagcatcatagtaaaaagcaatgttcttagtaagtgaaagcacctatagaacagaaaagtatgtaaaattggttgaggcacactcacaattcacagtgcacctaaaacaaactgaaacgctttgccaatttacatagaagcaaaaaattaaaatgtacaagtaactatatatatatataatagttgctgtttaaatatataaatgcacatgtaataattctaataatgatttaattatatatgcatagagagaaagaatgaaggagagaaaatggacttcaatttatttccaatttgttgaatagaaacaaatacttcagcgtaacagttggttctctttttgctacccattttcagacagactttagaaatgctgaggctttggagaataattttaacctaaatgttcaacagtagtatagatcattactggaaaagagtttgtgttccttttttaatcagatagaaattttaataaaagtattcaaaaaatggagtaacaaaaatgcaacctttatcaaattgaataattgaaaacaaagcttgcagatagaaattgaaatttatatctgcaaaagcagggcaaaataaataaattaaacaatgagaattcaaataatgtataggttgaattttgaagtcctctacctgtgctttgaaatatctccacttatgagaaaaatatttgattaaactcctatctatagctgtataaattaatattgtgttcttgagtagattcaaatttagaaaacttatgatttttttaacatccaaatttagcaaagacatggaatcaacctaagggcccatcaatggtagagtggataaagaaaatgtggtacatatataccatggaatactatgcagccataaaaaaaggatgagatcatgtcttctgcaggaatatggagggagctggaggccatatcctcagcaaactaagactggaacagaaaaccaaatgctgcacattctcacttataagtgggagctaaatgatgagaacacatgggcacaaagaggggaacaaaagacactggagcctacttgagggtggagggtgagaggagagagaagatcaagaaaaatgaaactactggctactagacctagtactcaagtgactaaataatctatacaacaaacccccatgacatgagtttacccatataacaaacctgccttgtatccctgaacctaataacagttaaataaataaatttgatgagacatcttaaaaataaatattttggtgagtttttcttatctataatttcataaaactaatttatctggcaacacaatgtttcaaaaattacataaaattattttaatgcctcctttcattctcaaaactgtcctggtacagatgataaatttatggtcaccctatatataatgtcgtgggaggttgcctgattgcttcccctagtgtgatgcagtgatattcttcaaggcactggcttagatactggaaacagaaaagtagtattaaaacgatctctgcctcccagaagctcacagtgcaatggaatgaaaaatatttattaattaatgttatgggttcctggttggagacatacaaaaatctccagagagaactccagtgagaatggctagcattgatattgcaaatattttggcaatttgattactgagtggaatgtatagcttttagaaaattgaccgtccagcaatatatttctgaaagaatttgttctgtggtgtcaaagagaaattgtaccagagttaaacgggcaaggaagactttattcaaaacgattacagtgaaagtcaagactattgtaataggagtgagagatcaaattcaacttctactgggaaaaaatgcaggagagtttttaagcactggggtgagctagtggagaagtactacaggatgttgagggggaggttggtccatgtgattaggccatctgcgttttctaattgcgcttatccaagtttgactcctaccctcccaccgaaactgagagagaggggcactatcttatttttggaaaaggggcacctttttcaaaggggtggctcccaggtcctagagaaagacattcctcgggtgtaaaactggcaagaggctgggagatgtacatctcaaaagggaaatagaaagaatctacaattgcaagtttcctaaattagatgctctcagtaaatggaggtcaggggtttatagtcaggaataaatctgtttaaagtttagtcaagctaaggggaatgttaaggccatcttggtcagtggatttctgagcatccatgcatatttgactccaagttagaggaatacaaggaaaactcacttgcctggaatctctccctacttcttctcctgctggtgaagtttattcttgtctggcaggttataatcctgttggagtgtatatggccacctaaagactgatcataggtctttaagattcagtttgaataaataaatacttttagtgttgctatatagtcagcttgggaataggctcttctccttggacagacagcttccagggttcctgtataggaaatatttcactttttcacactttagagccaataaaaatgtacttttctgcaaaaatgatgacaatgacaggatataacatctgctttataagagacagctgcatacagtagctccacactaaatttaatctagtccttaattcttagctgtgttcctgagggagcatgactaaaaccattgcgttagcttgttcccaacgatgatgtccaataaagatgccaaaaatattttagcattatttttatctttgacatttgaaagcaaaccacacttactggtaaaattttgtttaacatctttactaattgccttcagtatgttaaaaatgtaacccttttaacagtcatctttcctttttgaggtattttgtgctaatttaaaatactgaaaaggaataaaatgcacaagaataaaatgaggcaatgtggtattcaaaccactctcctttcttctctggctgtgtgaatttgctcaagtttcttcatctctatgaagttcagttttctacctgataaaattgaaataataaaaacatctcctctgcattcttgttttgaaggttgaggattatgtatgataagttcttgaaacatagtaagtacctaacagtatgttattatagatctgaaagcttcatatatacagtgtggctgtaagaagggactactattgtttcaaaactgtaaggcagttttgaatatacccatgaggtattctgagcccagatgtggtttattgtttttcttattctcactttcttgaaagaaaattttttttgaagattatagtaccaaacagagagctagagaacaaatgcactgctggataattgatttggaggtaactttcatttatgagttgtgagaccaggcccctggattctggactccaaattcggtattttttcaagagtatccaaagagacaaggtccattctttgatgcaggaccaaggtagcactaatccttggctagtttttggaaggcaatctcaaagctggatgtgatacaaacagaataggtattgggataactccagaaaaatttagtctttcattaattcttgcatgcatgcatgcatttattcaaaaaatatttgttgagtacctcctacctagccagcactatagcaggtgtcaggaatagacaaaaataataatagctaattcttattatgccctgctggtactaggaaagagtttaaatactttattgctcttttactcatttacacctcaataactccctgaagtctatattgtcgctttccccattttatagataagaaaattgagtgaaagagaagttagaaaacatatatggtaacataacatcgtgaagtcagaacccaggcttttgaacaccacttcatagtgtctcctctaaaataatagtgagctaagcagacatggtacttgaccttgcctagtgaaggaaaagaaattaatcaaataatcacaataagtgtatgattataaacaattataatggggcacatccaagagtaggaacattacatagagagaacctgataagtgtgaaggcacaggaagagcatgagaaactgaataaaggccagggtggctgggacacagagattcacgggggaaaacagtgcaaagtaccaccagagaggcaaaatgtttagatcctgtataagccttaactttggggtccagaatacctgtgttccaatcccagctctgccacttttttgctctgtatttgcggcaaaggacttaacatctccgagcttatgtctttatttttaaaataaggataataataagatctacctcacaaagttactgaagtcaacagatgagttattttatgtctggcacttagcatagtgcctggcacattataaaactaaataaagattagttattatgatgattatatgaaattataaaaatactttaaattttataaattataaaatatacaatttcaattcacttactgaatctgattcttttctttagcctgaattaattctctaatttatagacttaatatttatagagcaggatgtgagctaaactgttctgctttcttcagcagaccctagacgagaaaaaaattttaaaagatagtttaaagtaacaaatgtgttagttgttataataacccaactccattaccttacatatgcacagacacatgctctggcacaggcatttgtgtgtgtgtgtgtgagtgtgtatgtgtgcactgtagttcagacaagctttccatattccagttggatcaagccggtaaatctgacatagtccaggtccccaggtaattccccagagtgcaattatgttgaaaccccaaatcactggcactactgcatcacagttgttaaaacaaccccagaaaagctacacaaatgaatgaatttccaaatttagcctgagtgattgcttagagcagtgactatcattctaaggaatgcagggggttagtgcaaggtattgccgaagtaggtggcggatttcctccttacacaaaactatgatagttagtgggtttgtaaaaactcagcagaaataaaattcttcatttattttgtttccacgagtagaaaacaggagaatttctctttttctctttgtgatcaagaggaaggtagcagtgataccagagtcatctcacaaaatgccaagtgagtggagctgatccattggcacaggtgacagaagcctgcttcattacccccaagcaacaggtttttgtcagcggaaggaatagtcaaagaattttctgtataggttatcaccctaataagcccactgtaaaaaacaccttaggaagaatttattgatagtcagcacaacgcaagtctaaacagaggctgcaaactgagtgggtgtggaagaggcttgaggaaataggctattcatagagaacagggaggtgcttgcaaacagggaagttggagatattccataaaaagatttttcctagggctgtgtcattttgaaaaaatttaagtgcctctttaagcaaaagattgttggttcccaatccctgcaataagccatctggccttgggtgaggctattgccatatggatggtcattttatctgaggagcaaccaagagcactatgaaaaaaaaaacatgtaataatgatctctaattgactatatagtctaattttaaaaactatggcaaactcaaagacttcaaagtgctacagggaaaatttgcacatggctgatgccttatctgccttcctactctctacatctcagtctcagcatgcagctggtcacatctgcttgcatgggtctttatgctgccagtcaagctgtgtggagaacaggcagcatgactgggtacatggccgcaggtgcatcagtaactcctctaggtaggaacaaataaagtttatgtttggaacaaccaactggaaactcaggaaaccctctttagtaaacattgtaagaaaacttggcatagttccaaagacagtgtactgtcatttactttgtttaaggagaaaacttattttcccaatgtgttttcaaaaatttctgatcattatgtttagctatccaaatagtctaagaagtcaaacaaatcagtcctttgctacagttaccatcaacgggatacaaagaaatggatattattttaatagccaattgctttccaaagctacttgaggaataaatatgacttaacagaaaatatttgatgtttcactaaattaaagataatggatatccttgtttttataaagggatctaagtctattgaagatttgagctgcattctttctgaaatgtgtgcatactgattcattcaattttgaagtaatttatcacttttacaaattaaatgactttcctctgcttctcacacaatgaagttatgtgtgaaaattaactaggccaggcgcggtggctcacgcctgtaatcccagcactttgggaggccgaggcgggtggatcacgagttcaggagatggagaccatcctggctaacacggtgaaaccccgtgtctactaaaaatacaaaaaattagccaggcgtggtggggggcgcctgtagtcccagctactcgagaggctgaggcaggagaatgcatgaacccgggaggcggagcttgcagtgagactagatcacgccactgcactccagcctgggcgacagagcaagactccatcacaaaaaaaaaaaaagaaaaaagaagaaaaaaaaagaaaattaactaatgggctgggcatggtggctcacgcctgtaatcccagcactttgggaggcccaggcaggtggatcacgaggtcaggagattgagaccatcctggctaatacagtgaaacccaatctctactaaaaatacaaaaaattagccgggcatggtggcgggcgcctgtagtcccagctactcgggaggctgaggcgggagaatggcctgaacccgggaggcggagcttgcagtgagccgagatcatgccaccgcactccagcctgggcgacagagcaagattcagtcaccaaaaaaaaaaaaaaaaaattaactaatgattctgcaatttaatgctctttcttgaaagaacactctagggagttttattctgatatgctgctaaagtttaggatatgtttattaatttacaacatccatataaatgatttctgaaattaagaagggaaatgcactctaatttgccaatgtgattggcttttgtaaaattctttccaaaaagtcacttgaatatccttgatattatacaatgaaatatctttatagactcttaccataactcagtgttcctgatgattttgtctgtgattattaaacattttactatcacagaaatagaaaaaaaattgaaattcctatgaaaccacagaaaaccccagatattaaaaaaaaaaaaacttgaacaacaacaacaaaaaaacaaatttggagacactaccccacctgatctcaaaatatattacaaggctatagtattcaaaacaagatactggcataaaaacagatatatagatgaatggaacaggaaagacagcccataaataaatccatgcatttacagccaattgatctttaacaaaggtgccaagaacacaaactgagaaaagaacagtcttttcaataaatgagattgggaaaattggaaatccatgtgcagaagaatgaaattagacccttatctcacaccatacacaaaaaccaactaaaaatggattaaagacttaaacataagacctgaacatgtaaaactactaggagaaaaacaggaaaaaaatactttttgaaatttagtctaagcaaagattttttgaatatgatcccaaaagcataagtgacaaaagcaaaaatagacaaatgggattgcaacaaactttaaaaagcttttgcacagcaaagaaaacaatagagggaaaagaaaacctacagaatggaagaaaacatacagaatgaaaaaatattaaccactgataaggggttaatatccaaaatatataagagacttgctatggctttgatgtttgtcctctaaacctcatgttgacatttaattcccagtgttggaggtggggcctaatgggaggtgtttaggtcatgaggtgaattcctcatgaacagattaatgtcctcccatgggggtgagtgagttctcattcttttgctcctgagagatctggctgttagaaagatcctggaaccttttccctttctctctctcctgcacctctgcccaaacactcccctgtgccttccactgtaagtgcaagtggcctaagatccacactagatgcagatgtccaatcttgaactttctggccatcagaatagtaagccaaataaacttttttttcataaattactcagccccaggtgttccttgatagcacacaaaatggacaagaccaaactcaaataactcaacagcaagacaaaaaattactcaatctaaaaagtgggcaaagaaccaaaaacagatatttgtcaaaagaagacacacaaatggctaacaggtgtatgaaaaaaaaaagttcaacgtcaccaagtataaggaaaatgcaaattaaaaacacagtgatatcacctcacacctgttatgatggctgttatcaaaaagatggaagataataagtattgccaaggatgtgtagaaaagataacactcacatactgttggtgggaaggtaaaactaaaaacagaactaccatatgatccagaaatcccactactggggatttataaaataaaaatgaaatcagcatgtcaaagagatatttacacgcccattttcattgcaaacattatttacaacagccaagataggaatcaacctaagtttcccccaacagacatatgtataaagagaaaatgtgacacacacacagatacacacagacacacacacacacatacacacagtggactactattaagcctttaaaaagaagtgagtcttgtcatttgcagcatggatgaaactggaggactttgtgctaagtgaaaaaccagacacagaaagacaaatattgtatgatctcacttgcttgtgaaatctaaaaaagttgaactcatagaagcagagagtagagtggtggctgtcagaggctgggggataggacaggtggagaatgagcgctattggtcaaaaagtacagtctcagacaggatgaataagttatgaagatctattatatggcatgataactattgttaatataatgtattgtatacttgaaaattgctaagagagtagacattaaatttcttaccactaaaaaagacaagtatgtgaagtaatggctatgtaattttgtttgatttaataacttcccattgtatgcatatgtcaaaatatcacattgtacagtgcaaatacatacaatttgtatttgtcaattatatcttaataaagctgggggaatgttaataatggcaatgatggtgacaattgctgaacaattgctttatgctagatactattatttggtagttgatatagagtagtatttaagtacattggctttcaattcacagaaacctcgttttctattacacctttaatgagtacattattcagcagaagttagcttattcatgactgtcagagaaagtcttctatgacctcttggaactcaatttctccatatgagaaatggaaataaaacacctaccacacagaattgttactatagcagataatttatatacagcactacacaaagttttgaagaaataaaattcatcaaaaatatactgaatttatatatctttaaactttgaaattaaggtcaaataccatcatttgtgaatagagatcagaaaaaatggtatttgggcttaaactgcttcaaaaaataacacaacttccatttaaatttttttacatgtgcatggaatttggcaaatacggaattttaaagtattaaaatacttgctagagttcatttgtgcctaaagatatgcctcctgggttcaagcaattctcctgcctcagcctccccagtagctgggattacaggcatgtgccaccatgcccagctaattttttgtatttttggtagagatggggtagttctccaccttggtaggctggtctggaactcctaacctcaggtgattcaccctcctccgcctcccaaagtgctgggattacaggcgtgatccaccacacccagccaaattcttcttaatcaacatgaggtgggacttctatctgttctaatttatgtagtcaagttttcctattttctttcattaagacagaaagaaaactagaaaacatcagttttgatctttggatcactttaagtttgtgttgtttcatctcaattcttttttagaaaatacccatctaaaactaccagaagaaataatactcctacttaaaattccttttgatatggtttggctatgttcccacccaaatctcatcttgaattgtagtaatccccatgtgtcaagggtggggccaggtggagataattgaatcatgggcgcggtttcccccatactattcttgtggtagtgaataagcctcaagagatctgatggttttataaatgggagtttccctgcactagctctcttgcctgccaccatgtaaacatgactttgctccgcatttgccttctgccatgactgtgaggcctccccagccatgtggaactgtgagtccattaaacctctttcctttataaattactcagtctttattagtatgtctttcttagccatgtgagaacagactaatacaccttttaatgttttaatttctctgtgccatctctgaaaactttagctactttatatgcatatacgcactcatacccatcattaagagacaagaagtttctttgcttgtgaagactctctgacagtcatgtgctctaagaacaatttctgtggtacccttgaaataaacattctggtgaagtagaagaaacttcaacaagagcagcaaacagatcaaatttcagcaaatgaaacaaggttcaaagtctaattacaactgaattcaaattgtaccagtggtaccagtgacatttctttggcctgttctgaaagacagtgggtgtttctagcacagattgttagttttaatttgctcaaatgtgtttttattaccaattggtacagaggtggcaaaaggaaacagtctctggaggcagaacaaatggggaaatgtgttttgagtcccttttggcagcagtcagtttgatatccccaaggaaatgtttcttgacaataattataagacaaacatcaatatttggtttctaaatgtttgacaaaatggaaactatttttgccaggaaaatggaaccagtggatcccttcaaactcagtatttaacggaggcttaagaaaaggctataaaggagaaaatatggaaagtatgtgatctttaacccaaataggctgtaaagtcaatctaacacacactctagatttatcaagacctacatattctgtttttttaaggtttttagagttattttcatttgtttcatttttaatctttcgtgccttttactaacgcattgagttttctttgttcttttcccttgattctaggtttttttttcttttttcttttggaaattatgcatttaaaaatcttctaatggttactagagacaattttaaatatattaattttgctattaagttagcctagaattttaaaatttccgaacagttcaataaaataaatttaacacatggaactaaaattactattgccaggtcttacttggattctattctttttccaagtaaatgttaacgagaagagtagcaggaagaaaagtaaccataacaattggcagatatatttatttctctagcttttaaagtttattttaaacacacaaggcagaaatataggcaccaaacaggcaccacccaaccaataaagaatgttttataaaacttcaatggccttgtcatctgttatttatttttattcatctttgccccattttctttctttttccttctctatctacagttaataataaaaaataaacaggatatgctaaatgaatgtaactcaaggtgaagtttttttctgtaatcagaaattatataacattattctagagagcttcttcatttgctttatctaattaatatataactggaaatttccacttctaagtctgataagtatttgggatcaacagaaaacttcagtttgaatttttattgcatcagaaattagcagttaaccaatagtcatttatctgggcaatttataattatttcattcatttcacattaggaataatatctaagtaatcataaacccaagttctcctgtacccaagtttcttgacaagcctttaagctttgctagtgcttgttaccaaagtgatctcacagttcaccttttctcctctcaatgtggtataaaatccagccatggccctcctttgtttttaataccacattgggtgatggttctgtgaggtaaagagagcccgaaaaaaacaaatagaacatttcaagatgtcattattaattccacatgatgaatatttactgcagttgctatttagatgtctcagagggtatccaaattcatttgatgtaacatgaggaaactagcaaacaacatcattagccttggaaaaaaaacactggttaaaataactaaaaacaaacacaagccaaaaaaaagggggacaaaaagggtaacactttctcacaaacttgttttgggaatttctataaaaccattctgaccattagtcagcataacagtgtttttcagattttttggacccatatatatttactcaataaaatcatgactttatttgttttttaaaattggtacatgatgacaggtctgtgtgtctggcaggaacaatatctttctggtgtccatgttccttcacctcttgttactgtcatttataattatcaaggaagtaccaggtaaacaaatgtgactttaaaacaattataaagcttgtggaatcatacatggacatttaaaaaatatgaattaatttgtagggccaacaaactgataataattttgagccactgccaaaaaaggtaaataagattgtttcccacctacttaaaattcaatgcaaatgttgaaaatattcagctttattttcattcatttaactaatagttcctaaatatgtaaaaagatcttgtcactatgcatatcttggaactagtgaaataataacacacagcttccatttttgaaaaattcaatataaatgtggggaatatcaatcttattccattttagtctaagttgaaaatttgatacctcactcttacagtcacttttatttgcaaaacatcaattttactttctatagagcatcacatgttaaacaaatttcatcaaatgtctttcaagaaaataaatactatgatggcctgtccttaaacctaccaccaatagctaattttaaaaatgtacagtgagaattactcaaaattgtatttaatgatgctctgatgaagatggcaaactgaaaatgtggtattagtgtctctcttcatctcccattttttttgaaatcaaaacaacaacaataaagattacttaacaaaatcccttaacaacaacaaaaaaaatgagaaccagaaaatttgccctttgagggccttctggaaaatagcaaaaaatgatttgagattgacaggtaaatttaaagcaaagtcaattataacaatatacacaatgtgcatcctcctgcagggatgataattggtcttcctaataagtccctggaaaaatcccaaatctgtagtctgtgggtggacatggtgactggtcttcctgccatagtgggcaaggaacgccaatcaaattcttggagtatagagacgttcaaggtgggagactgggctcaaactcaagtgagaaaggcagatgcatttgatgcccttcccaatgttaatcattcttctctttatcaatcataaaaacccaaccttgagtatttgccctccacctacctaccaaaaggaaagcccaattgcatagaacccaaattcattcctctcattcataaggaaggctactgtgaaacaatttttttcacaattaagaagcccatgctagctgtgtatatgaatccttataatcattataattctccctttgtaaatcaagtaatttgcctgatagagcttttattgagtccatgggatgtgataagcactgatcaaataatgagatacactgaggtgaacaatccagacaaggtcattggcatcataaagttaactctcttacagagaatacaaatggtaaatgagcaaataaagaaaactatttaaacaagcaagtaaagaaaaatacagattatggtaagtgatacaaaagtttaaaagtcaggtgaggcgctagaaggtaataagagagtccctttataaaggaaaatcaaaagacctcctgtaacaatgtgagatttcagtagaaaactgaaagaggagaatgagccaaacatgtggaaagttacagaaaagaacatttcaggcagagggacagtcataaaaagggggcctggatacatagttgggaggagggcagcatctttcagaaaaacaaaggaagccagtgcgcctggagcataatgagaaaggtgacgattgattaaggtgaggcagtgtccatgtcaagaaaagctttgaagaacatagtagagcctggattctttttctgactcatgagatagcattaaaggttttactcagaaggatggcatcatcagctttacttctcaaacaatcactacattagctctgaggaaaataattgaataagggcaaagtggaagaagagagaccaataaatggtctctggtggtagtctaggcaagaatgatgtcatctcagactaggtagaggctttgggtatgattcctgggtttttggtttgagcaacagaaggatggtggtgatatttagtgagataggaaatattagggaggaataggatttagtgggaggtaatcaaattttactatctaatatgatatgtttgagatgtgtaatggtatgtttgaaggtgttaaagatgttgtctttttcagtgagagatcaatgtttgactataataataaaatatgcttacattttcaacatttgataacaattcaagggtaaccaataaaattttagatatataatttataaattccaggtaaccagaagaagaaaagagttaataaaatgccagagaaatataaacaaaagggaacgtgtaagaaaaaaaaataaaatcctactagaaacataaaataaggtggtgggatatatccaaatgtctcaataaatttaatacctgccagatcacccattaactatatcttcttggagagtgcagggaatactcctgtcacctagggtttgagaaatgcgtcggtgagaagagcactgctctgcagtggcttctctggaggccagaaatgacagcaaaaagtactgctataaaaacgggttctctgaactgaatagaatctatgagatcctatatttcagggatcaaatgcaagcattaaatggccaaagacaacatgtgcatggttaccttgatgggcagcagactcaaagcagtaatagaaaacggtctgacccacagggatctttggcattggctaattaatcatgcagaccctatggctaaaataaatatatagcctagtaacattatagttggtatatatcaataaatggccctaggtttggtgaacagaagttcgacttgaattgctcaatatggagttatggcccatttacatccccagatcctctttacttaggcagtgctgggtgtatttgagaattatactgcccaaaacttatgccctaaatttcctccagctttcctcaaaagaacttgtgatcatccaaaagaattattgttgatgggagaagggaaaataatcagatttttcagagattattgatcactggctctgagcagtggtttatggagagcagcgggttaatggggttttagcgtgagtccatctcacagttggcttggtaatccctcaaactcatgctgtgattattttctcaacccttctgggcataattggaataggcatactctcagagcaaagtttaagtggagacctctagagcttcctttgtcaaaatgataattcaaaatcaatactgcatttcttaaggaattacaaagattagtgccaccaaaatgtgcttgaaagatatcagagtggtgatgctactgcattccgatttaactaacctatttagcttgcatagaaaacaaatgaattttggagaataacagtagattacattaacttgatcagatggtgactacaattgcagctgttgatccagctgttttttccttaccaacggaaatcaacaaatcttctgtcacctgatatgtagttttgatctgttgaatgtttttccgccctctatatcttttagtaaatactgccaaaagaggtgatttaactggcagatttagctttaaagttttcactttcattatcttacttcagggcggtttccactctccagccttatgacataatcttcataattgtttcttcatttcatagaatatcatgttgattgataatattataatatgaatattttgcttattgggcctggtgaatagcaagtatcaaccactctagataccttggcaagacaaatgcttatcaaaggataagtaaatcctaccaaaatttagggacctgtaatcttgctattaggggctcagtggtctgcaggaggctgagatattatttttaagatgaagcataaattactggatctggcctattataccactaagaaagaagtacaataccaagtgatagtctttgaatattgggtatgatagtcattgttttttgaagaacacaaaagaatgtcatttttaagtggtcctgcaataagagaaggctctccaacagatccaggctgccatgccagatgctcttcctcttgagacatatgttgcattagatctgatgctgctgaagtatttatggcagataaggagtctataggaagattttggaaagtctctataatggatcacagcacagaaatttatgtaagtcagattcattccttatgacctcagtctttctacaagggctcattgacaaagtattaataaatgaaacaactggttgacagtcagttaagttgagttgctgccacacaatgcagtcttaaaaatgatctatcaaatttttactccagaaatacatcaaatgtgattgtaataaatgattctttttttgtatagtgctgaattatgtttgtaatctttcatttaggatatttgcatctctgttcatgagatatgtcagcttttaattttgcctttttataatatatttttcaaagttaaaattaatttggcctaaaaatacaagataaaaagcgtcctctctttttctattctttgtaaaagcttgtgaaaactagtgctatttcttcattaaatgtaagtaagatcagtctcatgctgggaaatatttaacagctggcttttcaaaaatattatatatattatactttatgttacacataacatgcaaatattatatatgtagtatatactgcatgctcattgtgaatttttactgctattgaggatgtgtaacacacaacttactaataaagtgtacgttctttactgtaaactctttattgccaattgagtctcatataatactttagtggctttctttcttaactcttgtgtccacactcagcctagaagagcaatttagccaatttgataaatagattttcatcctaatctattaaatgtcttccttttgtatttactgttattaatcatatatgtgatctactgatcaactaattcttaccttcatacaaactatatttttgaaactgaagcctctttacatttagcaataaatcaagccctcatatatattgcttaataatttctgtggtgttaactctcccaccctggctgatttcatgctatcaatgtgatatcactgaaaacaaaattgagaagagggacacagtagagcaccagtataagtatttgcaccctacagatacaacagatgttaataacctcaagagcagctaatagtaaaatgtaataaaaaataatgaggaagtggccgggcgtggtggctcaagcctgtaatcacaacacttcgggaggccgaggcgggcagatcatgaagtcaggagatcaagacagtcctggctaacacggtgaaacctcgtttttactaaaaatacaaaaaatcagctgggcgcagtggcggacgcctgtagcccagctactcgggaggctgaggcaggagaatggtgtgaacccgggaggtggagcttgcagtgagccgagatggcaccactgcactccagcctgggcgacagagcgagacttcgtctcagaaaaaaaaaaaataataataataatgaggaagtaatgagtttgggatattgatttttttcaatatgatttatttagttgtaattttaaatgttttaatttttaataatgactgtgttaaagaactagcttgcaaaatttctgaaattttagcagttgtcaggaacaagccatctccagtacaccaccattgaagtcatcagataatctatctgtgccaagagttttatttaaggtaaagtattcaattatagatttatttcatttaacagttttaagacaatagagactttttatatcttcttgtgtcaattttggtaagttgtattttcctagaaaattgtccttttcttctaaatttaaacatttattggcataaagttgcccactaaaatgtctcataaacctcttaattcctattactattgtccctttttaattcttgttatttgctttttgttagtctttatttcttgacccatcacaccaggagtttatcaattgtattagtttttctcaaaaaaaatttagctattgatctattttatgtttattgctacttcattaactcttactttgactctttcccttctactttttatagatttaaatttactgtcatttttctaagttcttgagatagaagcttagataattgatttccacctagcttttctaatcataaatgttctatgaaatgatgtatgtatgatagctatagatttttcatgaatattctttatatagttgaggaagatcccatcaattcctagtttcctgagcattttcatgaggaaatttaagatttcgtatgaagcacagctttaactgcatcacataaattttgatatgtagtgccttaattatcacttattccaaaatattccctaatttcctttgtgatttcttttttaacctatgaatatttccatttacaaactttggagtattttctaattatcttgtagttatagatttctacactaattgtaccatggtaagattacatagtatatgacataatcttttaaaatttggctaaacaaatggttaattttagtaaagaaatgtgtatcttgtgattttggtaccacatgcaaaggtatgtcatttggaccaaaaatattatgtttttaataatactcatattgagatgtgtgtttgttttctaaattaaaaaaaaagatggcaaaatctccccaaaataatgtagatttgtatatttttacttttaatccatcatttaaaaaataattattagatgacattattaacatgattcaggttaaaattgttccattttcctagtaaatttaaacatattattataaagtatatctcacaatatccagtgtttgtttctgtcttacatctcatttcataggtctgtaaactttgaatattatttataagttgtatatttttcacttttatttattttcagtttctgtatgtcctttagatatgctttctaaatagaacatggttgttgccattgatgttattattcttataaagtctgaaaatatattatatttacattaacttcatttacacttaacataatcacacacacatccatccatttgtatgtatgtactcagtgtatttcatcattaagtatcatagctgtagatttttcataaatatcctttatatagttgaggaagatcccatctattcctagtttcctgagcattttcatgaggaatagatgttaaatttttcttaaatacttatttgcacctattgagataaccaaagcatttttcttttctattctactaatgtgataaactatcatgctatattaatatagtgtataccacaaaattgatagttcaatgctaagtgagcattgtatttatggaataaatcccatttggtcatgatgtattattctttttggatattactggatgctgtgttatgttatatcttgctgcataataaattcccaataacacatttacttaaaacatgattttattatctcacagttttcattggttaggcatatgagcatggattaacttggttctcaaatcagagttttacagctgtaagcaaggtgccaaatatgatggagttcttatttggagcttagggtcttccaagctcattcaggttgttttatgtagaattaggtttcttgaggttgtatgactgaagtattcattttcttgctctctgtcagtcaatgactactgtcagatcctagaagctacttttgggttcatatcatgtgcagctcataagcagttcacaacatggatatttgcattctcccaggccagcaggagtgtataaatatgactttctcctctgcaactagctagaagaaactctctgtaaagatcctgcctgattagatcaggctcacctaggataatttcccttttagatacataacataacataatcatgagagtggtaactaattacaattatagcttccacccacaataaaagggattatataggcacatacaccagatggtgggaatcttgaggattatctcagaatcctgcctacgagagattttatttgattgaattttgtttaaaaatgtgtttaagaacaaagcaaagagacaacctacagaatgggggaatatatttgccaactatgcatctgacaaaggtctaatacccagtatatataaggaacttaaacaaatttacagagaaaaacaaccccattaaaaagaaggcaaaggacacaaacagacacttctcaaaagaagacatacatgtggccatcagcatatgaaaaaaaggtcaatatcactgaccattagagaaatgcaaatcaaaactacaatgagataccatctctcaccagtcagaatgtctactattaacagatactggtgacattgcagagaagagggaacacttacgcaatgttggtgggagtgtaaattagttcactcattgtggaaagcagtatggcaattcctcaaagagctaaaagctgaggtaacattcaacccaacaatcccattactgggtatatgcccagaggaatatattaataaatcattctaccataaagacacatgcacgcgaatgttcactgcagcactattcacaatagcaaaggcatgaaatcaacctaaatgctcatcgaagacagattggataatgaaaatgaggtacatatacatcattgaatactatgcagccataaaaacgaatgagataatgtattttgcaggaacgtggatggggctgcaagaacagaaaaccaaatacagcacgttctcacttaaaagtgggagctaaatgattagaacttatgaatacaaagaaggaaacaacagacactggtgtctacttgagggtggagagtgaggaggaagaggaaaaaagaagataactattgggtactaggcttaatatctgggtgatgaaataatttatacaacaagccctgtgataggagtttacctatgtaacaaaatttcacatgtactcctgaaactaaagtaaaagttatttttaaaaatgtatagagtagaatactggctactagaggctggatagggtgagggtgttggggaaggttggtcaaggagtacaaagttacaattagatagaatgcacaatgtttcattgctgagtagaatgatgtagttaataataatatattacatatttcagaatagctagaagagaggattttgagtgatctcaccacaaagagatgataaatgttggaggagatgaatatgctaattatcctaatttgatcatcacacattgtaaacctatatgaaaacatcacactctatgccataaatatgtatagttattatatatcaactaacaataaaataaacttaaataaaaagaactaaaaataaaactaccatacaatccagcagtcccactactgggtatatacccaaaagaaaaaaaagatcattctattagaaagatgcctgcacttggatgtttatcatggcactattcacaataacaaagatacaaaatcaacctaaatgtctgtcaatggatgagttggtaaacaaaatataatctctatacaccatggactgccactcagctatcataagaatgatatcgtgtcttttgcagcaagatggatggaactggaggccattaaactaagtgaaataactcagaaacagaaagtcaaataccccatgttctcacttataagtaggagccaaacaatgggtacacatggacatacagagtgggaaaatagacacaggagactcagaaaggtggggtgggggtgaggttgaaaaattacctattgggtatcatatttactatacataaaaatatatactaaaagcccagacctcaccactatgcaatatacccgtgtaacaaaactgcacatgtaccccctacatctttaaaacatgttgattctgtgtaccgaagagattttggtgagtagtttacagttttatttttccccttgtaatgtctctatctagttttgatagaaaatactgctattctcatgtggagggtgtttccctcctcttcaattttctggaagagtttgtgtagagttggaactatttctttgtttagtgttgggcataattgaccactgatgccatctgcgcatgtggttttctttgaggttaggggttttttttttattatactttaagttttagggtacatgtgtacaacgtgcaggttagttacatatgtatacatgtgccatgttggtgtgctgcacccagtaactcgtcatttaacattaggtatatctccaaatgctatccctcccccttccccccaccccacaacaggccccagtgtgtgatgttccccttcctgtgtccctgtgttctcattgttcaattcccatctatgagtgagaacatgtaatgtttggtttttggtccttgcaatagtttgctgagaatgatggtttccagcttcatccatgtccctacaaaggacatgaactcatccttttttatggctgcacagtattccatggtgtatatggccacattttcttaatccagtctatcattgttggacatttgggttggttccaagtctttgctattgtgaatagtgccacaataaacctatgtgtgcatgtgtcttcatagcagcatgatttataatcctttgggtatatacccagtaatgggattgctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaacgatcaccattctaactggtgtgagatggtatctcattgtggttttgatttgcatttctgtgatggccagtgatgacgagcattttttcatgtgtcttttggctgcataaatgtcttcttttgagaagagtctgttcatatccttcgcccactttttgatggggttgtttgtttttttcttgtaaatttgttggagttcattgcagaatatacattcttctcagcaccacaccgcacttattccaaaattgaccacagagttggaagtaaagctcttctcagcaaatgtaaaagaacagaaattataacaaactgtctctcagaccacagtgcaaccaaactagaactcaggattaagaaactcactcaaaaccgctcaactacatggaaactgaacaacctgctcctgaatgactactgggtacataatgaaacgaaggcagaaataaagatgttctttgcaaccaacgagaacaaagacacaacacaccagaatctctgggacacattcaaagcagtgtgtagagggaaatttatagcactaaatgcccacaagagaaagcaggaaagatccaaaattgacaccctaacatcaccattaaaagaactagagaagcaagagcaaacacattcaaaagcgagcagaaggcaagaaataactaagatcagagcagaactgaaggaaatagagacacaaaaaatccttcaaaaaatcaatgaatccaggagctggttttttgaaaagatcaacaaaattgatagaccactagcaagactaataaagaagaaaagagagaagaatcaaatagacacaataaaaaatgataaaggggatatcaccaccgatcccacagaaatacaaactaccatcagagaatactataaacacctctacgcaataaactagaaaatctagaagaaatggataaattccttgacacatacaccctcccaagactaaaccaggaagaagttgactctctgaatagaccaataacaggatctgaaattgaggcaataatagcttaccaaccaaaaaaagtccagactcagatggattcatagccaaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacattgatgcaaaaatcctcagtaaaacactggcaaaccgaatccagcagcacatcaaaaagcttatccaccatgatcaagtgggcttcatccctgggatgcaagtctggttcaacatacacaaatcaataaacataatccagcatataaacagaaccaacgacaaaaaccatatgattatctcaatagatgcagaaaaggcctttgacaaaattcaacagcgcttcatgctaaaaactctcaataaattaggcattgatgggatgtatctcaaaataataagagctatctatgacaacccacagccaatatcatactgaatgggcaaaaactggaagcattccctttgaaaactgtggttaggtttttaactatcaatttaatttatttaataggtatagggctgtctggtttatctatatctgctgaagtaagcttcaatagtttatatgtctcaagaaatttgtccagtacacttaagttttggaatttattgacataaagttgtacacaatattcccgtagtctttattattcttttaaaagttgtagatttatagtgatagtgtttctcattcttgctattgttagattttgccttttctttttttttctgattagcccaggtatatatttcttcaaagaaaaacttttgtctttattttctttgttagttctctgttttccattttattgatttctggactgatctttattatttcattgttaatgcatattttaggtttcatttatccttcttttttttgttaataaaggtagaaactgaagttacagttttcatctcttttcatatatgtattagtgtttagttgtataaatttcactttaagtgctgttttaggtgcataccacaaatgttgatgtgctctatttgtattttaaaaatataaatagctgaaaatgtttcccattctacttttgatatcttatttgaccttgggttattgaaaagtaaggcttttttttagtttctgaatatttggagatatctttttgttactggcatcttaattctattgtggtcagtgaacatactttgcatgatttgaattcttcaaagtttatggagacttgtattgaccctggatgtgaattattagtaaacgtttcatgtgttgttgaaaataacatgtattctattgttgggacagtagtgttttagatcaactatttcaagattgttggcagtgccatttaactttactgatttcctgcctattaattctatcacttattgaaataggattattaagacttctgacttataaatttgaatttggctatttctctttatacttctattagttttgcttcatatgttttgaagctctgttattaaatgcattaatttataaaattattattatcttcatgaattaacttctttattatgaaattaccctttttccaagtaatattttgctctaaaatctactttatctaatattaatatagtctttctagtctattttgattattgttagcttagcaataaatataattttcatccattttcgaacatctttgtgtctttatatttaagtgtttcatggacatcagatagttggatgtcatctttgtgtccaatctgacaatcttcgctttttaattggagtgattataatattaaaatttaatatgattatggatgtgtttgggtttaaattcaccatattgctatttgttttctattttctcacctgttttgttcctttttgtccttctctgacttcttttgaattaatttaatatatttttattattccatttatctccattgttatcttattggctataacttttttggtattatattagtggttactttgggattatatagtatacattattagtcattatcaactttcaaatgatattatgccatttcatatatagtataagaaccttaaaattgaatgcattcacttttccttgcctggcttttgtgttactattgtcaaatattttactcctccatatgttataaacctcacattgcgttgttattcctcttgctttatatcttcaattatctgtcaaaaatatttaaatgataagaaaaaatgtatcttatttatatccatacagttattatttccagtgttctctcttaatttatgtagattgagatttccatctaatattattcttttttctgttcctgaagggtatcattaaacatttcttgaagtgcaagtcttctaatgattaattcttttgggttttgtacgcttaaaacatcttagttttcttaatttactaaaaaaaaaattgctgggaatatttgtataggttgacaaatttcccatccaccaataccttaaaaatattgcttaccatcttctggcttgcattgttttcagtgagaaatctgcagccgtctatgtctctcttcatctatacatgttgtattttttcttcttgctgattttaagatgatttgtcactagttttaagcaatttgattcagatatgccttgatgtaattttatttgtttcttgtgcttgggattatttgagtttttagatctctggggtttgtagttttcattacatttgacattcttcagccattatttcttcatctatatgttttttctcctatttctctattctcgtttctttacataccccaggcatatgtatattagatcacatgaagctgtccaacacctcactcacacaccgttcattttattttcagttatttttcccctatgtttcattttgtagtttttacattggttttccagttcactgatcttttttcttttcttttttttttttttttttgagatggagtttcactctgttgcctaggctggagggcagtgcagtggtgagagctcactgcaacctccgcctcccaggctcaagcaattctcctgcctcagtctcccaggtagctgggactacaggcgtgtgccatcatgcccagctaatttttttatttttagtagagactgggtttcaccatattgaccaggctggtctggaactcttgacctcgtgatccgcctgcttcggcctcccaaagtgctgggactacagatgtgagccaccgtgcccagcctccagttccctaatcttttgggaatcaatgtccaatctgccattaatcatatctaatgcattaaaatttttttgacattattttcatttctaaaagtacaatttgggtcttttttatatccatcctccctctttttaacaggccaatatttcctataggtttttgaaaatatggagtacaattataagctattttgatgtccttgtctactaattatatctatttctcggatagtgtgttttgatagaattttctccttatgattacattttccttttttcttttcatgcccggatatttttataggatagcagaaattgcaatttttatcttgtttggtgctgcatattttgtgttatatgtttgtattttatgtattttttatatgagatttatccgtttgtctggagggagcccagtgcttgttccttctccttttttgcagtgtttttttctcctgtcctcaatttcctcatatacgtgtgctgatcaatcctcagctgaagactgaggggaaacctctgcacatattcagagtctctgttggagcagccctgtcttctctgggattttgccctatatactacagctgtctaagaatccctagactccaagctctgttgcctcacctcagggaaccaagatcctaccaaattcccacttcctatgaagtagccttgttgtctgaggtattacccagagttctttgtctcatgaccaagaaaaataaggagcatggacaccaaaggtgaggttggagtgacagtttaataagcaaaagaggaatcactctatagcagaaagggagcccaaaagagggttgccagctataaggctgagtttagggactttatggactggaatggagaggaataagctgactggtctacaggtcattttggagaaagcacaagttagaacgatgtatgatagtgtaaagaaccaattggaggcagaggtgaagtcttggcctggcaccttggccccggaccagtcaggtattgaagtgatgactcaccctatgtaaatgaatacttagcccacagccaattatagaaaggtaggcatatgtaaaataggtgaaaactaagagaccaataggtgaaaagtaagaaactaagtcatgccaaggagagacaaatgtgtccaaaaagaggttgaatttgttcatctcagttcacagggcaagcatttctattcaaggacatgcgctctttcttttctggggcctactgcttgattttcaggctgttctttgtttgaaggaattttaccaatgacccaccctaactgcctgcctgactgctttcttactttctcctttttcagctaggcatggcctctttccaggcagtaaactgtggtaattataggcctcaacttttttatgtcttgcctctcaggaataattgtccttcattgctggatgtctaacatattgaaaaacattctcatgtattttatgccaaatgacaaatttgtcctctgtaattctatattggctggaaatttaagtccagtgtgcttttcttttgatttatcctgttttagggtatattgctctctgtaatcaaacttgatttttaaaaacaatttacatttttttcaccacttcctttctatttctactcctacccatctgttattagtagctcctctacctctaccactccattacccatatacatgttctaccttttctctgtatctcttttatcatctttctgtacatatgtattcttttctttttaatctctttaaacttactcctgaaaattttcttctgacatgtctttcagtgcctaattatttttctaatatgttattgaacccatatttagagttcttactttggttttatatttctcagttctagaatttagatttattttgtttgtctagttttctgtttttaggtttccaattttctcttataaatctcattttctttccatctccttgaacatagtaaatgtacttaatttgaattatgtgtgtcatactttcattagctgtattccctgagcattcatttttattgtctgttgtttctcttggtttatgtttatgttattatattcctcatcttccactttcattttgaatgatagatactgaatacgaaaaaaagtttagaaataattttaagccttggatagtgttcttccttcagagaggaatttatttgcttctgctaggaggctatcaaggtaccagcaagtcaaaattatagagctggtatgtttccaaagtcactcttactcccaaggtattatcttttgtgatataactacagagaacagagaaataccaggtgcctctttctctatgttctggaatctaatatttttccactagcacaggattgtcaaaatgatcactcaactccttagcttctcatcctcttcttgatttagcaaacaatatcttgaaaaatgcaatgccaggttggggcctaccttactgcgattctgccttcttttggatcctggcctaaacatccttcatagtcttattagatgtctaatataagtagatatttttaatacttttttcagatttattaattgtttcaatggaagtgttggtctggattgccttgcttctgattactagaatataaaattccattgttattctcacgtttttacataagtacatgcatttgtttgataaaagtaaagtcaatcaaaattaaatgcattcggaaataagtaaattttatttgatcagcagtaagaatccactataaattctggttgaaggtagagacatgaaggcaatattattggagaaatggatagaattagaaatttttaaaataataattgactataaatgtccataatttcaaatggggctaaattttcataactaatcattatattagtagatctttgtttgacctaatagtaaaaataagttagtgtgctaattaattgttcacagattttctattacaatgctagtagcagagattttactttgagccagagtcaaatccaatgtaggggtggaaagctatttgtgtgtatgtgtgaatgtgtttgtttgtgtgtggtcagtgtaaacttaaagagatttgggtgaaattaagtttgggagaatgatcaaaattagaaatatatgatataagaattacttaaagttttatactggaaaaaataaagtgatttactacaaaaattaattaggaaatatctatgtgagctcactattttagtaagaaatatatatttcagcactgtcaccaaacagacccagcagggagtgaataccatcagtgaacatggagaaaaaataaaatatttatacctagtgccgatatttagactctatttcactctaaatttaaacttttatgtgaagagtaactgatttcatgtctttgaccaggaaaacattaaaaataaaaagtgtatgaaatattgctagaaagcaaagatgcttttaaaatgtctgggggagtattgaaattaaggcatttccataagctaaactgttaccaagtgagactgaaaaagagactaataatcatggccaataggcattaaaagaatgaaatcatatcctttgcagtaacagagatggagctggagaccattttcctaagtgaactaacttagaaacagaaaatcaaatatcacatgttctcacatataagtgggagctaaacaatggatacatatgaacataaagatggaaataatagatactggggactccaaaagtggagagggtgggagggggctgaggttaaaaattacctattgggtacaatgttcaattaaaaaaaaactatgtgaaagaaatggagctaaaagtcctattgatatagtaagtgatgtataatttttagaaatgttttaactcaatgtatgttagttctaatttgaattaccagttcataatcaatatcaaagagttaataatctagatgctataactttctgctatctggttacattctttttgttagattacctttaccatggaaaagtatcaaaataatatcattacctttgtgagtatcagaataatatatattactgtacaaagaaagtataagaatcaatatagaataaaactcatggagtttaaattttaaaataggtgcagttggaactcttttgttgagtttgtgagtgctgagcttctgtattttttatcttccgtttaagaggtttgatgtattttttaaaatacaataataaattcataattttattttaaattaataagatcatttaattgattaatcttagcatttaaaaacatattaatcaaaatgtaggtctcctaaactgagcatgaattaaagcaggagaaaacccccctttgtataaatatccctgagacattcaagatatctaggaattctgaattttaacatgtctgaccacgtctggccaactgttaaaagagtcaagagaggaccatgtgtaaaggctttctataggcaaaaagaggcaggccaaaataactttcccattacaaagccttcgtcattacaaaggtggtaataattctcactacaccatggtggttttcaacagcctgggctaatagccacgtgtctgagtccttatgaaagaaagtgatataagtaaaaataatagggctgtggcaggccaggtctcactaacagctgaacaggcaggcctccatgacgacttttttagcactgactgagtggttaagttaaacattaaaagctgatagggccagtgcccttatacaaaggctggaatgtaacaaaagcccaccaagggttttgccaaggcttttcctgggccctgaagcgtgacaagataatgagggaattcttaacaggacccgtttaagattaaacaagttttattgggggtctgaagaaactctgcagacctccacaaacaagttttattggggaactccccaaacctccatgatttcgcaggagacaagataagggtaatcacccctatcacctggacccatcaagattaagtaaatttactgaggctccagagcaaggccttaaggactcagaccttagttatagattagaagaagttaatcatttgtgtctttagatgaatgcacacttacacttacaggtagacatgtagcttagaaggtatataagcgctggaaaactttgtaatattgagttggtctggtaatactttctcggccttctccttgtacccagtaacagaaataaactcttctttcccagttcatctgcatctcgttattgggccacaagaataagcagcctgacccttggtttggtctgagaacagggccataacgcaagagcacacaagcagcaactcatgtcacatagaatatactacaaaggtatattcaactcgcaacacatcagtgagtagctttgatgccatgagggcattggtgcctcagtggtgatgcctcaggttagctccagatggagcaataagttgcttagcagaaatcctagtgcctaacagagtacttgtaggcctgccaaaaccaaggtggctgaaagagtacctggaagatctgaagacacagctgggtaagtgcagtgggatagttcatggacaaatgacaaacatgctctagaaacacttgggctgagcttgtcagggatgaagatcctgcaagatgcgatttggaagaatggcagcagtaacaataaatgtcactaatgttaatgtgacctaatatacataaatgctttaatatctggataacttgtatttcatacttattaaaataaattctgagggtataaaattgtaacatcattgttctaggggaaattctggctatgtttaaaaataaagaatcttttaataattgaaattttaaaactctcaagtatgaatatttctactatggtaatttataatacaaatatagtttttaaatgttgaagcatttgttgaaattcattttattgccatgaccaaacacaaataaaaataatttcattatagttttatataaatgagcttagtgggaatgcaaattctcattagctgtgatgaaaagacacctatcctattaacaaaagaccatctttgaaaatttgttagcctctgctactttttagacagcattctatgtgctcagcttaaagcagtgaacaagacagagaatgtctgtgcttccacagagacctacaatgtcagggagggagggagaaatatccaaacaagaaacaaaaaggataacgcattggtaggtattgtacctctactttctttgggagcaattgtcatatataaaaactctcaaggacattggacattgcccctttataatggtgaccatataacttactgcttgaaccagggcacttcagagagtaaaaagtaatgcttaaaaaattaaataatttggctgagcatggtggctcatgcctgtaatcccagcactttgggaggctgaggtgagtggatcacttgaggtcaggagtttgagaccagcctggccaacatggtgaaactccgtatttactaaaaatacaaaaattagcctggcatggtggcatgttcctgtaatcccaactactcaggaggctgaggcaggagaattacttgaaccggaaggtggaggttgcagtgagccaagattgtgccactgcactccagcgtagacaacagagcaagatactgtcacaaaaaaatcaaacaaatgaagtaatttaatttttaaatatttattgactgataaattagtttgattatatttattgacctgcaaaacacttttgctaaaaaattacattcaaaaataactttcttaaaaataatatacatctgtacatattaaagcaaaattttaaaaaatcccattcattatctaaaattaaacatagactaagtaaattacttattcttggtacataatcagtttttaaactttattttcttctaatactttgtcactgatatttttctgaagcacttagatttttttcagctggtcttatttttatttttccaaataactccaataatttttaaagttatattttatacttagtaactttaaaacagtttataattcttctctaaagaaaatattaatggagaaaatattctttctacatgtgaggtacttggtaatctcaaaaaatttttttgatgggcgatattatcaatttttgttcttttcatattgaaatgtgtaaaattttaaacccatgtatttttccagttattttcttcttttttctcctttagaagacctttctttgataaatatttttaagctaaactcataaaataaatcctatttattaactttttgaatagtttacatttagatacaaattgtagaccttcttaatttaattttatcctagtatagagtgtaaatttatccaattaaaaatagcagttatgtcaaaagattctttcaagtcaaaacatcacaattacaggatttccagattaagtcttgtgaactgtttgatctttcatttttcattctgttcagttccacactttatctggtagaaataattttagtattttctggtttgtaagctttgacttccaagtcttgatataaatttaaaaagtggctgaagattgactaaaggagtcaataagaaatttccaggtgtgatagaatcattctatacctcagtggtgtaatggttaaataaatgaatgcttttaggaaaactcatcaaaatatacatttaagatctttatattacactgaatgtagatcttactatgataaaaaatcaactgaaaaaataaaaaactcagagcttatgtgagaaaagttaaaaaacaagatgaaataagctatataatccaatatcatttatataaactaaaaatatgtccacacaaaataacaatacatgtttcataaaacacatacggggtgaaaaaacataacattcaatggtatagaatggttgctgtggttgggtaggggagaggggagcaggggaaggagtggtgcagaggaaaagtgagaataaacaagtaaagtggaatttgcttccatggacctttcacgtacgtattcctttcagatacaactttctgacctaaaatgcaacctatgcatttgacgaaggtctaatttccagaatcgataaggaacttaaacaaatttacaagcaagaaccaaacaactccattacaaagtgggcaaagaacatgaacagacacctttcaaaagaagacatacacatggtcaataagcatatgtaaaaatgctcaacatcactactcactagagaaatgcaagtcaaaaccaccatgagataccatctcacaccagtcagaatgactcttattaaaaaggcaaaaaataacagatgctggtgaagttgcagagaaaagggatcacatatactgctggtgggaatgtaaagtagttcaaccactgtagaaagcagtgtgtggattcttcaaataacttaaaacagaattaccattcaacccagacatcccataattgggcatatacccaaagaaatataaattattccaccgtaaagacacatatgtgcatatatgttcatcacagcactattcacaacaccaaaaacatgaaatcaatctaaatacctatcaacagtatactgaataaagaaaatgcaggctgggtgtggtggctcatgcctgtaatcccagtactttgggaggccaaagtgggtggatcacgaggtcaggagattgagaccatcctggctaacatggtgaaaccccatctctactataaatacaaaaaaaaaaaaaattagccatgcatggtggtggacacctgtagccccagctactcaggaggctgagtcaggagaatggtgtgaacctgggaggtggagcttgcagtgagccaagatcgtgccactgcactccagcctgagcaatagagcgaaactctgtctcaaaaaaagaaaaaaagtaaaatatggtacatatacaccatggaatgctatgcagccataaaaaagcacaagatcatgtcctttgcagcaacatggatggtgctggaagccattatcctaagcaaattaatgcaggaacataaaacaaatactgcatcttctcacttgtaattgggagctaaacaatgagaacatatgaacataaaaagagcaacaacagataccaaggcctacttgagggtggaggtggaggagggagaggagcagaaaaaatatgtactatgcttagtacctgggtgaccaaataatctgtacaacaaaccccagtgacctacataacaaaccttcacatatacccgtaaatctaaaataaaagtttaaaaaattaaagaaaatatgttatcagaattttatgaacagtcttgttaaaggaaattttacatatttacattgtgaatttgtttcttggctaatccagtctacttgagagtaaaatttcattaaacttggacaatgaaaattcttctccctatagtcaaaagtaataatcaatataatttgactctaaaaattctaaaatgcacatgactaattttttttagtatgaaggaagaatgaggggaaataggtctgtggcaaaacaaattaactctgattctatttttcacacattttgaataagagattcacacctgccatttatagaagtgtaattttcacagtcctgagggtgagtatccaccttctttatggaaagttaagctatacagttttgcaaatagaatattgcatttgatttaagattgttgatttaaggtaaatatttgcacaagcatcatagtccatttgttaagaaaaaatgataattccttagggccaagctcattttcaagatagtgtttcagatacacccaatcagagaatttgttggttccaaattagataagattgtagattttaatctatggaatcagtatctaaagattaaaaacatgacatcacaagatgcgagaatgttagaatgtattattgaaccaacaatgaacaccatttgtaggcttttggctgtagtatgtgagaaaaattatgcattctgtcttcctgacatgctctcttcaggcttcataatgttgttttggtagcagtgtaaagtattctttattattttgtaaatgtgtcctcaaaataacaggtattattttggtataattctagttaagtaaaactctggcagaactgttaagttatagagtaaaagacatttctacaggttggttaaacccctacttatagctcctatatattactcttgtgaatggctgctgataccaagcaaagattttaagggttattaatttaacttcttctgatgtactcaacaacactttctaaaaatcacatgcagtaatttcctcctacttacttcaagcattaagtgaacagatttgtataattttgtatgcataattttattttaatctataatgtaggtgccatcactaagttctgctgaagaattgattactacaaatatttttgttttctttaatttggaatatatatataaaatctaggaatacaaaatgctgtataatggaatccaaacttttcattttttgtatttatcctttagaatagtaaaagttcatgcatgcctttaggacaatattagagtaagttagtagaaagaaatgtagaataatgctattaggttttctgtgttttttcactttcccatataaaatgtggtttcctaaggttagatgggaaaacgacagttgttttctaataatcttaatttctagttctgctctcaatgtctagctctgctctctacaaaccattattttcattcttttttatttaggtagtaatttgatataattaatacactcccacccaaggcacagaaaaaataattataacaattcattctaacatgtgttctcctttaatattgtttcacaatgaaaatatggacctttggtaaaaacataatttctcctcttcgtttgaaaatgtaaaaatcataggtagcttttgtgatactaggtgctcaaatacttgtagtattttatgatagaaacaactctgtcaaagattgtgttaatcttcttaagcaacaagaattcctattggtcttttccttacacattaaattgaaccaaataatttcaaaagtctcaaaagctgtgaaattattataataattggaaatgtgtcaaagtgtggagtatttatatgacaatttcatttaagctttcagggcactattgaaacacatttcaaccttaaatggccatccaggcagaggctttagaagtaaattgtttacattgattcacaatcccataagcctttatagtaaactatcctctttgaatttactaccttggttaattcagcagaaaattgctttctatttctgagacccgcttagaaggcttgagcagatttttttttaaaaaaattgttctgcgatgatgatgaagggagacttgagaatccctttgaaaaatagaattgactacagaccgaacagcctgtgtttatggataactgagcttcacacctctcactgaaggtgagaaagtcctattgaagatgacaaagcccttatcacagtgcctggtacaaggtgggtacccaaatgtgtgtccctataagacagcagcaaagaaactgttactcctcaaaaactctcatctccactgaatgggtataggacatagaatcttcctgtacttaagcaacttttaaatagcactttatacactctcaaaagatcaattacatcagagtagctatggcttgtgaaagtaaaaaagggaagtgagcaatatcttaagaatacctggcagataagaaatgcagctgttatgattgcctaactgaccacctgtttcctgttgaaggagccagttgtactagtggagagattttaaaaggaattaaaatacattcttcaaatttacatcaaaatggatatcatactatctactgtttcatgattaagaacacatacaaagcccttcttttatcatgcctatagttcctggtgttcctgaaaagttatagtgagactcaactatgtactgaaagaaaggagaggtagaaatcatactcagcagcaaatgggatgcctgaatctgaatcccagctctgcagtttactaaccatgtgactgtagaaaatgttccaatctctcttatttttctcatctcttaaatggtgatactaataatagttacatcctagggtgttgtgagaacgaaatgagttaatatatgctaagcattcagaacagcctgccaaataatgaacactacgtaagcattgacttattaatattttgttattactttataagcacgaattttctgtaatcagggaaagaaagagaaaagcaaagaaaccttgatgttccaagcaagtaaatactcaagttcatccagttgtgtttctatcaaatgtgaggggtttaggagtagactatcttctttattttatacctgatggaacttaggcaaaagggaataactggcttgtatcagatgatgtcagtcattgattcagtcactttcagagcttttctttttatttttctttccatgatgagcatttactctttcaacagccaaagatcatttccacgttcttctggtaatgaaactgagcaggtgtcccacagagctgatgttcgtggtttctttgaataaacatagaagttggccctcctagttttaaaacctgagaaagttgcatttgtcttatctgagttcctttccaaggaaaccagccatcaggcctcccaaatagtagcaaggagctgaaagtcaccagatcactgcatttggacaatcagatgcccgacactttatctgttaagtttgcctaactgaccacttgcttcccattgaccagctgctcttctttacccctccctaattcctgttttcccacacatggttacatttcttccctgctatatcagctcctaattttagtcagtcagggagatggatttgagacctcctggcctcttggctgcagcactctattaaaggcttcatctttggcaatacttgtttcagtgataggctttctgtgaagcaagaaacaggatctagaccgaacatctggtgttttggtaacagtaagtgaacacaatttcctttgaaagttgtccctcgctgacaaggatgccagttgtatttcaccaagcccggtaagggtcattgacctgcgcctggccaggcagccaacgtattgttggatgaatgttacaaaagaagggctgctgatcttttatatggcgcttaatatataaatactggataacagaagcacactttactctgagatcagtgggctgacatcatgtaaacttaaggctgtctacaaatatggcattcccatttttatcttccatctgggggaagcccagcagcaatggaggaaatgaggccaacacataaagtgaagcagagctaatggatgaaagaagaattctgatggtatcatttaagtatccggagtcttgagacctttcctacatctggatttccaacatatgaaagctaataaattgctcatttttttgcttaatctattttcacttgaagttctgtcaattgtgatgaacagagagccaactaaaacaaaaatactgcaaatggaaaaatcctaaaatgtagatttgacagaatagaaaagggagtgaagggaagtatggctcttacattttacaataacgcaatagcaaagcagctggtagatctataacctattataccttgggtcttgaaccatatatcaaccaagggtggcacttcatgggcatggtagagaaacatcatgttgttaatgtgtttattacctcttgtagcttccagtaacatccaaatggaaagtgctaaatgtttagtctaagccgttataaatgagagcacatagagaaaaatatacatctttaggaaaggtggctgaactgcaaccaatgactggcaaagattagataatcataaggtttgcaggattaaaattcaattcccttttatagaccaagttggattatctttctagattaattagttaatctaaaatgtcaaacactgtgagaaataaagttggaagttaggattcagggcaataggttggggaatgggagcatgtgtgatcctccgggcctcttacaaacacctggtgctttgcaaactcttacacaacacaagtataatttcatacattaaaatgtgtgttttaagccttggacccattagttatttttcctgaccctctccctccttcctaccttctaccctccaaaaggccccagtgtgtgtcattcccctctatgtgtccatgtgttctcatcttttagctcccacttataagtgagaacatgcaatatttgagcttctgctcctgcattagtttgctaaggataacggccaccagctacatccatgtccctgcaaaggacatgatatttacaacaaacccccatgacacaagtttacctatgtaacaaatctgtacttgtacccctgaacttaaaatacccccatgacacagatttgttacctatgtaacaaatctgtacttgtacccctgaacttaaaataaaagtttaaaaagtgtgcttttttactagacggaagcttggaggcagagggaacgtatatccatcaacatccctgcctttttctattttctattgctattagacaaacaccaacacaatcttttaagttgaaaattaggaataaggacaacactcgcatgccaattactaagggtcagaaaatactcaaatgctgcctcaatttgaaattctgactggtaaaaattctggccttgattactagctaatgcaattaataagagccagccaattacagttttatggaagttgaattgtcagagaaatctaattttggcatccagtagcttctgactgcccaaaacttaagttaatttttcttttaggttaacatttatatggaatggaaaaggatgtttgagacaaaataataaggtcagagatcattaaaaggaaacattatagatttgacaacattaaaatgtgaaacaatggcatctcagaaacgaacacaaatgtaaaagacaaactgaaaatattagtcacataagccttagtatatttcataaatcaatataaattgatgaatgcactaatagaaaaataggaaaaagtgacaaatattcaattcagatcaaagaaaaactagccattaaacatttaataaaataaaatgtattaataaaataaatgcattaatgggatagttttttatctatcaaactagcaaaggatttaaggaaatgagcacctttatacactgtagtgtggggcagaaagaaattctttaaacattttcatcaaacaacttgtcaagagtttttttttgaaactttaaagtagctataacttttaacctagtaaatcttttcctacaagttaatgcaataaatagcaaatagaaagatgggcaaaaatctatatacttaataaaatatatttatctgcattgtttacaatccttttaaaatttttttattattaaaaagttatgaacacatatagttgtacatatttatagggtacatgtgaaattttgatataagcatatcgtgtgtcatgatcaaatcagggtaattggggtatccattacctcaagcatttattattttttcttccagttctactctttaagttactttgaaatgaccaatacatttttacctataactatgttagtataccaccaaacactagatcttatttactaaccatctcctctttatgccctcctccccaccacccatttcagcctcaggtaatcatcattttactctctgtctccattagttcaattcttttttagcacttacatgttacagagaacatgcaatatttgtgtttatgtgcctcttttacttcacttaacataatgtcttcaagttctatccatattgtaaaaaatgacagaaattcattatttttatggctgaatagtatttcatcacaaatatgctccacattttctttatccattcatcccttggtggccacttaggttgatttcatatcttggctattacgaatagtgctggaataagcatgggagtgcagatagctcttcaatatactgattgcctttattttggatgtatatccagcagtgggattgctgctggatgatatggtagttatattttttggttccttgaagcacctctgtattgttctccatagtggctgtaatctacattcccaccaacagtgtacgagggtttccctttctcaacatcatcaccagcattcattattgcttgtcttttttataaaagccatattacctggggtaagatgatatcttgttgtagttttaagttgcatttccctgatggttagtgatggtgagcattttttttcatatgtctattggccactcgtaggtcttcttttcagaaatgtctattcataactttggctcatttaaaaatttgattatttgtctttatcctattgagttgtttgagcaccttatatattctggcttttaatcctctgtgagatggtgatacagtttggctctgtgtccccacccaaattttatgttgaattataatctagtgttggaggtgggacctggtgggaggtgattggatcatgggggtggttcaaatggcttaggaccatcctctagtgttgtttcatgatagagttcccatgaaatctgattgcttaaaagtaggtagcacttccccctttgctttctccttcctgctgccatgtgaagacggcttgcttcccctttgcccttctgccatgattgtaagttttctgaggcctccccagccatgcctcccatacagattgtggaactgtgagttaattaaacatttttttaaaataaatcaccctgtctcaggtagttctttatagcaatgtgagaatggactaatacagaaaattggtaccagtagtggggtattgcaataaagatgcctgaaaatgtggaagcagctttggatctgggtaacgggcacatgttggaactagtttggagggctcagaagaagaaaggaagatgagataaagtttggaacttcctagagacttgttgaatagttgtgactgatatgctgatagtaatatagaccatggagtccaggctgaggtggtctcagatggagataagtaacttactggggagtagagtgaaagccactcttgctatgccttagcaaagagactggtggcattgtgcccctgctgtagagatctgcagaactttgaacttgagagagatgatttaaggtatctggcagaagaaatttctaatcagcaacgtgttcaagatatggcctggctgcttatgaaagcatatgctcatttgcataaacaaagcaatgacctaaaactagaacttattatatttaaaagggaaacagagcacaatgtttagagaatttgcagcccaaccatgtggcagaaaagaaaaacccatttctggggaggaattcaagactgtagaaatttgcataagtaaagaagagccaaatgttaatagtcaagacaatggggaaaatgcctccaaggcattccagagaccttcacagcctggaggcctaggagggaaaaatgttttcatgggccaggtccaggacctgctgctctgtgcagccttgggacatggtgtcctgtgccccagctgctccagctccaaccatggctaaaagaagccagggtacagctcaatctgtggcttcagagagtgcaagccccaattcttggtggcttccatgtggtgttaggccttcaggtgtgcagaaggcaagagttaagctttggaagcctccatctagatttcagagagcgtatggaaacctctggatgtccaggcagatgtcagctgcaggggtgaagccttcatggaaaatctctactagggcagtgcagagaggaattgtagggttggagcccccacatagcatcccagctggagcactgcctagtggagctgtgagaagcaggccactatcctgcagacaccagaatggtagctccactgacagcttgcactgtacacctggaaaagctgcaggcattcaacaccagcccatgaaagcagccatggaggcagtattctacagagccacaggggtggagctgccaaaggccttaggagcccacgccttgcatagcatgccctagatgtgagacatggagtaaaaatagactattctggagctttcagatttaatgacagccctgttgggtttcagacttgcatggcacctgtagccaattggttttggccaatttctcccttttggaataggtttatttacccaatgcctgaaccaccattgtatcttggaactaactaatttgttttttattttacagtctcataggcagaaggtactggtctccgctgggactttggacttggacttttgagttaatgctagaatgagttaagtctttgagggactgggccaggtgcagtggctcatgcctgtaatcccagcattttgggaggccaaggtgggcagatcatgaggtcaggagatcaagaccatcctggctaacatggtgaaaccccgtttctactaaaaatataaaaaattagccaggcatggtggcaggcgcctgtagtcccagctactcgggagtctaaggcaagagaatggtgtgaacctgggaggcagagcttgcagtgagccaagattgtgccactgcactccagcctgggtgacagagttagactctgtctcaaaaaaaaaaaaaaaaagactttggggaactgttgggaagtcatgattgtgttttgaagtatgagaaggacatgagatttgggagggaccagggcacaatgatatggcttagctctgtgtccgcactcaaatctcatgttgcattataatcccccaatgttcaagtggggccttgtggagggtgattggatcatgggggtggtttctaatggtttagcaccattcctctagtactgtctcatgatagagttctcatgagatccggttgtttaaaagtgtgttgcacttccccctttgtgctctctctcctgctgccatgcgatgacatgcttgcttccccttctgccatgattgtaagtttcctgagacatccccagccatgccttctatacagcctggggaactgagtcaattaaacttcttttctttataaattacccagtctctggtagttctttttacagtgtgagaacagactaacacagatgggtagtctgcaaatattttctcccattctgtgaatagtctcttcactctattgattgtttcctttggtgtgcagaagatttctagcttgatgtgatcccatttgtccatttttgctttgattatatatgcttttcaggttttactcaagaaatctttgtctagaccaatgtcctggagtatcttcccaatgttttcataaaactgacatgaacagcaactgaattgctggactggtttagtcaccagaagtggaagtcttcgtggtgtacctttgaagtattgtagtggagacaacaaggaagaaagaccctacagtgagcagagctctgggcagcaagattggcagaacaaagaacttacataaagttcaaggggtaggaaaacttcttctacccacctggatatgttatggaccagaaaccactattgccagtaccttttcctctgtttctaagtggaaaacacttataatcattcctcccactatgatttggataagttaatcacattttataagatcccaaaaaaccagttctgaatcttatcagagatcctgcatttggaattggataaaggaacgagatgttattggatagcaactagatgtttctggagaaagaaactagttgttttcctttagtgaaggaatatttccacttccatttatatagggaagagctaattggggctttttttttttttttttttttttttgaggcagagtctcactctgttgctcaggctggagtgcagtggcgtgatctcggctcactgcaacctccaccctcccaggttcaagcaattaacctgcctcaacctcccaaatagatgggactacaggtatgcaccaccacactggctaatttttgtagttttagtagagatgggattccaccatgttggccagtctggtcttgaactcctgacctcaagtgatccacctgccttggcctcccaaagtgctgggattacaggcatgagccactgcgcttggccctagttgaggaatttttgaaatcagtagtttccctcttatctacaggggatatgttccaagacccccattgtatgcccaaaccactgatggtacccaaccagattgccatcaattggaatacatttctgtttacatattccacccacaaacttaatatcttttccattttaacttagcacttatcacgcggccataacttttccaatttgaagtgcaacagcaaaactagcacggattcctgttccttcttcacaatctcatggatagaagatttgttcttactgtagatcttagcaacttcagcatatgatttttttttctttccttattaactcaaaacttctacatctccacttaaatggagcactttagggattctttttgccatatccaaattgccaggattactactctcatgcatgggccattattaagtaaactaagggttccttgaacataaggagtacccatacctctatggtctgaaagcaaagtcagctaataagtgatgcaggctggtaacttctacagtgtggatacactggacaaagaaatgattcatgtcctgggctgggtgaatcaggatgtgtgagatttcatcatgctactcagaacggtgtgtaatttaaaacttaacaattggtatttctggaattttctacttcatattttctagaatgtagttgatctcaggtaagtaaagcaaaccacggataatagaaagcagaaccacagataagagaggatatatggttcaaagactaaataaaaagggaaattggaaagatcataatcttagacaatttgacatttcagatataaatacgacgcacacacatataaagaacatagagtcaaagtgacaaatattgtcagttctttcttatattacatcataaatcagtagaattcagatttatattccaatagggattacaataaaatttgacaagacgaacctaaaacttaaaattaaaaaaaaatgtgaaaatcaccagaacaaattttacttcattaaaaaattaatagcattattgaaatataattgacatacagtaaagtgcatatatttaagtgcatacattttgataaattttgaccctacagttaagacagtgaacacatacatcattcctagaagtttctttgcatcctttgtaatccttcccttccgactctccctaccactggatgggtatagatagatttgtaaattaatgttttttgtctttcattattttaaagatgttgctccactatctgcaggttcttgttgttttggataagaaatctgatgccatcctcatctttatttctttacgttatataatgtctgtttttctctgcttttaaaatgttgtctttatcactagctttaggccatatgattatgatatgcttggtgaagatttaaaattatgcgtctttcgacctttgggtttgttgaactttttcatactgtgcactatagggttttttttttctgtttttaaaatcaaatttgtaagatattttagtcacaacctctttagctttttttttctgtaccatttctctcctttcctcctgggatactaatcacacataaggtaggctgcttgaagttgtcacgctgttcccttatcttctcttcattattattttttagggttttgctgtttcatattctatagtttctatttctatgtgttccagtttattgattatttctcctgcaatatccaatcagccatcaaatccttccagagtattttttatttctgtacgaattttcagttttggaattttgatttggagtattttttaaccttctatgtttctacttaacatgctcaatctttcctctagcttttcagtcatgtgaaacacagctataataagtattttaatgcctattaataataatgtgtgtgttaattctagtttgctgctgattggttgcttttccgcctaatttggggttggattttcctgctttttatatggtttttctatagaatgccagccattgttgattttatcttcttaggtgctggggattttttcattgcgataaatacgaatgacctttgttctgagatgcagttaagttatttaggaagagttcttattcctgagatttattaggtagtatcacagcagtatgtatactagagtaattagaggtgtcttaggttccttggatttccagctttatcatctcaaatcaggaagtctaccaggctgtgtctgggtcttttcttcctgctccactggctggaatactgaaggcagtaagctgtggcaactgcagagctaagcttgtttatttcctatttttcagtgatcattgtccttttttcctgatatccaatatcttgaaaactatagtttcatatattttaccctgattttcattgtttctgctagcagggtaaacctggtcctttttgttctgtctcagttgaaagtataaataaaccaagatgatttggagcaaaagatgtgagaaaatttgctctataagaaaatacagtcatgtatcacttaattacagggattcattctgagagcagtaggttagcttacaccagcgtcatcacaaacacatgagtaatgcattgcactatagtgttaggatggccatgatatcactgggtgagaggaatttttttcagttccattataatcttatgggaccactctcaaacagacaattcattgttgaccaaaacaatggtatgcagtcagtgcatgactaattaaaatactggttatttggtgtgaaattaaacaaattctattggaaagaaaatgacctgtatttgtatggaaaattagcactgagttattgtaactttttgacttagttaagaacctatagactacttaaaaatggtattggaaacattgacaagtatttggcaaaactagaattatataccttcttcacttcaatcacaaacatacaattctaattggattaaagatctaaaatagaatatacaaaatcataaaatttgtaaaagaaaataatttcagaactgtgagttattgaagctttctataaactaaaattataagccataaagctagattaacaaatttcactatgttaaaattaaaaatgtctctgccatcaaaaaaacttcaccattaacaatgttaaaagataaacgacagatgagaacaagtgcacataaaacagccattggattaatattaaaatacgtaaaggtttaccaaataataaaaataataggccaatggaaaacagagcagaaaatataaacaactgtagcatttaacaacagaaaatacatataaccaaggacatatgaagtagagtcaagcattttaaaaatacacattggtggccgggcgcagtggctcatacctgtaatttcagcactttgggaggctgaggcagtcggatcatgaggtcaggagatagagactatcctgaccaacatggtgaaaccctatctctactaaaaatacaaaaattagctgggcgtggtggcgtgtgcctgtaatctcagctacttgggaggctgaggcaggagaatcacttgaaccagggagttggaggttgcagtgagccaagatcgcgccactgcactccagcctgacaacaaagtgagactccatctcaaaaaataaaaaaaaaagaaagaaaggaagaaagaaagaaagaaagaaaaagaacgaaaagaaagaaaaaattggcaaaaattagtttgttaatatcaaatgtaaagctatgggaaataagtagccccccccaaatttaaacattacatgtctaatgaccagttttatttcttattattatacactcagatttaataccacggttaagaacaagaggaataaacagagattttcatggcaatattgtttattataaaaaatttgaaaacaaattatatttccatcattgggaaaataactaaactacaaataaattgcatgcatagtatagcatacactatataaggttaaaaagtgacacagaaaagtctccaaagggattatgatggtgagagaaggcagtaggaagcaattatcataataaagcatttagcatgatgaagtatccatcagaaacacaaacacacacagcaacactgtacacttctctaaatagttgcttgtatgagtacatgtgtatttaacacattaaaaagcctaaaaatatacctgttaaatgataatctgggataaaaagaggtattacatgtagtagtcaaaaagcatttaaccttaacctataatatttcattttttatcagtgacaatgcattctacattgcttgtgtaattctataaatattactatacaaaccagtgctaaaatgaattataatatgggaataagcatgcatatggggtctgtatatgcatgctaggaggccacttagtggaatgtagtgggtgcctcttatttttgtacacagcatccctttctccttttccagttaataggacaattaaattcctttttatagttttattttgcataaactaattcaaattgggtttgtgtcatttgtaactgaacaagtccttattttctaacacattttccgttttgttgtcattgtgttttaaaaatgtaaaaacagcacattactatgcaacttccagtttatcttgaagaaatgagtcaccacccaagtatggagcatgagctttatctcacgggattggaaaggcagactgggaaaggaatgacactttggaaatttactttgagaaatgtctgtattattaaacagaataaggttttcatttctgtattctttcagcaaagctactaatctgagcaacgtggaattaaaattgtagactaataaaaggtaagatatataagagtaaagtatataagattctaacaatagagattttgataatgggtagttgcttcttatttcccttctgtcaacagccacgcctcgagagcccagctccgggaccctggcaccaggggaagctcccatgacagattactgtggtctcttgcatgctgctatagattgcaatactgagaccatgataacctgccactccccaaaatattcttgtcttgcctacttgctcaaatattggaggatctgaagaaattacgaagaagttttgatccttagtaatcagtgaggattgtccagaaaaatagaaccaataggatgtgcgtatatatatgtaaatgaaagagatttattttaaagaattggcttatgagattttccagacttggtgtgtccaaattctgatgaggaagcctggaaggctgaagacttaggaaagagttgcaatttgtgtccaaaggcagtctgctggtgagccaggaagaactgatgttgcagatgaaatctaaaggtaggtactctgttgtcagaatttcctcttgcttgcaggaggtcaggcttttgtctacacgggcctgcaactgattgaatggggcttgcccacattgtaggggatactctactcaaagttcaccagtttaaaggtagatctcattgaaaacacctgcacagaaacaatcataatgtacaaccacatatctgggcactgtggcacagctgtgttgacacataaaattaaccatcacacttagtctaacatctttcaagcatttccaaatcggttttaatttactggtggacctatgacttatattgaaaattttaaatgaaaataataaaattcttttgaaaaataaagataatatagttatgtacattaaaacaaaaactttatatgactacctgattatgaaaaatggtattaattaaataattatttttggtacatatttggaattttaatctttcttggccatatctctaatattatgtcactggagttctttagcaaaaaaatatatttttagtatggtcctactttttctttttcttgtaacattcgttcagtatttttaaagttgtatgtcatggcaaatcaatttctgataatctcagagcaaattctacaaactggaaaacacagtcaattgtaattcttttcataaagaaatacataaatattttaacagaagtattgtcataagtataatatttttgtctccatgtagactaccatgttgacaaatatttttagaagacatcaaataatttgccaccatttatgattgtgtttaatattttgtcagatgtaaatgctgcaagtacgtagggcttctgaatgttatttcattcaagtggaggatataaacatatccaatacaaatagaagttccaattttttcataagtcaagatattccaagatgcaattaaatctcaaattttaatttcatatgctctttgagctcttgtttaatttgattggttcccgtgtggctttttaaagtaaaattttgttgtatggcatacatactgaaaagtgaacaagtcataaattatacaggttggtgaaatttcactaagtgatcaacaccagtgtaactaccatgtagatcaaatcaagaaatagattattatcaggttcccagaaagttcatcctcatatctccttcacatcagtgactattgcctaatgcagtgactatttgcattcatagttgttggggggtttttcagctcagaaaaataattattgcccattatccatattattaggatattataatagtgaagtagttcagtgtgtatgtgtgtgtgtgtgtgtgtgtgtgtgtgtaaaagagagacagataaaagacagagagatatagtaccttcaatttcttttggattatgtgttgctacgtcattcattacatgttgctatgtcattcacagaaacatcaggagtagacaagactgcctgttactgtgtagcactcgatccatttctgttttgatttggagatgataaattaaggaaactcttcttggtatgttcatttgtgaggatggtcagtgtaagaattagatgccagtgtatgtgtagatccttcatacaaagcctagaacaaccatttggaaaattcagtgccaatttcttgcagaataatgtagtgaagtgggttccctgggtgcctggctgtaggatggcaggtgcctggaaatgtaaccaagagaacaaagggagaggcaggaggtaaaggtactgggttgggaaaaccaataaattataccgttttttaattcccgtcctgaatttaaaaccaattaagaaataaaacatggaaaagacactgatgaggaccaaatattggttttaataatgataaagctaattggagaatttggctttagttttcataacaaaggacctgctaaaactcaacccagggaaactttgggtctgataagcaaatatactgatctgggatgatgaccttaaatgggtggagaagaaataaaagaagattaatccccagtgcttatagatgtttaatagatgaggcttgttaatttacaaacatggttcagtggtgtcagatccttgccaaccaacaacaaatactacactttctatatggagaggaataggaaagggatgaagaaagaggcctgaacatcactctgcaagagaaaacaaaaccagataaatgaaggttccttcctaatgttagtcatcacatataacctttttacagagactaaatgtatatctaaatgctgccttgtgttatgatcaagataagtttaatgtaatggttaaaaactatggtaatcacatatgtctgtatatagagaaatttaatcatcctcaaaatataaaaatgaattatttggacaaattagtcaatactttggttggtggtctatatgttatattgaagtataaattattccagcctttcaaatatatagataaattttgattagtaatgtgatgccagaattccagggattgtccatttcacccattgataatgctaagcaactctaagggactatgcagaaactaaaaaggcaggaaaaagtcattcgaacaacaaaagtcattcgagcaagaaaacatgacctttattccagagtagaatttagtatacattattaaaaggttgatatgcgagcaactgtgaaagaaactagtgattattaaagccagcatgtcctcattaaacaagttatgtcacaataactacatttttttataacaaggttgtaagattagtaggctatggaagttctaagaaaaaaatagaaataataagtgcaagggtaacaacagtggcagtaatgtttactttaatctattaagtctaagagttaatagacttaattgatagacttaaaacaactggaatgctgcctgatacatggtaagagcttaaaaacaaactatttttatgattgtcattattttttaagaaactttagttgggttaaaatataacacgtattattcataaaagattttggaaacgtgttaaatattgtctaaattgataagttggaacagatcggaacagattttattgtatataggtgaatttgcaactgggtcataatattgaaagaatttaagataaagaaataaattcagtggcataataaaggtctacaatttagactcttctcactgagcattttcattaatgacttcaggaaggcaaagttattagatagaagataaaataaagctgaagggtagcaaatcaggaatccaagaactgtttctttctagaaaaacaggctgaatggaataaaattaattataatagtgaaaattgaagaacagcacacttaagtaaaacaaaaacccaaaaaagaactgtccatgtgcattaagcatcagtattacttagcatcagtattagtggggagaaaatatttgtcgaaaagcaagcttattatgagtcaaaaactgtaaaataaatcttcaataaaataaagcaattctgagcttcactaaattctaatttgttctatgtgtcagaggtattgaataaacatcaattgatagaagatgggggaaaccattttcactcaagctctaaactcaccctgcccgtttattgaccaggctggagtgcagtgtcataacagctttgaattcctgggctcaagtgatccgcccacctcagcctccccagaatctagaactacaggcgtatgccactaagcctggctaacttttttttttttttttgctagtgacaagggtattgttatgttgctcaggcttatcttaaactcctggcctcaagtgatcctcctgcctcaacttcctaaatagttgggactagtggcatgcgccattgcacccagtactaaagttaaactttctaaagattaattgaaactatccaaagtggaatgcccacgtttggggagcagtttattctcaatctttagagtactttgagcagtacctggaaaccttgtatagccagagtttcataatctaaggtcagaaataaataaagaggttgtttagaaaataaggatgactggaacctactcctttatattctgatccaagaagcctgaagtgggtacaagcttctcatctgctttcttttgtatttactatttactttttttttctttttacaacactgttcctgttgataacccaggagtggaaatctgacctggattgtggatcagacaaggcattcctaaagcacttaacgtgatagagatctgaaacatatgtaaagagggcttataagggcgttccaggcagatggaacagcatgtgcaaagcctctgtggtaggcaaaaagcataatatgatgagtaattaaaagacagcgggagtggccagaacagaatgtgaaagagaaaatggagagatgagactggagaggtctatattactgacaacacacggccttgtagttcatgttcacaattttgacctttgtctaaaagcaataggaagccactgaacagtgtcaattaggaaggtgacatgactggattatgattttgaaaggcttgccctgtctgcggggtggttaatagattggagagggacaaaagattataccagaaattcagatagatgtctatctcagtggtccagttaacagattaatgatcatttattttgataaggtgacaagggagatgaaaaaattgatgaaaaattgatgataaagtgatgaattcaaaagatatttgcaaattaatatcaataggacttaatgaaaggttgaggatgggattggagtagaaaaaagtttcaaggccctgttctttcagggaatatttatgaaaccactactatgtgttgggtactgttgtaggacttaggggtacaccagtgaacaagatgaacaaggtccctgagtttgtgaagcttacttatcagtggagaagacacataaacacataaagaaataataaaataataaaataatcacatgtactttgaggaaaataaaatgctgtgacgtgatagagagtcgttgaagaaatgtttaaattagtggtagctagagagcatctcaaagagtagttaagtgttaagctgaaacctcaataacaagaaggaactcatcatacgaagaaatagaactggagccttccagaccaaaccaaaaataggcagtgcagatgtcctaatggaagaacaagtctaatgtctttaaggaaaaaaataaggctactttgtttggaaaggaatgaggagggatgccatggaaagaatgacggttggagaggcagggctagatcatgtagggcctggtagatcatgataaacagtttcaacttcatgcaatgcctatgtaaaagtataaaggcttttttttggttggttgtttgttttaataggaaggtcatcaagatcctattgcagcaattcagaagggaagcaatgatagtgatttggactagtgaaccattagtggaaaatggagaaaatgaatacaattgggattattttgagggtaaaaaaggaagaatttgttgttggattagatgtgggggttcaagaaggacagccctctttctcagtttttagttgaacaactgagaggatagtatcatatccttagaggaggaagacttaggagaaaaatgtttttcagacagggaaggaagaataaataatttcagatcatccatgttgtttaagatgtctattatacacccaagtgtacataaaactttgatcaagactagagatattatctagtttgcatatctagatagatggtgctgccttttattgatataagaaatcttgtctgaagtgctacttaatgaagtgtgtggtccaatgagatactaagcattaaaaaggtaaagtaagtatactgctgaattcattagtagcaaccttgcaatggtgctattagctttcctaaataaagaaggctgctgggtttttttgttagtctgttttttggagatgtcagcaggtacaggaaatgggaagaatgtgtcttatttgttaatctcattttttttcagtaaactagcttaatttcagaatttcaattagggtcattcctcctctgcataatcaatttctgatttggagtctttattatttatttatctatattataaataatataataaatatttattataattatagtaaatgtacagtggcatctcattatgattttaacttgcattttcctggaaactaatgacgtttgtcatttttttctgtacttattggctatttgtatatattccttggagaaatgtctattcaaatttttgcccatttttaaattgggtggtatttttgttgttgaattgtaacagttaattatgtattctggtactagatctttattaaatatatgatttgaaaatattttctcccatttggtgaattgtcttttcactttcttgatagtgtggtggatgcatgaaagtttttaattttgatgaagttcagtgtatctatttttcttttgttatttatgcttttgatatcatatctaaggatcctttgccaaatcagattcatgaaggtttactcctgcgttttatactgaaacatttatagctttacatcttacatttcgctcttttgatccattttgaattaacttttgtatatggtgtaaggaaagggcctaacttgattgattgattgatttcgcaagtggctatccagttccagcatcatttgtcaaaaagactatttccactttggatggttttggcacacttgctaaaaaccagttagccatatatgaatagatttatttctgtattctcaattacattccattgatctatcatagccattatctttgttttttgttttttttttgtttttgttttgtcttttgtgaggcggaggtgtgctctgtcacctaggctggagtgcattggtacgatcttggctcactgcaaccttcgcctctgaggttcgagcaattctcctgcctcagcctcctgagtagctggggttacaggcacctgccactacgcctgttttgtttgtttgtttgtttgtttttgtttttttagtagagattcggtttcatcatgttggtcaggttggtcttgaactcctgaccacaggtgatctacccacctcggcctcccaaagtgtttataccaatactacactgtctaaactttgctttgtagtgagttttgaaatcaggaagtgttagccattctacttctattcaaaattgttttagttatttggaatttttgaaattttagagtcagcttgtcttttttttttttttttttttaagatggagtctcactctgttgccaggctggagtgcagtggcaagatcttgatcactgcaacctccgcctcccgggttcaagctattctcctgcctcagcctcctgagtatctgggactacaggcatgtgctaccatgcccagctaacgaggtttcaccattttggccaggatggtcttgacctcttgacctcatgatccgcctgcctcagcctcccaaagtgctgggattataggcgttagccaccacgcccggcccagcttgttaatttttaaaagaagtcattttgatacagattgcattaaacttgagatcagtttggggactgttcccttcttaacaatattatgtcttccaatccatgaacatgggatattttttcaattatttagatcttctttaattcctctctacacattttgtggttttcacaatataaatttttcacagctttgttaaatttatccctaagtattttaattctttggatgctcttatacacagaattattctcttaatgtcattttcagattattcatggcaaatgtatcagaatctttgtatattgatttattttgtaaccttgctgaactaatttattaattgtaataatagtttttagtgcattccttaggattttctatctacaacttcatgtcatctatgaaccaggataattttacttcttcctatccagtatgaatgcctttatattcatttatctttcctaatttccttagctagattttatagtacaatatttaatacaagtgtcaagagcaggtgtctttgtcctgttcctgatattgtagggaaaccattcagtccttcacaattaagtatgaggttagccagaggttttttatagaccttctttatcagttaaagatgtttccttcaatttctagtttgttgaatttttaaaaaatcatgaaatagtattggagttttctgaatctatgatcatatatttttctgaatcatatgctcttccctttttattcattcatataatgtattacattaatattcagttgttaaaccaatcttgcattactagaataatggtcctatatggtcatgatgtaaaattattttttatatattgctggattcagttagatagcattttgtagaagatttttgcatcttcagtcataagagatattggtctctagttttcttgtgatgtctttgcctagtttggttaccagggtaatactggcctcatagaatgagtggaaagtatttccccttcttctattttagggaagagtttgtgaacaattggtactactttaaaaatatgcctggtggaattcagcttgaagccacctgatcctgagcttttgtttgaggatagttttttttttttaattactactttaatacctttacataatatatctccattcaggttgtctatttcttctcaagtcagttttgctagcatgtgtctttctaagttatctaagttatctaattggttgacatacagttatcatagtattaatttataaccctttttatttcctgtaggttcagaattaatgtcccctaatttgagtcttctttttctttttttctttttttttttttttttctatctttttcatcagtcatttagctaaagatttgtcaattttattgatctttttagaaaaccaacttttggtttattttatctattgcttttttattctcgaattcattaatttctgctctaacttttcttatttcctttcttctgcctgctttaggtttagatggctcttctttttccagtgtcttaaagtagaaggttaagttatttatttggctctttcttcttttttaatataggcatcttcagctttacattttcctctaagcagtgcgttagctgcataccgtacatttttatatgttgtatctttgttttaattcatctcaaagtattttctgagttcccttttgtttttgtctgttttttaaaagtcatttcaacttttattttagattcagtgggtgtgtatgcaggtttgttatataggtatattacacgatgctgaggtttggggtatggataatcccatcattcagatagagagcatagtaccaaacaggtagtttttcagcccacagtcccctccttctctctccactctggtagtccccagtgtcagttgtttctatctttacatctatttgtactaaatgcttagctcccacttagaagtgagagcacatggtatttgattttctgttcctgcattaatttgcttagcataatggtctccaactgcatccatgttgctgcaaaaaacatgatttctctttttttatggctgtataatagtccatggtgtatacataccacattttcttaatctaatccaccattcttgggtacctaggttgatttcatgtcttgttattgtaactagcactgcaatgaacataccaagtgcatgtatctcttttgtagaatgatttgttttcctttgggtagataccctgtaatgggatttctgggttgaatggtagttctgctttaagtactttgagaaatctccaaactgctacccacagtggtagtaccaatttacactgctaccaactgtgtataagtgttctcctttctttgtagccttcccagcatctgttgtttttagaatttttaacaaaggccatcctgactggtgtgagaggatatttcattgtggttttgatttgcatttctcaaatgattagtgatgagcatttatttcatatgcttgttggctgcatttgtgtcttttgataagtgtctgttcatgtactttgtccattgtttaacggggttgttttttccttgttgatttgtttaagttactatagcttttggctattagacttttgttagatacatagtttgtgaatattttctcccattctgtaggttgtctgcttactatgttaacagtatcttttgctttgcagaagttatttagcttaattaggccccagttgtcaagttttgtttttgttgcaattgctttttgtgactaagtcacaaattacttgccaaggccagtgttcagaatggtatttcctggttttcttctaggatttctatagtttaaggtttgagttcccttttattttttgacttattggttatttaggagcatgttaatttgcacatatttatgaggttctcaaatttcctcttgctattgatttctaactccattccatagcagtaggagaacatactttatattatttgcatcctttgaaatatattgagcctcaatttatggcctagcatatggtctattctagacaatgtttttggtgaacttgaaaataatatttgctgttgctgttgtgttctgtagatatctgctttttaaaaaaattttgacacataaagattacacatatttatggtgtatatagtaatgttgcgatacacatattacatagtgatgagatcagggtaatttgcatatctttttcttttatctagttgtctatagctgttatcactggcaaactagctagcctacattttagctagtatcttgaatctcttcctaatatgcttttactacaacctgcactgtttctgagagtgcccttaagcttgactttctccctgctctgtcgcaaatgaaatcaatttctttgacaataaattaggaactatctgtttcatggcccacttttccctccaggtgaaatctgtaaaccaggactctagagctggaaaagggaaaaatagcaagcttttctccaagtgtctacctttccctaggaagtgagtgcttctggagtggggttagggggcagccagaggtcctttcctttacctcttctggctgaacaagggcaaaggtgatcggggcctcaggcttctcacatcactatgccttatgtaaagcttccattctatgagtggaggctctgaggcagcatctcaatgacacccaggacttagcctcagcaacaggtagctgagggcagcatgagaaatgctgatgtcctactcctcccaggatacatatacaaaaaaatgatttctgactcagagctttggggagagggagccctgtgcttttgactgcagcaatctagagtgaagtctttaccttgctgagctgggagggggtagtaagggaacagtcttgcttcagataccacagatgctcaccttttaaaatagattttctttaattgctgtttctccatatgctatttatccttacaaccatttccagaggctttacatggttatgttttaaaattgatttcaccagtttcaataaaggtgggtcagtgaagcctctcacactgtcattctggcagtcaacgcctaatatacggttctaaacactttacctctggtattcagtgtttatgattatagttctataagagtcatttgaataagtgttacttggccctcaaagggaataagaattctcttttgtcttaaaaaaaaaaaaaagaaatgaaataaaacaaaaaataaaacaaaatctgtcttgggggattttatgttacatgaaattctgccttaacaatttaatgaaagggcccggcacagtggctcaagcctgtaatcccagcactttgggaggccgaggtgggaggatcatgaggtcaggagattgagaccatcctgattaacaaggtgaaaccccgtgtctactaaaaaaaaatacaaaaaattagccgggtgtggtggtgggcacctgtagtcccagctactcgggaggctgaggcaggagaatggcgtgaacctgggaggtggagcttgcagtgagctgagatcgcgccactgtactccagcctgggcgacacagtgagactccgtctcaaaaaaaaaaaattaatgaaaagatatatatctgctttcatttagtgttggtatgtaggttggtaagaggtatgcaaattgcataccaaaacagacctttcctcccacattctaaaactcctgctgagattgactcgtctttctagatttttgtagttggttctcacagtgctactgtaggcaagtgtctactttagtccttgaccgtaaacgctagggcgtaaataaagaatatatttagattgttggtaatatatcacctctatcaaaaatgtggctgaattgcaagctcttgttacagaatgaacagcagtctttacaagaagcagcagcacaatattaacatcatcatagtcactgtgtgctctaccaaggagaatctccttcacacaaagggatcatcactgaatacatggggatgactctagcttcagagtgtgtgcagcacagtagagagagcactggagtaggttttcaccctaaatgtgttgttaattaactctgtgactttgagaaagttatccaaacctctagacctcagtctactcatttatggtgtgaggggattgaatgagatgatcctgttcatcttcagtaatctatgactgcatgtgatattaggtgcacttgtgggacataagaaaatagaaccaataattcctgcccacaaattttgaaagatataatatgataaccaagaaaatatttaaacatataaggaattatggcaaatgttaaacagtatagaaaataattctctcatggtcaaataaggatattttgtggatataaatcacctataaattctaggtatctgtttagctttcagtaactctaaagagctaaactgtgggagggcgaggtcatttccccaagagcaaattgtgagttccacagaaatctcagcaatagggggaaagattcataacaaactctagtatttcagaatacataataaaagacatttaattacaaaaaatgtaattttaattacagaatctattaaatacagtgaaaaatctagctgcagtgcaatactgacaccttagccagtaacaggcttaaaatgaaacagcagaaaaattgatttctacctgtaactacctttggtttcttttattggctcaatgatgcaggtataacagaatcaaacaagtaattgctgatggctcccatcaactcctgcctgtatctctaaggtgtcagaagtggaaatagttgctcttatgggtaatggcatatatgggaccatttgtctattttgaaagctttatgaatcattttcaaattattttccttgatacattgtagtatcagctattgtagccctcttctgctttccttgtttagttgcacctccatgctccatgttcttactcattttggatacaactaaatgtcccatagtgagtcacttttcataattagctagcttaagggaataggttttatttttagtggttttccctataatttattttctgcgtaatagaggaaagagatttgaatgtgctgtaaaatttgtagatgctaaaactcattttagttgagtcatgcagttagaataattttaagctaggatttgatgtaactgcttttattgcacctacactatgatttccttaacaaaaacgtttttttgaactattatttgcattatagtatcctgtgagttcaaaagcaattaggctatggctaagagaaatgagctagaaacaataaataaaatctatctcttttagtcaaaacttgcctacagctagattttataatttggcattatatcatacaggggaaaaaacaacttacttgggagtaaaaaaaattagccaaattagacatccactattcagtggattttttaaaatattgttttaaataaaattcagtgggttgaattcaactgagttaacgtgttctcaatatgaaggcatagtttttgtgtttgcagaaattcagagtgtatagttccaatagtctgcaagattaaatgtctaaaagtggaattttacatattttatgattaaggcccagcctgcctttctgcaggcaactgaatctagatgttttcaaggaactctcattttacatcagtaatttattggccaaatttaaattttaagttttgcatgcctttgttaaatttatttctacatattttattttttcgatgctactataaatattttttgttaattcctggcttgattgttcactgagaaggtataaaatgcaataagctttcgaatattgatcttttatactgcaacctttctgaacttattagttctaataaatttttacagaattccttaggattttctatataccagatcatgttatctgcaaatacagatagttactgcttcctttcaaataggaatgcctttaaattcattttcttgtcggattgcttggttagaaccttcagcacaaagtgactagagtggacattcctgtcttgttcctgatcttaggaggaaagcactcagtcttttatcgtcaagaacgatgttagctctgggctttttgtacaggctctttatcaagtgaagaagttccccaccccctattcctaacttgttgaccatttctatcataaaagtatgttaaattttgtccattgctattttttttgcatctattgagacgatgcattttttgtcttttgttctattgataaggtatattgcattatatgatttttagatgttaattaaatccacctttgtcatagtgtgaaatcttttaaaatattgctggatttgctttactagtattttattggaagatttttgcatgtatattcataggagatactggtcgatagtttaggggtttgtgtgtgtgcacaaattttttttttttttttctgatggagtctcactctgtcacccaggctggagtgcagtggatccatctctgttcactgcaacctctgcctccctggttcaagcaattctcctgcctcagcctcccgagtggctgggattacaggagtgcaccaccatacccagctaatttttgtatttttgttagacacagggtttcaccacgttggccaggctggtctcaaactcctgaccacaagtgatccacccacctcagcctcccaaagtgctgggattacaggcatgagccactacacctggccatgtgtgtgctgtttttgagtagtttttgtttcaggttactattgactgcataaaatgagttgaaaagtgttcctttgtcttccacatcttgaagggtttatgaagggtttaatgaatcttcaaatgattcattaaatttaccagagaggttacctgagcctgggctttctttgtgggaagttttaatataatattattaattcaatctgtttatttattatgtgcttattcaaattattttttcttcggtctattttggtactgtatgcatttttatcaatttgcccattccatttaatgtgtttactttgttggtatataattcttcacagtatttttcaataatctttcaaatttctgtaaagtaggttgtaatgtctgctctataattcctgatttaataatttgagtgttccctttctttttcttggtcagttttagctaaagatttgtcaattttgttgatctttctaaacaactaacttttgggtttgttgattttctcttttatttttctatactttatatcgctaatttctgctccaacttttagtatttcctttacttcttgctttaagtttagcttactcgtctttttccagtgtcttaaatgataggttagttcatttaattttatatcttatctttttaaaaaaaatagatgtcttgcagatacaaattttgttctaagcactattttacctgtgtcccataaatttgctatgttgtgtcttcacttccttttgaattactctttaaaaatacttttaaatattttctaattttctttgtgatttcatacttaaccagtgggtcaggtagcagtgtgcgtgttgtttaagttccacaaatttgtgacttttccaaatgtctttctgctattggtttctaatttaaatctattgtagtcagagaatattcacatcctttgcatgatttcaaaccttttaagtttgtatatatttgttttgtgttttatcatattgtctcttctgcagaatgttccatgtgcacttgagaagaatatatattctgctgttttgagttagtgtgtcctataggtgtctgttagatctccttggctcataatcctgttcaagtcttctgtttccttgttgatttttccctagttgttctatccatctctgaaagtggagactgaagtctccaacaattattgttgaactatgtcttcctccaatttttttagtatttgtttcacacattttggagctgtgacattaggcacacatccatacatttctaaacaaactcctagctgtttatgttaacattacattatctttctatagacatcatttaattatgtttcaaatttctatctgaagatatgtattaggtaccatggcttagcttacttaatcttcatttcacccatcttccagagtacattactctacttcagagaccagaaatctaaaatctacatttgtcagaattctttgcagctacagttctgtggaaattaaattttacatacataaaatttggaagatagaggtacacagaagcagagcttctcttattcttcttaccgtctatttttgctgataaaatcatgaaagcataaggtttttctgcagctattttccattcactgttctgtagatttctggttgtccaaaggtagtttaggaggtataagcagagttgttggagctttaattctatcttctagtccttaaatcataatgtgaaggtgtgttgaacccaatagttttaaaggtgatctagtaaacagcatctctcagtgggtcatttctgcactgcttggaaagtcatatgtagagactcattttagatcccattcctccagcttttccaatcattttaagcacctaattacaccctatttccgcttaacacctaaaatagtttctatttcatgcacagagactttactcataagagtatttggagccagaagaggttacttgcaacagaactacaaagatgggaatcttagatcctttacctaacttatttagaattaaaggcagtgatgtccctattaaaacaggaaataagaatactactagtccatgccacatgatgacaaaaccgcaccttaaaattttaacttgatgtcatctgcaacaaagtagctactgagaataaggctatggcagatggagtgattcctacaacagaaaattttggtggtacttttgatgtgtggtttgagaagctgaaggtaactgcttgctctgttgactgaaacctagatttagaagcaattaagatgccagtttttttgttatgagtattaacatatttaagagacaggaatgtttaagattaactttataatatatactcccctcactttatttgttcaaatgaacaactaagtccttatttgcttaatataacctgtatgagtgtgaagaatagagtcctaatttaagccaccacaatggagagcgaaatcccagacctcagtcagcagagacacagcaatgcttaaataaattggaaatcaaatattcttgagaaagttccatgacatcattcttcaagtatatactttaaatattcttcctagtcttttccaaagaaatctttagctatttcccatggtttttgtaccttaaagaaagaaaaataatcaaagattttgagtattcatgctctcagtccttcaaagtacacagtctctgcagacacagtgttccactgtgtctctcaggtatgactgagggcttataagggtaaggtgagaaatggagatttgacgaaactttatcccctgtggctctctgggtctagaaactcattttcttgctatttcccctgttttgaatggagaatggaaaaatactcttagtaactggaagaatttcgttaactttcagaggaccattatgataggaaaaaccaactagaagccaaataactgcctctcccttccaaaagagtcattcaaaagcaatagcacatcttgaagggaattagtgccaccactatgtagtagattgctggaagcataatcaggtgatgacaacaattgtagctatcaatccaggtgctgtctctttactggagcaaaccagtttgttttcaccaccactagaagtaggacacctatactggtttacctcaggtagtgtcaaatctccagtgctgtgtaataaactcaagaaaatcttcattgtcttaccatactacagatcatcacaaggatatttccaatgttgatgtcagaatgccacatggacctggtgggccagaagtatttgctatcccagttgtcttagaaagatacaagtgcattagaatgtggaaggtaacccagtgaaaatataggtgcctgctaccttggtgaaatacacaagcacattatcagtatactcatttcacagtgaaacacagttggctgcacattcatgacccactggtgttggtaggcatttctggattttggatgctgcatacattatatttaagggtgctgctctgaccatttactaagtaacctataaggcaactggcttagaatggggctcaaagtaactaatttaagctgccagtcaagcagatatggtattacataacacatttttatgaccaagtagatatagtcaccgttgatgtttctatggtagattaggacattgtataaaggacctggaaatcttcaataagataatcacacccctataattttggaactaagccacagaactcaccaaatactattgtatttcacctttgaaaaaaatagcttctggcttgctagttagcctcagaggtagaaacactatggggagtttttattattttgggagtcatccttggaggtctagcttagagccagatctttgagttcttttgatgatattttaatatcttatattaaacctctttctgcttaagtactttgagtaccttcgattccctctactgactctgacttattggggatgccattattgggttataagtcatgattgacattagattaacatgtaagtgtagtgaatgcttataacgtcatattgtcttggcatccattttaaatataaattagaaaagatatagtatttcacagcacaacatggtggctacagtcagcaataattcgctgtacattttagaataactgagggagtacaattggaatgtctttaacacaaaagaatgatgaatgcttgaggtgacggacaccccatttatcctgatgtgtttattacacattgtatgcctgtatcaaaatacatcatgtgcctcataaatatatacgtgttctgtgttcccataaaaattaaaaatacatacatacaaacatacataactataagttgggttttctcataccaagaacagggcttagtcacccttgatggtttccagttctacacaacacactcctcttccctcagttcctcaatatagtagatccataaacaactgctccctagtaaccactttgctagaaaacagctaggtgcatgcagcctgcttgactggccccgctgaccctcacacctcacatgggctgtgcacagtgactacctctcagtcagcgtgtgacttcctggaactcatgcctccttgttttaaacccaccaattaatattccccacaggaaacctgtttggaaaatgccctgggcctatttgtttggcgcacaagtaattgcagtttttcccaccacttttaatggcaaaaactgcaattactcgtgcaccaacctactagtaaaggcattggctctctctccctacctatgctccctgaactctgtgtttgtggcctccaggtgtgctgtgaccccacccagggcctgtaagtattaaaaactcataaaccgatacatggaccataacatccagcatctacaaggaatttaaacaaatttacaagaaaaaaaaaaaacccattataaagtgggcaaaggacatgaacagacacttctcaaaagaagacatacatgaaaccaagaaacgtgaaataaaagctcaatatcactgattattagagaaatgcaaatcaaaatcccaatgtgatatcatctcacaccagtcagaatggttattattgaaaagtcaacaaacagatgctggcgaggttgtggagaaaagggaatgcttttacactgttggtgggagtgtaaattggttcaaccattgtggaagacagtgtggtgattcctcaaagacgtaaaggcagaaataccattctaccaatttttggtatatacccaaaggaatgtaaatcattctattataaagatgcctgcatgtgtatgttcattgcagcagtattcacaatagcaaaaacatgaaaccaacataaatgcccatcaatgagagactggataaagaaaacgtggtacatatacatcatagaatactatgcagccataacaatgaatgaaatcatgtcctttgccaggacgtggatggagctggaagccattttcctcaccaaactaactcaggaacagaaaaccaaatacatgttctcacttatgagtggcagctgaatgatgagaacacatggacacatggaggggcacaacacacattggggcctattggagggttgggggtgggaggaaggagaacatcaagaacagctaatggatgctgggcttaatacctaggtaatgggatgatctgtgcaggaaaccaccatggcacacatttacctatgtaacacacctggacatcctgcacatgtacccctgaacttaaaagttagaaaaaaaaaaaaaactcttaaacttttaacattgtggttgtgtcattgaagatgtgtctgcattctagcccctgatggcaaggctgccctaagtgacacaggcacatggaagccctgctggtgctctttggtcctggcctgtggtggctgctgagggcaatagctaccagctaagttgataaagaaactcaaagggtttcattcaaaaagtaaaatatgagaagatgtgacctttaggaatttttattctatatcacatatgacattgagaaaataaccaattaatttcatacataaaaatagaaattttcctggaagatatgtaaaaaaaaatttattctctagaaataaaataacaactatttaaacatgtataaaacattacaccatgtcaaagcactggtagtctatcgaagtgttctaaaattgacctaaattggaagaagttaatcctgtactatctgttcctatatgttccattaatataaaaaagttatttttactctttgatgtttagaaagataatgggtgctgcaaattaaaggcacttgatcttataaataagattgaagagctgactctacttgaagatgtttgactattagaataatttgaaatctcctactttatactgccctgaaaaaaaggagaaaatataaaattaaaggttacaaatttcaagataaattttattcagttttaaaaaatcttccaggcaagaatattaaactaacaaaattggatcatattgctttcaggggtctttataagagatttaatagacagaataatcactcaaattctcattaagtggtatcaatagctgacattttatcatttatattgtttttcttcttcatttaaaaaatgttgataagattcctgagattattctttaagttgcacactaaaatttttattaaaatacattttaaataaatagaaaactcagttatcagtcttagtatgtcagatgttactcaaaggaaaataataaatcttacaacaaaacttttaaaaatacggaccaaagtggtgtaatatacgcttgattattataccacatataattcatcaaagatatgattaatctgcctattttaacatgagtcacaaaagtaaagaacataaagatttcactgtgttcaataagcataggagctatatcatcttcttggcccactgacaatgcgagtaggaatataagctccagttcagttttcatttgagaactgcttaattttagatgatattacttttaccaattgctgtgtagaatctcctagattctatattcatattttttcctgttccattcatttatataacaaaaatttattatttgaataaaaatagatcaccagagaaagaaagtcttcatatgtaaatcaattggccagaaaactgtcaaagtattttaatacattcaaatcacctatgtggaaagaacacacttaaaacaagctgtaaaaattctagtataattatatttctccatatgctgctttatcccacatccattagtacagatacaaaagcaagattcattcccaatcttatttttcttatttgtatccctctacccagagcagcaaaacagatttctaagatgtaatcatgtttaacctttttctttgccttcccctattaaaatatctcttattctttacatatttttttcttttttgcctttggaaactcattctaaatgattttctttcaagatttatgtttgcctctttctttctcctatatattgaatccgaaacatttatttgatatttattatttgttatatactttcctgggcccagggatatcataatgagaaatatcgtacagatttctatgtttttcatagacttaaaaataatgaatatacaataataatataaatataatataattataggatttagagttaaaaagtagggattctcctttaccaaacttctctctaatcccatcccatggacccttaaccactttttcaagtttaatgtgcaccctttcagacattatgtgtacattcatacaaatatatgtgaccttttttaaaaaatagaaatttctacctaagtaaaatcatgctacttaaatgtctttttattgttgacatggtgacttagcagtctctccatttcacagcatctagatcttatttaactactgtatgagtttttacgaaggtgtcttaatgcatttaataattctcctactgattaacatctaaattgttactaatgttttactaatacaatcaatcctataatgaatatctttatacatgtgtgtagatatttttataaagaaaatgtatatgtaggtatacatagattttttatgaagcatattccaaaattgtacctctgtgatcaaaataatacttacaacccttatttcaatacataattccaaaacacactgcacaaatgtatattgccatcaataattgtattaaaattcctatgcctaattctcacataccatcctcacaatagtcactttaatttttatgaatctgaaatatattgctgtgttaatttgtattctctgatttctggtgaagtagaatatcatttcatatgaatataggctatttttactccttttgcgaattacttaggtatctttgtccatttgtttgtcagttcctttttgtttattgatatgcaggcattatttatgtatgataagtatttaacgttagtgtattttacatatgacatctattatttaatgtataattaatatgatcaaatcctttacatttctactataatagttgctaaggctactacaacaaagtatcataaactgggtcgcttaaataacagaaacatgttgtctcaaagttctagaggctaaagtctgaaatcaaggtgttgggagggtaaactctttctgagagctgtgagggaaggatctgtttcaggtctctctccttggcttgtagatggctgtcttcatgttcacatgatattctctctgtatcttcatattatcttctctctatacatatctgtgtatatctgtatccaaatctccattttctatatagacgcaggtcatattgtattagagctcatcccaatgacctccttttaacttccattacctctgtaaagatcctatctccaaataaaatcatatcccagggtactgagggtcaggacttcaacacatgaattttggagcacaattcaacctgtaacatttcaccctctgtatcctctaatttgtgtccttcacatgcaaatatattcatgtcatcccaatatccctgagagtcttaaccaattccagcagcaactctaagtccaaaatctcatctaaatatcacctaaagcaggtatgcgtgagattggaggtatgattcatctagaggaaaaattcctttctagttgtgaacctgtgaaaccagacaagttagctgcttccaaaataaaatggtgggacagctataggataaacattcccattccaaaaggaagacataggaaggaggaaaaggatcacaggttccaaacaagtctgaaacctaacaaggcaaattccatttaaattttaaggcttgaaaataatcctcttttgcttcctgttctgtcctacaggcccacagtagtggtaaccccactttccaggcccaccatgttggcaatcccaccctttctgctctgagaagagggccagtccctctgaatccaaggagatgaccccactctctggaaccaagcaggagatggtcccatacacaggtttgtgcactctgagctgtggtagcagtggcagccctgacatgctctgaaccaccttccaggtgtttgttctcttttctggaaggacaattcatgttagtgttattggcctatttctttccggtagaattctagaagtctggcagccttcttccattttatcccatctctgttcatctccgtttactctagcagcatttctgcttgtataaaattatcagaaacctattggcctccccatgcaattcatggggtccagtccattagataagcggatcatttacagatctttcctggttaactcatctctattcctggcttctgctgagatggttgattggatctgtgggtcacatgcctaatctcttcagtaagggatcatccaaccacaccctggatattctctatagaatgtgttttctcattttgtataacatgtataggctgagaatttttcaagccttcaagttctagttcccttttgcttaccaatttcttatacaatttcttattcaatttagctgtcttctcatattttactataaacagtaaggaaaaaccaggccatactttcaacactttgcttagaaatgtctacattcacctactttctacaaaacactacaacacaattcagccatgttctttgtccctttataataaggattgcctttcctcaggtttctcataacatgttcatttccatctgaggcctcaacagaagcacctttaatgttattatctttaccaacagtctcctcaagacaatggagattttttttctataaagtgcctcaaaacccttccagcctttatccataattcaaatccaaaaccacatccacatttttaggtatttgttataggatctgccatttaaaaatattattattatttttgtatagacaagttcttactatgcttcctaggctggtctcaaacttctggtctcaagcaattctgccatggcctcccaaagcgctggggttaagcgtgagcgactggactcagtctcctcccagttcttcagtgaaaaaactctacagctgatacacttgcacttctttttttgcttattcagatattcttctagggatggggataaagaaattaccaaagaaattaagttccttccctcatgaggcatcatttctattgggatgagatagacaaatggatgaataaataaataaacatataatgtcagcttatgatacaggatctagacagtagaagtagggcaaggatgaggggtggagaggctgctatgtaacacagagtgttcaggaacaactttctctgatgaagtgacatttcagcattgacttgaatgaggtaatagaatatatcataggatacatggggtaagaaaatttcggacagggaaactgggtgtaaaggccctaaaacagaagtatggttggctttgtttaatgaatagcagaaagggcagtgttggttagagtgccttgagagaaagctgtggcatgtctgtattatggcattaattctaatgatggctttctcatgggatccacacagaacctcatcaggtgccattctcagatgtaactgacatgctcacaactattttctcttcaagaattgctttttttaatcaatataaacttctgtacttaaagcttgccaccttgaattttattttatctgatataattatcattacagattttattgtgcttgcttatgacatatatttttgtatctttttttcaacatgtttatatcattttatttagatttattatttcaagtaagatatagatggaagtatttttatgaaattttagagtcccagacttcttttttaaaaaatttgagacaggatctcactctgttgcccaggctggagtgcagtggtgtgatcacagctcactgcaacctcaacctcccaggctcattcatgtgatcctcccatcttcacctcctgagtagctgggactagagatgtgcaatcacttaatatttgatatttattcatataattttgctatatggggctaaatgcataattatttacttattaaaaagtaaaaataggccgggcacggtggctcacgcctgtaatcccagcactttgggaggccgagacgggcggatcacgaggttaggaaatcgagaccatcctggctaacacggtgaaaccccgtctctactaaaaatacaaaaaaaaaaaaaaaattagacgggagtgttggggagctcctgtagtcccagctcctcgggaggctgaggcaggagaatggcatgaacccgggaggtggagcttgcagtgagctgagatcgcgccactgcactccagcctaggggacagagcgagactccgtctcaaaaaaaaaaagtaaaaataataagtttgccttttttaataaacacaggcatttaaaatttggagtttggggcaatagtttaatacatgcttctaaatcccatttacatcagcaagtaagtggttatggtaaaatatttttagcagtttgttttgaaatcttaggatattcttcagttaaacagaattagcaagaaaagattttctccttgaaaacagcataaatatgaagaaatctgacataaaattagcatccttgattgtctttaataagctaaactgtggtacataatacatatgtgttttttaaaaatttttttaatagtataaaggttctttgtgaaatttgaattattttttgtgaaatcctgaactaccactagaaacctaacagccatttgaatcattggcttaaaaagagtcatccataaaatactgaagctaataccatacatataatttgtaattagtctgatggggctaaatatactagttctctttttgggggctttcaaactaatttttaaaccacttaatatattcttttttaattttaaaacttatttttaattgaaaaataacaataatatatttatggggttgcagtgggatgttttgatatatgtttacaatataggatgattaaatcggactaacaaatccatacattatatacttattttggggggaacatttaaaatctaatcttgtggcaaattggaatatacaatgcattattatttattatagtcaccatttgtgcaataactcactaaagtttatttttcctgttttaccctttgatcaacatcttcccttctcccacttcagactctccctagcctttggtagtcttcattctagtctctacttccttgagttaaaattgtttagattccacgtgtaagtgagatcctgcagtatttgccttcctgtgcctggcttatctcacttcacatgatgtcctccatgtttgttcatcttgttgcaaatgacaggatttcccccctttacaaggctgaatagcagtttattgtgtaattataaatcacattttctttatttatctgatgaggaactcctaggttgtttccatatcttggctattgtgaagaatactgcaatgaacatgggagtgcagatatcgcttcatcagcaagatattttaaattagactcaatacctagtttgctttcccaatttcctttaactgaacacattagttaatattttagaagattcaaagaggctttccaagaaatttagcttcataacaccaactaaaatagctatgtcttgagagattgagcaattaaatcactttgataagagcatatgaggtcttttgtatgattaaatgtatcgaaatctggctctttgaaaataataagactcagaattagaaaaaactctatttttttgtgacatcaaaaccatgcaagatgtgacaaagcagagctttaaaacaatcctgttgatgcctagagggtatttctttcttaataacagccttaaccagaggaaattttacacacacacacgtgcacacacacatacgtattttagttttctaaactcattgcttaaattcaatctctacaaaaataagaactttttttttttttttttttgaggcagagtcttgctctgtcgcccagggtggaatgcaatggtgccatctcagctcactacaactctgccccctgggttcaagcgattctcccgcctcagcctcccgagtagctgggattacaggtgcctgccaccatgcccagctaatttttgtacttttagtagagatagggtttcaccctattgttcaggctggtcttgaactgctgacctcaggtgatccacccacctcagcctcacaaagtgctggaattacaggcatgagccaccacacccagcccaaaataagaacattttaatctcttcatgatacactctggctggagatttaggcacctttagagtataaagtgattagcattcagacaattttcattcccaacaaaagcttctggacaaattgatgggtaaattgaacaaactatcagttctgtctcattattaaagaacagcattttggcaatttctctgccagggcctttgttttaattttaaaacatggcttacaatttgtgatagacgggtccactggattttgcaatgctttcatcaagttccctgtgtctctttgagtccagctgaatctcatttgccttccattttggattatacatttggagcaccatgtaaaggctatataagcagtagcagaatgattccagaactgttccaaccattgctttcagctttaattcacctttttagtcttcgattatgttgacaagaccaagatgtgagtttgattattaatgcttctataaagtcttggtgcttatgacaccattagagcaagagaaatcagggcttttatcttaactagacatattataatttaaagtgattttaaattatctagtaatagtgcgattccacttttagatcaatcaaaagatgacacttccgccacagcaaataaaaagaaaaactttgtaaatgctaacatcatggttttgttcaatgagagttgtatgattcaaaagtgcctggtatagaagtaggattaaagaaaaaaggattccctttggaaaacatttaggcaaccagtattaaataattctgtattttaaaacatcttaccattcaattacctccaggttttagtttcagtcactctgttaggcatatggtgaaatcatattgatggccaccagaagttcctgagagaattgttaaagactttttttctactttcagtgaataaaattttaggataaaagtaatttttttaaaattactttggggggactatgatgacattttaaagtgtcatttagctaggctgtactagattatgcagaattcccttttttatgcatttccaattagggtgaagcacaaaggagattcttgcaagatttggaagacctagggaaggaagtgacattttatggctgacctatgctgttgctgatctgctgcatcatttcaatggcataaagcagcatctagatctgcggttgtttagccttttctggattcatcttcagttttttgacccctgagccaggtaggtgtttagctctgagataaaggcctttgcaggatacccttttaaccaaggtcagaggcaacaagaatggacatgcatttcagtttatccttgtggggtttctgacatgcttgcaatcttcccttcctgattccttgcctgtggacttcaagctccaacataagatacagagacatagttttcaaaagactgcttaaccagccctcataatagtgtaagtcaattaccagtatcaaacacacatatgtatatatacaggaatgtatacctatataaaatatatcttgctggttctgcttctctagttgaaccctgaatggtacagaattcttcactaagcactggctctcattgaaagaaattgaataggttctatatttgttgtggaatatattactatgttgtgctcaaagatggaggaatggttgtatctggaatggaaatagagtgtaaggggctataagattgtagatggtaaaaagtatgggaaatcaatatacaacattctcctgttttgatttttaacattctatttgtctttctcatcttgagacaacccaacatacttgctaacaaaagacttgtatagtttacatttatcttcacttatttttctcatatccaataacattctatttctgtagttaaaatatcacagcttgatagccaataatgttattacctagttatataaacaacttaaccccaaagaaattagaagaatcatcataatcaatataataattacagtcagtgtttcagcaattaagtgctggaagaaaatgaacccatgtcttcacagctctgagttaaaataactttgaatctagaattctatacatagcccaactttcaatcaagtacaagagaagagtgaaattattttcagtcataaagtttttccccatgcactctttttgagaaaataagagcacactctgaaaacaaaggaaattcaataaagaagatacatggaatccaagaaataagacaactcgaccaaaagagcaaatggaaagaaatctgaggaagacagctgggcagtaaacctgaaaaataactagtctacaattgatgggggagttcttaggatttcaagaagaatatccttagaaaaaaaggattctcactgcaacaaataatatgatgaggatggtgaacaattttagagataatatttattattgtcctatttatcttatcttttctcaagaagaaacagaaaagtcaatacaaacttccgggataagggtacggagagttgtacaagaaattcataatcaaaatacataattttgagtaatcttgaataataattttgttctagaaaatggtatctacaggagacaagtattatgcttttttgtctacctaaaacctttttaacatctcttctaggctaggagagtttttgtccctggttttgttatccctaaggcagaaagtccacaatcacttctccagcctcccttcagtcatgtatgtaacccagcctgtgccattcagatgcacctttatgagacattaattcaaaagtagatgatgtgaagaagcaattaccattctgacatgagttcaaatgagagaagaggcagaagtctaaacatcaagtgctcagaataaacagatttattctagggactgtgtctttgggaggcagcagtgagtcttcactggattctgtctatgttgtcaatgtttctccttacattgtccccagacttgattttccgttgtgacatagaatctacaaatgcatgtgttttttgttgctgttgttgttcaaactacctagcctgggttatgtcgtttaaaatttaaaaattgactaacagtaattgggaccaacagtggttagagagagtaggatttcaagaaaattagtattaacagtgattatttgacattagtagaaatctcactatcatttggggatgcagctctggcaaccgataactggaagagataaaatagttaattgaactatcaagcaaacttacctagaatcaagtatagacttaaggcaagacttctgagaccttgtagtcactgcctaagagtaataaggaggacgtaaggcttcttctctttgtgctggagagttcaaataaacagattgactggactgatatcccaaatctttgctcaaatcatggtaaaaggaccaaggattttctatgactttactataaaagcctctcatctattgctttcacagtgttgaaatcactttaaaaaatcaattataattttgactttgtaaattactcctggttttgggggttccacttaacatttcttatagaaaagggtttatgctgctgaaaactttgaaaattgatgtcttaaactatattaattttaaataagccacatatttctctttgagctctagggcatcagaaaagctttcccaggttccctgtgcattcatggcaatggttatatcctctgcaacgaactataacatcctttagagctatgtaacaagtaggccaactaacaagggttagcagataagctcagaataactgagacctccagtcagaagcggggagccatgttcactagaaaggtctttttcataggcctccacccaatgcccacaaaaaagcaggcggttgtaaaattgccacctctgtgatgcaggtgcacaggtagttttcagctgctccctgggtcaggcatcaaacatcaactgcttttctgggcactactctcatacaaaatataaagacacactgcttcgtggccaggtgcggtggtgcacgcctgtaatcctagcactttgggaggccaaggcaggtggatcacctgaggtcaggagtttgcaaccagcctgactaacatggtgaaacctcatctctactaaatacaaaaaaaaaaagaaagaaagaaattagccaggcgtggtggtgcatgcctgtaatccgagctactctggaggctgagaaaggagaatcacttgtacctgagaggcggaggttgcagtgggccaagattgcaccattgcactccagcttggggaacaagagcaaaactccgtctcaaaaaaaaaaaaaaaaaaatccactgcttctaggcaagggtagaggcagaggccctgtgccccagtggaggagcagaaaaatcacttggtccaggctccttcatggacaccaaatagaaattggctacaactggggaaggaacaggaagctctcctgtccaagacccaacaaatacataggcagagtctgactgccaagtagaggaggggcaggggtgcttaaaagaccatttatccaaggcccaggatcacaagccctgcacagtattgaagctgaacaagtaaaactgaaaacatctttgctgcaccaccatgagctcaacaatctatcaatgaagaaagaatgagaaaatgtcctctctgtggcacaaacattcagaaactactgaaagctgaggaaattggaaacactgagaaaaaataccctggcatctcaggccatatactgggtacaaaataacagaagccgagaactggaggaatttgaagccagtgaggcacagatagctgtgggacaataccaaagactttaacatagatgtgattaaaatccacaaataacaagacagaatcaaaagaacagcacagaggaatatttgaagaggtattggccaagaatttccaaagttagtgaaataaaaatggaccatatattcaagaagcttagaactctctagcagaataaacaatttaaaaagaaaataaaccaaaccaaaccaaacatcacctagatacattatagtcaaacttctgaacatcagaaataaagagagtaccttgaaggtatacagagaataaaagtattactagatacaaaggaacaaaagtaaaaattatagcatacttttcattagaaactatacaagtcagaaaaaaaagagcaatatctttatgttctgagtgaaaaaaactcatctagatttcaatatgtagcaaatacatattttaataatggcaaagtaaataattattggaaaaacaaaagctgagagactcaatgcaagcatacctgcagtgcaagaagtaaataaatgtcttcaggcataagaaatagtataacaaatgggaatctgatctacacaaagaatatgaaagcactggaaaaggtaaagttaaagataaaaataaaagccatttttttcttacttttaaccactaaaagataattgacagtttaaagcataaggaaaacaatgtatttggtggttatgtaacatcagtggagtccattctcacactgctataaagaatactacctgagacagggtcattataaggaacgaggtttaattgactcacagttctgcaggtttaacaggaagcatggctaggaggcctcaggaaacttacaatcatggtggaaggggaagcaggcaccttcttaacaaggcggcaggagtgtcagcgagaaccagaaagtgcctcatttaaaaccatcagctcttgtgagaactccctcactatcatgagaacagcatggggaaaactgccccccagtccaatcatatatatatccaatatatatgattggatcatatatgtgtgtgtgtgtgtgtgtgtgtgtgtgtgtgtgtgtgtatggagagagagagagacatagatcagaagggatttattaggggaattggttcatttgattatagaggctgagaagtcccatgataggccatacgcaagcttgagaaccagaaaagccagccagcagtgtgactcagttcaagttcaaaggcctcaggaccaaggaagttgatggtgaatctcagtctaaagccaaaggcccatgaaccccaaggggagagggttttttggagaggaggcagcacaggtgcaagtctcaaagggtggaggatatggaattctgttgtccaagggtggaataagggtgttcaggctctggaagagacagtaagaattctcctttcctctacttttttgttccattctagctggctgatcaaatgatacctgcccacagtaagggcagatcttctctactctttccactgactcaaatgccaatctctttttgaaacaccatcacagacacacctagggcagctcaatcttctaatctaatgccaaaccacctggcttatttttaacagaagagggacaggctcagtgcctatagaagcactgagaatatttagtgcctttccagctacccaagtatcccttaatccagtcaagttgataccccaaatcagccatcatggttagtaagaggtaaaatgtatttgctagtagctccatccatgtaattcctcaacaattaatattctgagccagaatttagatgttagatgggtttatcaaccagtcctcatttgtcatatgaatgactacagtccttaattactctttcttgaacttctttctctgaaaacacaatcacttggacatctttaatatagtatgtaattcttgataattattgattccaagttgctccatccttgattatgacagtgcaatggacttatagtttatatcccgctaaaattcatatattgaaacctaatctccaatagtgatggtattaggaggtgaggactttgggaggtgattagtcatgagtatggagccatcatgaatgggataagttcccttataaaagagaccccacaaagctccctagtccttttactcaggcctctgagcccaagctaagccatcatatcccctgtgacctgcacatatacatccagatggcctcaagcaactgaagaatcacaaaagaagtgaaaatagccagttcctgccttaactgatgacattccaccattgcgatttgttcctgccccaccctaactgatcaattaaccttgtgacattccttctcctagacaatgagtctcagaacctccccactgagtaccttgtaacccccatccccgctcacaagagaataaccccctttaactgtgattttccactacctacccaaatcctataaaactgtcccaccccatctccctttgctgactccattttcggactcagtccgcctgcacccaggtgagtaaaaagttttattcctcacacaaagcctttttggtggtctcttcacatggacgcacatgacagtttttgccatgtgacaatccaggcaggccctcatcatacaccaaattgccagctccttgatttgcagtttccagcctccagaactgtgataaaaaaatttctgtcattttaaagccatccagactatgttatttttgttatagcagctgaaacagactaaggcaaatggtgtgctgatgaattcaaatatccctgtggcaaaaaacacacatgtatattaaatgtcatcttataaaatgtaaattgtgcctaacgggactctgagacagaaatgaaaaagaagataattgccatgcctatcatagcaaatcaattgactttccctgttgtactttttgtcctgtctttactatatgagtatagctgaagtaataggggaaacatcatgtttcttccccatagtctactctgtctccagaaaatctgccttgagttctggactgacaggactattagagagttttagaatcagtactttaccctcgactattttcctaatcagggcaactatcccttgttgcccttctgcaaatccatattgcttgtgaggaagtcagaataagatcattagcatgtttccaggaagatatggagccccacatatttgccagcattaatgcctaatgcacacatccctggtttatactttcttcatcattctttttttctttctctcctctcctcttcttttctcctctcttcctc

SEQ ID NO: 577 - DNA, 99947 bp, Homo sapiens
ctaggtgaatcagagcctgttgcttaaatgaaggagcaggtctggttcgtgtctgccctcctcccagctcagccatgcactgcaggtctcatgttggaaaatattgctcaaatgctgcctggcaccatctggcaccatccagagctcaagagagtggatcatttggccaggcaggaagtctgctctcagatgatctgacctggattaggatagtaaatactcaatacatgttaattattgataacaacctaagagatggatactatattatctctatcttattgataaagaaagtcaggctcagagaggtgaggtgacttgcccaaagacatatagcctagaggcagtgtactgtaactcagcagtgtgactcacttccaagcccaagtaccgcattctgttgccttcttgatgggtgaagcagccatctgagcctagagttccttttaggaccctcaagctttccttgcagcatatctggacttctcccatcattgtcaggagatggagaggatagcttcatttggccagtgaagaaactaaaaggctgagtggcttgtagggctcacattgtgcatgaattggcacttgtctatagaaaatggtgccaggacaatgggtgtattttggttgaagtagttggagcccttggatgctagtggttcattacaggggccatttctgagttcccttggtcttgggaaactggttttcctgtgcctggaacccaagaagacatctgtggttccctgggctaggagctcccttggtggaggctgcctcatggatgggccacccatggtgtttggtggcagggtctcatgggtcaatgcacacagcccaggacagagtgaacagtgggatgtgcagggctcgactggccaagctgaactgttttcttgggttgtgttatatttatttccactaatctactcctcttgcctgtttatacaacacagagatctaataacatgtatctgaggccagagtaaatgaggaactttttgcaaagaagcataaaaggaaagagatcttggaatacctagctaatctcagttgctgtctctgctctgaagccctgcctttgaaagctctatttctcctcccatcctctgcgaaagccagatgagacttcttgacattaagcaaatgctggtatactgactttggtgtggggtttgtacatgtgcctgttgagagctggatccttcccgtgggtggatgctggcatggtggctcttccatctaaggatccatctggaaaagtggccgatttcatcacttacgtgccaggacctcagatgccgaggcaggggaatgctgcaatctaaacatttacattctaaaaaatgggaaatcatctgcttcgatataaattagccagggcctgacgggtttattacatcctggaatgctttcatgaggctttcagaggggtccatggtgcaggcgcaggtctccagctgggattgcctgtggcatgctcctggggggacccacttggaaaacacaggcagggggccaactcttcctcaacttcccatgggcttgtaatggattagagtgtgaaatgggaacaaggacatacaatgcgggaccctaggacagtgaagcaccctgaatgacgagcttcttgaagctgatggggagaggtcggtcagggaagagaggtgggaggagccaggtgcacaggcccaatcagaggctgtggatggaaagtggaacaggagaaatatgctctgggatttcacaataacagggtatgtgatatgactcattgagtgggaagagggcaaaggagtgtagcaagaaatgttgaggagggaagagtcgtacatcctctggaggagttttcagacaagacttggtgtgagcccctggggtcaggggctggatttgaactctgctgggtcccctagagtggactgagccaccctctctgcaaagtccctaggactgggccgatgttccaaggaaagctgagtcctacgctcaggaagtttgagatctcagtgaataggtaggaaaaatacacaaacataaacatacatgcctaactgtaacaagttgtgaactcatttattttccctccctttgtcgtatcttatatgcactcacatttttctgtaggtttacacagatatatgtagaacagatgctgaataactgattttggaggaatttgatttgatgctaatgatgagtgatctgggatatcagctatttttcacttgtttggagcaagaaccctgctttgcacaaggggtattattttggttgattttattcagagcagtggttttcaaactagcatgccttagaaccacctgcagggcctgttaaagaagatcactggcccccacccacccttggagtttctgcttcattaggtctcgggtgggtcctgaaaatttgcatttctaacaagtcccaggtgactctgtgttccagggatcgcacttggaggacaactgatcaagaaagagagaagtgcatgggctttggtgggaatcctttacacaactttgctgggtctgagaacttgtgattcatgcctttcagaggatgaaagaggattcacgatatccacggaaccacttccttgttttgagaaggaagctggtgcctcctataatatgggcagagccggcttgctgccacatgaagcagtgcctggctttgtggatttgcagattcattcagcaggcatctgccagcatccactctgggtccagccctgggtatgacgtgtcttcagcattggggaagacgctcaggcggaatggttccagcatcagtgactctaacaagggtgggggtagggtacttccttgtgcccagctgggctgcctgctgtgggggtatggggcagagacatgacacagtacttggcgtggggatgctggctgtcctctgtgccctccccacctgctgatccctggctccaccttggtctccaggaacagctctgtacccctctgggaagtcagatgtttcccttaaagcttgtgggtcccagcagactccccaccctgaatgtcttggctatcagacctcaatctgtcccctacaaacaagtcctcctgccctctgacctctgctcttgacaacaaaccatgtgtcacagcatctgttttgcatacatttgccaccattttcactgaagagtaaacacagagctggactttggggacttgtgggcggttcttccttgaaaataggccaagcccagagcttagaataggacaaggaggggcctacttggaggatcactgaaggggtgccagaaggtgagtcaggccacctgggttcctgttacatgattcaggcaggcccctccttctctctggcctcagtttcctcctctgtcacatgaggtgtgatgatgcctgtcctgcccctttcctgtcacgatggggaggctccagtgggacatgccctcaatttctcccaaatgtgcgtgaattgttgagggcacctgggatgctgagggtgtcaggcgagcaggtggctctgaggtttgggggtgagggtgtggaagcctcagggagaggcagggactagctctgaagtttaacatggctctgagagatacactgagcacctaggttgaaacctgcaaactcagtaagcctagacggcaggccacatttcttgacctctctgagcatcagcctcgcccggaaaaagataaacaatagtgcctaggtcttggggtgacgtcatgtttaccgggcactcgctatgagccaggccctgtatttggagttcagttaggggtgaggatgacgacagggcttattgggtggcttcaggtatcagctgcaggaggcaggtggtgcctttagatgagagacctgaacttcggcactcccaatcatgccatgcttcctactcagtcctggctggccccgtggctagtgggtagaagtcagtaaaaacccactgaatgtttattaggctaagactgtgaggaggaaagttaggctcctctggtgccctagtagtttttgatttttgtcaaaggagtacatattcatagcccagcagcaataagtttctcatgagaagcagcagccccgctgggcccatggccctccctgcctggtttctgctttctatcggtaactttttaatccttttttaaattaagttttttttaaaatccttttagtgtttttgatgattaccatatttcttaaaaagattacttatctcacctttttcttgatttttaaattttagttattatctattgactttcaattatagaggacagggagtaagtttttcataccagttctcttctgaccaaatagatacccacacactcccccttccccaaagcacagctgcctccaggcctcactgtgcaaatacccacggtggagctgtgtagtgtactggaatcacattttcattttcctcaaagatgttttgttttccttggaattaggtgcatagtatctgattttgtcatttgcttagttttctgttatttatttatcctcccattctggctaaactggagatgttttctgaagatgttcaaacacatcaggtagttgtctcctttttccctagttgggagttgttctctgggccccgctactcatctgagtcctcccttcgccatcatctggggaaccctgttgaatcgcccatttcctgaaatctgtggctttctctctccatttactccctcactttcaagacgtgcatcctccagtgtcttccaaagaaagggtccatggaaggcaaaatctttgagatcttgcatgtttgaaaatctgttttacttttttttttcttttttaatgagatgggacctcgctctgtcatccaggctggagtgcattagtgtgatcatagctcactgcagcctcgatctcctgagctcaagccatcctcctacctcagcttcctaagtagctgggactgtaggcttacaccaccacatccagctaattaaagttttttttcattgagatggggtcttgctaggttgcccaggctgatctcaaactcctggccttaagttatcctcctgctttggccttccaaagcgctgggattccaacatgaggcaccatgcccagcctgttatacttttatacttgattaatagtttggctgaatgtaaagtcctgtgttgaaattactttcacttagaaactggtcttccagcctcctgcatgactgttgagaagttgcatgcttctctgtgtcccagtctttggaacgcaataatttcttttttttaatttttactttaggttctgggatacatgtgcagaatgtgcaggtttgttatgtaggaagcacggcatacatgtgccatggtggtttgctgcacctatcaacctgtcatctaggttttaagccccacatgcattaggtatttctcctgatgctctgccaccccttgccccccacccctgataggccctggtgtgtgatgttcccctccctgtgtccatgtgttccattgttcaactcccacttatgaatgagaacgtgcagtgttttgttttctgttcctgtgttagtttgctgataacgatggcttccagcttcatccctgcaaaggacacgaactcatccttttttatggctgcgtagtatttcatggtatatatgtgccacattttctttatccagtctatcattgatgggcatttgggttggttccaagtctttgctattgtgacttgtgctgcaataaacatacatgtgcatgtgtctttatagtagaatgatttataatcctttgggtatatacccagtaatgggattgctgggtcaaatggcatttctggttctagatccttgaggaatcaccacactgttttccatgataatcgatccaatttacactcccaccaacagtgtaaaagcgttcctatttttttccacagcctcaccggcactgttgtttcctaactttttaataatcaccattctaactggcatgagatggtatctcattgtggtttgatttacatttctctaatgaccagtgatgatgagcttttctcatatgtttggaacatgataatttctacaccacccccacccagaaactttgaggatagatcctttataaccagggtattgaaatatagcattttcatcattcaagatgaatttttaaattcaatgttttgggcacttggtgcagctccttttaaatctccagacttcaataccagggatttgtgttatttatttgataaaagttgccctcttcatgcactctgttttctctttttccggagttgttcttttttaacattaaacctcctgaattgattgcttcactaactttttctctttttcatctttttgtcattttattttgatgccagcagttctaatatattttggtttcaggtcttcttttgcctcaggacatctttacactcttaaaaatcattgagaatcccaaagaacttatgtggattctatctattgatatttactatagagagattaatactgagaaaatcttagaatattaatttaaaataattatatgttaagtatataattttatgaaaatgtcgatataggctgggtacagtggttcattcctgtaatcccagcactttgggaggccgaagcaggcggatcacttgaggccaggagttcaagaccagcctggccaacatggtgaaaccccatctctactaaaaatacacaaaaaattagctgggcctggtggcacacgccagtaatcccagctacttgagaagttgaggcatgagaatcactcgaacctgggaggcgaagattgcagtgagccaagatcttgccactgtgctccagcctttgcaatagagcaagactcaaaaaaaaaaaaaaaaaaaggtagaactacatcccaaaacaaagcatttagtgaaaaaataattttatatttttgcaattcttcctaatgtgtagcttaatagaggacagctgtcttctcaactgtttctgtttttagtctgttgtgatatgttttgatttaaagtattgaagaaagtctggttttgttcagatgtgtagttggaagagggaaagagtattttaataagcttttaagttaattgtagataccctttgataccacaccagaactcaacattagtgcattcttaaaggttagttgtggtgtagaattttaactgtggctgtgtttgtaacattcattggtcatttggaaaatattgattcactgagttatacagatctttcaaatgttgacacatttcttgatataatatcaaacaatcagatttgtaaatattgcccctgatctcagctgaaaagcacatatttgaaagttctcaagctcattgtggcagataagtttttcagagctttaattttgcatgaaagctcaaattttatcattagtaataattattacagttacattagtaacaaatattagtaacaaatagtacattccttgaaattgacaggtgtatgctgttcattttctagaaaaatatatgccagatacccaagtctgaataactgtcatttgactgttagttgttttttccgtaaaaataggactctgtgataaaagtggctagtttatctcacaacttgatctgtcgctaaagtgctttgctttgagatagccattgatcctacatggtgtgctgtggaagtgctttctatgtcctcaattttgttacataaaatagtaaaaaatatgtgtacttaaagtttgagatttaatagaattaataacttttgcttcttcaacaagtacataattaagtgggactgatttgtttttactgtgagtgtgtggtagtgaagaaggtagtgactgtgagtgcagttgctgccactgccttgatttctgttaagactacagcaactctacccactattgctattgcgccatcagtgcaaatatcaatgcagtgaaaaaggcaaataatggcttaggattattatgaacataattttgactttgcggacctcctgaaagggcttcagggccctttggggtctgaggaccacattttgagcactgttgttctagactaagtctttgactttatcttacaatcttctattggttttttttctcctgctttgatagttttaaattcttagagctttttgtttgttctgtgtagctttcaattctcatatatgctttatgttttcttatttctctgaagatattgtggtttttttctgaagttttcctttgctccctatattgtatctttcctctgggttctttttatttcctcttggttttagtcttgtcttttgtgttggagactcttctcaatgtctggggattcttgttttgtatttgagacaaggcaccaaaatgctggttggaagctctctgggcatgggtggggcctgttggctaatgggcttctccaaaatggtattggataggaagccacctcttttgatgaggaacactcaaataatggcatctttaggagtttttcagggactggttagtttctgaagagggatcatccagtcttctgcctgacgtgtataacttttagaaccaaaaagagaaaaggaatttgggggattttgttgttcagtatgttcattttcatagaatccccagttacagcatctcaccatagtcttcagttttttgttttttgtttttttaaatccctggatccagagggatctctcttgcaagtttgaagaagaaattgttacttggttgtcagggctgagggaaggcacctgggggatctaatgattcctctaaagactgtaaaccagtctgttttctgttgcagttgcacctctgccttccaagcacctattggctccaattctcttgcttttgtgagattcttcacacacagccacttgcgtcttgaaggttgacccactggaggtgtagcaggctggaatgtaagtcagtatcactgattcatttacttgctggcttccaaaatagcgttgacatcacttacctgctcttgttttcctttcctttctcttcatcctctaggacttatgcaacaaaaaaaatctcctttactttgtgttagcagttgtattagtctattctcatgctgctaataaagacatacatgacactgggtagattataaaggaaagaggtttaatggactcacagttccacatggctgggaaggcctcacaatcatggtggaacacgaaggaggagcaaaggcacatcttacatggcggcaggcaagagagcgtgtgcaggggaactgccctttataaaaccatcagatctcatgagacttattcactatcatgagaacagcatgggaaagacccacctccacgattcgattacctcccactgggtccctctcacaacacgtggggattatgggagctataattgaagatgaaatttggatggggacacagccaaaccatatcagcagtgtgttggacactctaagatggttccaatatctcctcctgctagtacttatgcccttgtgtaattcccttgagtgtggtcacaacctgtgacttctttctaaccagtagaacatcctgtcacttccatgatacgttacatcagatcgtaacatcagcctcgctcagagactccctcccttgctggctttgatgaagcaaacagcaatgtgggaggcccacatggcaaggacctgagggcagtctccagctaccacccagcgaggagctgagggtggcctctagctgaaagcaagcaagaaactttcagtcccatgggctatagggaactgaattatggcaaccccacatgagattgggggtgccaatctcaatccttccccatattctgccttgagatgagattgcagcctcattgacatattttttgtagctttcagatgagaccctgatgcagaggacccagtaaagagcagactcctgacccttagaaacggagataatgaatgtgtattgttttaagctgccatgtttgtgaggatattattgtgcaccaatagataatgaatacaggcaggatatgagctgctgtgttgaactggaagtttagccctcatgctttggtttcttgggcctggtaaccatgtgtagtggaatgtccagccccagtggaatggtcttcaggagcttctcaggattctgttgtcccaaggcttcatttacatttcttcttacagaattcagaatactggaaaagaggggcctcctaggttcaggggggtactctccctcatgaggggtcattcttcctgcatcatagggttgctgaggtcagaaaacctttgtgcccaatgcatagactatgcatgtacccccaattgtcatgcttgcaaggggtctgcagcccagatgtcatgggtggggtgggttgagggatgctgtgtaaaacatcatttgaaacaccagaatttaaactattgtggataagaactatggaatgaaagaagggctgtttttaggaatgtgaatgactagggcgggggaagcaacaaggtactgtggcaggtgcactgggccaggggcctgggcttggctgcttatgtctgttttgtgctcaccagctgggtcaccttgcacaggtgagttaactgttctgcccttagtttcttcacctttcattcaaccagttacccaacatttaatgagtatctgatgtgtgccaggccctaggctaggtgctgggattatagggatgaacatgatgtggtttctgttctcaaggagcttggtttgaggtaggagtagagggacccccaaacaggcaaatccaggacagcagagcttgtaaactggggtcctgcagacacatttgattgattcatccagtgttctacattattggaatctgtttaaaaaaaaactaggagatatttggctagaaatttagatttctgacttctctagagaaataagatttggtaacagtcaccaagagcaaccgtctttaaatgggcatggaccaaagtctctattaagagagagaagaagggggaggctgggataactgtgtttcagggaaatgagccagtgcatgtagagccacattttcctgtgccagtgttgagatgcatcctgggctggcctcacttctttgtgtcacagctgagcccaggagcttctgagtttgggacccctgcaattcaggatgcaagtgttgaatggggccatgggggccagaggatgaagggcatgttatgtgtccataagtgccccctccattctgggttgttatgaagagcagaagggccacctcccacctgtggaagcctctgaatgacttgcggcaggcaggtcattcactcatcagagctctgagggccgcacgatgttctggtgaattgccctgtaccacgagctgcatcctgtgcatggctcctggagtgcaggatttaggtcccagcatgatcagaatatggttttggaaatggctgtggggtccaggtgacatgagtcttgtttgctcagacacttggcccttccagggtctgggaccctcctcctcctctggtgccatcttgtagccccagggacctcgttgtcttgtggggactgcctctttgtggagggtcctgtcacaggagacttttaggaatggcatcctggtgggcttgtgctgatgggtgcccccaccttagccctgcctgaggcagctctggggaaggctggggagtctggccacttatctcacaccattaggcttatagcagtgctgctagcagacaaagactcgaaggggattaggggtaattaccaggcagctctttcttcccagggtttaatgggcccagccactgtaattgtacctgctggtcttgggctgttcccttccatccaaaggccaggccgtgggctgggtttgggcgttgaagggcatgtcctggcgcttgtccacctgcccacctattgctgggtggccaatgcatgacttcagcatggcatggcagcctggcaaggactgatagcagagctcatggtgaagaaatcagggagcccattgtgtgctaaggacgtgctaatgggaatgcaggggccttcctgccttgtcagggcctgagctactcaagaaatctccatccttattgagagggttatctctgtggcctgtgggaatgtccagaggcctgggcattctgggggcagggcagtagggatctttcccagccaagtgaggtgggacctgccttagggataagggacgtgtaggctttggctctgggcagcgttgcgtggataggggagccccagtctgtgcaccccggctgctctgggagagtgcgaggcccacgcagccctggctgtggccatgggcacaggctggcgggctctagggttcctgctaatggacctcaccccacagccatggagggactactcttttcaccagggaatccccactcagtccctctccctctgaggaatgtctgcatcaaaaagcctcgaaaagagttcagcaggggcatttgaaaattcaaagtatgcatccttttaatcctttcagggaggctgtaaggtgatattgatggcaatgtttttatttcttagaattatttttccagtcattcacgtgaactcagagcaccatatcggttttccaccttaagtaagaggattaaaaacatttcataatgcagggcctgagttaggagcccaggccccagagccttgtcacattgtgtaattggaagtaattgccagtgtggggtttgagaaaggcgcccgattgggtggtgggggctggtgaaacctcttttgagcccttgttaaatggggagggcagattaagctgagcaagtgggttgaatggacagactgatgtactcacccctctcagacctcagcatcttacctgggtgtcctttgaggggaacatagggctgctttgggggtgctgcaggtgtgtgggggagatgagagcaaagctgtctctgtgtacagcaaggcctgtgcctcttcctggctgctgcctcttcattctggggacaggagcaatgcagggacctgttgtatcttacagaagaccctcagtctctctgagctgacccctgcaatatcaccaatcagatgatatccaggttatctcttggggaaattggaaccataggttggggtgggagggctcacgttccagggggtgtagctcttccaacatagcattttttgattccaaattgaacttcacttggatcttgtgcaatacagcagccttgccacagctgtgcaaatgcctcatagggccagagccatgcctatcaatgggggcccttggttggggagggagacactcggctttctgagaagtgattgagccgcgtggaagtgaaggtgttttggagtagcctgctctggctgggtgttgttgtggccatcgagcacccactcctgtgtctttctcctgtgtggttctcatttagccacactgtcccctgctctctccaggttttgatgcctctttcccggggtggggagtttaaagtgggaaagcaggcattggcactattcacaatagcaaagactcggaaccaagccaaatgtccaacaatgatagactagattaagcaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataagtgggaattgaacaatgagaacacatggacacaggaaggggaacatcacacaccagggcctgtcatggggtggggggaggggggagggagagcattaggagatatacctaatgttaaatgacgagttgatgggtgcagcacaccaacatggcacatgtatacatatgtaactaacctgcacattgtgcacatgtagcctagaacttaaagtataaaaaaaaaaaaagtgggaaagcaggaaggaacatggctgttcctcagaggtccaggctgagaggtttgtggcagctttcaggggagaaggagggccaggagagggaatgaggagatgaagcccagttatgagccatgtataatttcccaggattttgtccatgatgctccaggattctctgtgccctggcaatgggctgggaagccagagggtgtcttgactcctttctccaaaaactgttctccgtcctggcctgtcctctaaggtcatctctgtcgccatgcaaagggagacgagatcagggccccatcacagccatgatccctctgtccatcctagactcactttcagttgaggatcctgggctcatggctcccacgtggatgtcccgggtgccccataagtggctgtggctgatcaggggtcaaagatcactcatgggtcaccccatctgagtccattgcggaggacaggttgaaatagagagtgtgtggctatgtgtgttggtggaaggagttgggttccctactctatttactggtgccagccacatttctggaccttgtgatcacattttcttttctggacccaagaggcttagggaagaaaggaggagacccttggtttccaaggccctgagtttgatgactcttggctagattctgaagacttctaagtttttcctgaaaacctcccttgtgtcttatcccccatatcagaagaagatcccttgggaatgaaattctataaagtatgagctggggttttcctaaagaggaaaatttcagaactgtttttgctggtgagatctttttattttattttatttttttgaggtggagtctcactctgtcgctaggctggagtgcagtggcaccatcttggctcactgcactttccgcctcctgggttcaagcaattggtgagatctatttttacaattagattgaaattagaaactaattagaaattgtttctttttaaaaattaagattctgcttaagaaagctgctttggttaaaatgggggaggggactggagcctcaccctctgctccttctgctgcctttggtggctcctgaggtgccaccatgcaactctagggctttttggaaaatggcttataaatcatcttcctaagctaagtccccggtgggttaaggtgtgaagattaagatcatgggctctacgatcgaacagcttgtgttcaattcctgggtctgccactcactagctgtgtgaccttgggcgtgtttctgaacttgtctccttttgcttatctgtgaaatgggcataagaagaatacctgccttgtaggtttgttatgaggtttaaattagtgtttggtacaatgacttgctcacttgccaaaaatgttagtgattattaacagggaactctcaagcctccaaaactctctagcatccaaagaaattcaacctagtggtatgaactgaagtcatgcagatattgggagagagattttaaggtggagagaggaccttccttcacactcttggggttacctccaggtcagaccagtcctggtcttgtgggtagtgaccttgtttgcaagtgagtcacagtgaggacctatctccttccccaactccgtcctagtgttgaagttgagcaggattaaacagggtgttgagttgtgtcattctcctgcctctgcctggggcgggaagggtgactagctctagtctaggttgtggcacagctctggtgagaagagggggaggtggcctagccaggagacttgtttagggtaggtgtgcactgacaggacgtgaggacagatttgagagcccttcctaaggaggggacccttgtccctggctccctctcccttcctctgcaggagtcatccaacagtgatgatgaggggcatcacctttgttgtttaagcctcctcctgttggctcttggtgctacccagggcagctccttttatccccatgatacagatgggatagtcgaggcctagagggttgaagctgtttgtgtggctgattctaggtcagaactcatgatctcctgactgtgctctgcggtcttggcgattggcagatgtgcctgattggcctcggagggagtcgtggaaggtgggcacagctcaagagagagagtgttccatttgctcccttcccagcggaaaggccctcatctgctcccgctggactgggcgctgctctggttcctagcctgtggcttagtaagtgctcaggagaagtcagttgaatgagtgaacagtgtttggaggtatttctcaaacatgactaaactgcccaatgcacacagaacttgaatcatgacctgagttgcataaccagcagggttgtatgttctgctgcagtggaaaaggactgaatttctatccgggtgggaaagaaagataaagctctgtcaactgaggcatcttatggtggacctaccactgctacttccacgtcatctataccagccctgggtactcttgaccacttcacctgtgtagatcctcatcttggcctcattggttgttctgtcccagggaagaaatgttgacttaaaaaataggctggccttctgggatattcttcactgcagcagccccatattcaaggtatgatgaggtgggggtgagaagatgtgctctctgaaggactttctagaaagaaaagtcagtggcttccatcaaaccaggagcttcccacatggtctctatgtggttggctgtgggagcgtccagggtacctgttcccttcagtggaaaagcaagccaattagcttctttgggccctgggcctcttttaagattgtcctgggtcatgggccaaggctgtggtctgcgcagctcagagttcttcccaagcaatgccttggttcaactggtggagctttttggaaggaggaaaccgtggacttgacggcatttggcaggtaaaccgtaggtgcttggatgatttttagaattggtattgggaccacaagggcaacacgtgtccatcgtatactaatatgtgccacagcctcatgatagacacagggcctggagctcgagcattgaggagggagtccaggtgtgtctcctctgttatgccaggcagctgactcccactggcagcattttcccagggcagagacccacactgtgccaggtcctgtcctgctgacaggctacagtgtagggctcatagagccagcccccaaggtcatgaggacaggggagacagtttaccacataccaggccaatgatcaaggtatcaactcatcacaaccagatttggttttatcttgcagaaatttcaaaattgagcaagatttcaaaatagttatttcacagaggtttcaaaatgggaagacctaaagccctatcctgtcagcctatcctggcctgagctaggccagggtgctgtctggctcctaactcctgtcttttctccccaacctcttgctacagctctgtaggattgggctccaggtactaaatcctgcctgatcttgggaagggatcataagccatgtgcataacagcatgtcctgagaaagggcccagggcatcatcttctgccatgtacagcaatctctgttggtggctggggcactgacctcagatccaggcttgggcaccagttcccacttgactgagtggtcttggggaagtcccttcacctgcaggcgttggtcttcctacctggacaacagtggcgatggtgggttgcaccagaaagtctcagccagtctgtggttccaggctcagtatcctcacacagtggtatgctcgtccccattttctagcttaagccatcacgcttcctagattgcacctggctatgctggaacaaatccagccccactgggaagcctgctttccttgtctactccagcacacagtgattttccttccttgtgatttccattgacccattcactggacacacttcctaccttgtgctgtaatctctctctctctgtctctcttctctctctttgtaagtatgttttctccatcaagattgggagcccaagtacttccctcctccatggcatgtggacatacttggaatccacaaacatgacaaataactcagaatcatggtgatctagggagtgaagtatcctgtgcatcatatatttttccttgggttctaacagctttccttggggcctagcatgaagtgattttggtggttcctcatcatgcctgcaattgtgtggtcttttccgcctgagggttgccacagtgtagctgccctctatcctgaggtgcccagggactagtgaaggacaggaatcgggacagggccccttgggtcccactgcacagattcccatgtgctcactgctccccagcccttcctggaggcaggcgtgggatgggtctggagggaacaaggacagctaagtcattgccatggatttaaccggctggctgggcccatatatgcacagattgtggggatgtggactcctccttcccatgctggaaatgggccccagaaagctaccacctgccacttctgttgggcgggcgggaagaagcttgcaccatagatactgtgaagtctgcaggtttcactcggttgggatttgtcatctggcaaacagtcaagtatctgccatacctggccgagtcagctgcagccttcatggccaatccgcatgatgaagtatccagtcaagttttggcaattccaaaggtgtggcaatcttggttgcaaggggccagtggggagcattgcgacagaggcccttgtgctggacctgcaggacgccccaggaagaaggtggagggtggagggcacccttgacagttgacatctgtgtcaacagcgcccagtgacacaccgggggaggacgagcctgcacttggcaggccaacaatgagctgattgatgcaatgaactttcccctcaaaggccccaccactgcctggggagcctgggccaatggtggtctgcctgcttcccctgtagcgatccgctggcagcctcagagcagggaatgggggtgggtattggctcctgatggggtcaagacttgtccaggatcctctaggagcctgctgtggagtaaggagaaggctggcagctcctggacatgcaggaacaaaggcctgggagaaatgagtggtgtatgagtgggagtggctgggccctgggtgggtgatgtgtctacggtgcctcccacctggcatgaggagggaggagcttcatgagctgctggggaggcaggtatgtttgtcctcccataaaatgtggcccaatttataggggttgcaaatgttccctagaaaccttacccatactgcacgtctgggctcagttcagcactggggatgaaaaccttggcccttcttcttagaccctgtccctccttctccatgtatacatgcatgtgtgtgcgcacacacacgctctaccttgccagctgaggttgtatgattcatgttgctggggagctcagactactcaaggccatggtgctgggagactccatatctgggtacggatatttagtctaagcaggcctcaggtcatgggaccctctagttgactctgctaacaaagacttctccacctacttttttttctatgctgtatccccagatgaagcaagcccaacagacctaggttactcaacagggcccttaaaacaggtcattgcctctctcagggtctcagtgttaccacctgctcaatggggcaatagtgttggctcagtatggatcttgggattgtgtgagtttccagagaaaaaggggagaaggtcctttcagagctgagcagaagactagaattctccaaaaatccaagtttgtctagcccaactcctatttgaaacctttcaaggctccttcaatggtaacattcaatgattattttcaggagagaggccaaaatgcttatcagaatccaccctctgcttatctcagttcttcaatgccacactatttccctgtccccttgttttctacattccatccatgctggcctctttcttaatatctgacatacagaggcctcatggtgggatagaacgcggagactattggcttctttgctgggaatgcctttcttcctacatccctctctttttcctttccatctggttaactcctgttcatctcttggttcttagagcagttgtccctgtagatattttctaccttgttttttatttttttatacatcataaacataatttttttaatagactctgagaaaattctgttatctgaaatgtaaatctgtttcagtattttgattcatgatgtcttatttccttgtgtgcctggttatttttgactatgtgctggtcattaatgctaaattattttagaaataattcattcagagaggattttatttgcttcctctgggctgtggagtgctgtctgttaatttaaacatgagattcatttaactctcgggttatttgaacaggagctacaggctcacaagagggctagtttatttgtagttcaccctcatgctgggagtaaacccctttatgggctcattttacataggtggaattgacactttgacttttgtacccctcattttagaaggtcaccaccaacttcttccagatcagaaaatgtcctcagggctaatgtggctttgaaggtttggcttatttttttatgtcctcacgtttttataaattttggtgtggtaattcttagccatgttatagctttttgattcttttgagaaaattgaatttattcagactttttcaggtatcctctgtaggaggttggttcaagttcactagctcctcctaagggagcagaagtctcttggtataattgtaacttctctaaggaagcattctctgacttcccacatggatctggcttcctagttatgtcttctactgataaaatgaggctatctccttacgagttctcacaatggttgtactaatcagttcgtctgtatggttatttggttaacacctctatctctacctccagactgtaagtccatgcaggcaggggcggggcagatgcctatgcctgttttggtaaccattgtatcccgagcacctaaagcagaccttgatgtgttatgtactcaaggattacttatgattggaatgacttctacttcctttacttggtccagcaagtttgtttcttgtgtaccctcttttttgccattactttaaatatgcaactcagttatcctctacttctaccttatatttttgatccctcagaaatcaagatgaccctaaaatgcacgtggtagttaacaacatgagctttacattcagagagttctgagtttgatccttgcttcttcttagctatgtggtattatttgagtctcttaaactctctgagcttcaatttcctcatctataaatcaggaaaataatcatgtctattttattaagttggttttaagatcaaataaaatgatgcttagcataatgggtgactttggtgggtgaaatgaattggcactcagatccataccaccctccttctagtaaaccttgcatacaaatgttaaaaagtatatgtctcagattccctatgccaaaagtatgaatgcagatgggttctatcagttagatgtatgtgtgtgagatttggaaggcagatatgaagtagagactgtcttctgtcttggcaacaaacatagcaacagtaaacatggtcatacagctgttgaattttccatgttggagttctagtgtctggtctctagttgtgtgggtattaagaggcagtcatggtagtgacagcacttttatacccctggattgtagttgtggcagtgtgttcttgatgtcaagtagttgcagcggcagctttttgattccttactaaatcaggtatgggtcattgtctaggtataatccatcctgaagcataattccactttatttgtgaacctgtgaaactcagtaagttttccactctaagaatatagtgggggtacaggcatagggtaatagttctagacatttctgtccaaaaggggagaaaatgtaaagaaaaaaagaatcactggtcccaagcaattttgaaatccagctgggcaaacttcatttggctttaaagcttctccgtgattcttggctcaccatctgggttcaagaccccaccttctgagtcaacttttctttttcattaaaggtagcatctgtttgcagctgaggagttttatcagcctgtttattgcctggagattttcagaggttctacaatctttttttctttttcatctcctctcagccctcttcagtaaaaactgcagtgtttctgctggcataacattcttaagaatcttgtaggtcttctcctcctccaccagtcattcctagataatctcatctctattttggcttctgctgagatattcaagaggatagataagtcacactcttttcaaagaggcttttgtgtgactaatcttttgatctttctgaggtaccagcaatgggttgtcaagccacactcttattttttgcctcttgtcatactttcttgaacgtaactcttaattttagtgtttttacaatctagataggctgagactttccctaaatcaagtcatgtttccttaaaaaaaaaatacacacatacacaaaaacaaaaaacaacaacaactaaaaacaatttttccttcagtttacctcttctctctctttctctctcttttttttttttttttgagatggagtctgctctgttgcccaggctggagtgaagtggcacaatctcggctcactgcaacctccacctcccgggttcaagctattctcctgcctcagccgtccgagtagctggaactacaggcgtgtgccaccatgcctggctaatttttgtatttttagaagagacagggtttcactatgttggtcaggctggtctcgaactcctgacctcgtgatctgcctgccttggcctcccaaagtgctgtgattacaggcatgagccaccgcacctgcccagtttatctcttctcttttgcattttactataaggagcaaaaataaacctggccacacctttaacacttttcttgaactgctactcaactaaatacacaagttcatcacttgcaatttctgccttttacataactgcagggcacaattccactgactttctgccactatataacaaggatcctctttcttctagttttgaataacattttttcattttcttctgagcccttaccagcagcaccttcaacatccgtatttctacaaacagttctttcacaacaattgaagtgttttttaaagtgattttggttttctttaccatgttcctcattccttctgagtcttagtaaagttgttaacatccatatttctaatagtctgttcaaagaaacctaggcttttctatcatgctccttacaattcttctagactgtgcaactgctgtttcaaagtcactttcacacttttaggtatttgttacagcagccccgcttctggtaccaaaaactgtatttacttcttgtggctgctataataaattcccacaacaaaaatgtattatcttgtggttttgaaggtcaggagcccaaaatgggctccactggggtaaaataaagatgtcagtagggctgcatttctttctggagggtctagagaagacccttctgtcttcaaagccactggttgtgtctttctcacattacatcactctgacactgactcttcttcatcttccacatttcagaaccctcgtgtctacactgggatactgtagtcactggatacacccagacaatccaggataatttccttacctcgaaggaagccattttaccactgtaatttcatctgctatcctaaattccctttgtcacaaaaatgaatattcacaggttctaggaattaggacatggacatctttggggagccattattctgtctacaacacctgacttccaaattggcaagtcagctcagtgggattctggaagtcattcccaggggcccacctagagcccattttctagccctttcaatgattttgtaagcatccagtctcctgaccatgggtacgttttttaccctctacaggctgccatttctctatctgtaaaatggggtgatgatgacgtagtccctaagtagcagtggagagcacagaggatactgatttatctcccaaacccaaggcaggcatgctgtggggactgagcagctgctagccaagagtgcctcaaggaggtggcatggcaagggcagtgaggagtccctggagtgtctggagcttatgggaagggtggaggatattgaacatctactacatgttgggcactgtgctgagcttttttcacaacagttatattatttaacttcatctgtgatgagtgaaatgctctattctgtgctgtacaatatggtagccaacagcatatatgtggctattgagcccttgcagtgggagtggtgtgactgaagaactaaatggtcaatcttatttagtttcaattagtattcatttaaatttaaatggctaaggtgactagatgctaccatatgagacggcacagctcttacaggttacattgcccagggtcttaacttagcatgtgacagaattagggccataatgagagaggggtttggagttgggcagttctggccatgtggccgcttccctctgacttcagccccaaccttgaacatttccactccctctgctgttcgaccatgggctagcacaacccctgtaagccttctgtgtaaccctcctgcagccatccctctggagttggggtctgttccagtcagggagctggcaggagatgagggtgtgtagggtggcagaagtgcccaggctagacacaggctctggatgccagtactgagacacatggcgacacttttgctctacgtgagctgtggcacagtcctagagcctgctttcccaggcgctaccacatgtcacttgtcagttcagagtcactggtgtttgtcctcttggggtctccttttccacggtgcccacataatcaccttccttggcacagggaagagtaggtggtgtcatagggtggaggctggcagtgcagtgccgtgcggacttgtggcactagagacatcagagcctccaggctgctcatctccgagcccctgcctgtgctccatgggtggcttgtcagagctgaggagccatgtgtgatggggaaggacctgtggttggtgagcgtagggatcctggcagagtccccccaaacatttgcccaggtagaggtttcaagcctatggtttaggggatgtgcctgaactaatcctgttattagctggattatctcttcaaactgagaaccagctcctgtgggtcccaggtgaaacgctcagtcaggagccagagtgacacgccccacccagggcatgtgctcggtgtcagtgagcctgccgcctgagtggcacccaggcaggcttctgctcctgcttcagccactagttgttccactcattcattcatccatcaaacagttcctggtgctagctgggcaccaggcctggagctgggtgcttgagacccaaaggtgaactacaccagatagagtctcgtggacttcacagtttagaaaggcagacagagacaagtggaagacggaaaaatggtaaaagagaggtaggtacagagagatgggacactcaggaccagaggctgagatggggctggagaggtggacagggaccagaaagtgtggaggccccaagggtcccactaaggccattccagaggtgatggagtccctggcacatttgaggagcaatgtgatcagatgtcgagttgagggtgcagactagtgtcagggtgagaccactgaggaggtgggctgttcattcatttgttaatttctcattcagccaatatttgagtttctgttatctgccaggccctattctaagagctaatgctatatcaccaaacatatagacaaccatccctgtcctcagggaacttacattctaggagaaagaagggttgaagggagagacggagagattggggttggggagggaagagaggaggagagggaggaaaaggagaagagagaatgagaatgcacaactgtaataaataagtggatgatgtagtatgctagaatgtaagaaaggctacagaaaacagcaggcctagaggtttaggaaatgctgggggtacacagggtatgttctgtcccatgagacggtgagatttgagcatagacttagaggtagatgttatttgtgtagagaggggcaggagcagggtatttccagatcatgagaagggcaaaagcagaaaccataaggcaagaatgtgtccagtgtgtttcaggaacagcaggggaggccagtatgcttagagtgacgccgtcatggaggagaggcacagacagggcagagaggtgaggggtgcagatcacagaactcccaggggctttgtggatagtgttcagaggatctctgaatgggattcagattcccacttggatggaaaaaaaaatcacatctttatttttaattttcgttagactttaagtgaaatttagtacaccttttgattgagaatgtaggcaataagaaaaaaaaccctaacagaaagcaaaacacaaaaaaactcccacagaagtatagagttacttgtgactttgtcaacaatagaaactatagattttttttttaattttggttttgtttattgtggtagaatacacataacataagattaccattttaactattttaaagtgcacaattcagtggctgtaagtatgttcacaatgttacgtcaccatcaccattatctagttccaggaacttgttaccaccccaaatggaaagccttttcttttctctttttttcttttcttttcttcttttctttttctttccctttccctttcccttttgctttcttttcttttcttttcttctttttttttttttaaagtatactttaagttctgggatacatgtgcagagtgtgcaggtttcttacataggtatacacatgccatggtggtttgctgcacccatccacccatcatctacactaggtatttctaataatgctatcctttccctagccccccaccccctgacaggccccggtgtgtgatgttcctctccctgtgtccatgtgttctcattgttcaactcccacttaatgagtgagaacattcggtgtttggttttctgttcctgtgttagtctgctgagaatgatggtttccagcttcatccatgtccctgcaaaggacatgaactcatccttttttatggctgcatagtattccacgatgtatatgtgccacattttctttgtccagtctatcattgatgggcatttgggttggttccaagtctttgctattgtgaatagtgctgcaataaatatactgtgcatgtgtctttatagtagcatgatttataatcctttgggtatatacccaagtaatgggattgctgggtcaaatggtatttctggttctagatccttgaggaatcgccacactgtcttccacaatggttgaactaatttacactcccaccaacagtgtaaaagcattcctatttctccacatcctctgcagcatctgttgtttcctgactttttaatgatccccattttaactggcgtgggatgatatctcattgtggttttgatttgcatttctctaatgaccagtgatgatgagcttttttcatatgtttgttggctgcattaatgtcttcttttgagaagttttggttcatatctttcactcactttttgatggggttgttttttttttcatgtaaatttaagttccttgtagattctggatattagccctttgtcagatggatagactgcaaaatttttctagaagaaaacctatgcaataaacagtttgctaactatttcagatatcttgaaatatttctgcttatcactactttgaaattacaatgcccatgagatcttactatttaatgcatgtgcataacaatatcacaaaaaaacattatttcagtgtaactggtttcattttaatgctatgtaagctttatgcatctaaaacatttctctgagacaaggtccataggcttccccagactgctaggggtgtccctggctcaaagatagtgaagaacctgtgatgccgaatctgctaacccaccttaagaacttgggctttgagggaaatgaggagctgttgcgggattttgagcataggaatgaggtctgacttaggctttttaaatttttttagacagagtcttgctctgtcaccaggctggggtgcagtgacgtgatctcagctcactgcaacctccgcctcccgggttcaagtgattcacctgcctcagcctcccgagtagctgggactgcaggcatgcaccaccacgcccagctaatttttttgtatttttagtagagatggggtttcaccatgttggccaggatggtcttgatctcttgaccttgtgatctgcctacctcggcctcccaaagtactgggattacaggtgtgagccaccgtgcctggcctctgacttaggtttttaaagcatggctctggctgttctgttgcaccaagacaggtggggactggggaggaggctgttacaatgagccaggtcagagatgggggtggctcaggctagggcagcagcagtggagggtgtgaggaggacatgagtgctggatgattttgaaaagagagccataggaattgttgctaggttgcatgtggggtgtgaggggcattgagaatgactggctgcagtggtctggctgccccaaaagttggagccctgctcaagaaggtttcccagaggatttgacatttgagctggacttaggtggtgattggctggctgtgctgtgagttctgcagggtatgtgcctcatcttcccaccctggcagcttgcctaggacccaccatcggtcctcataacatatcagtccaatgccggacagaaggtggaggctccatggcgttcttgggtttctagcttgggtgctaggatggatgactttgcagtgacagagttcctgctattcagtgaagaacaatgggcagagacatttggtgatatttaaactccaggcttcagcctaggctgaaagtgaaaaggaagctttctttagcttctcagttctctgtttagctgggacgactgattgatggcagtggttttaataactcagtaaaccagggctactccatgcaggatgaatttggttgagatgtaaatattttatatcagagtattaactgcttattaaaagtgtattgagatttatatgttatatggatataattatagacaccacagaggggtcatttgcttgttggaaacatctctaacagagctgttaatccggaaatgtgcgtcctgcagtcagctggactttaggtagaacattttccctgtcttattaagcagaaattaaacacaggtataaatgctgctgaaaatgcagctctattttctggacccaccacatgcagatcacgtggaactgccaagccttgatgtggctcccctgagatagaagaggctgttctgtggccacgaggtcttcacagctcattgtgacagggggcacccaggggaaagttggggcagcttggctcttccagtgggagcaggctgacagcccaggtatgggggaggaaggatcctgccgctgaactctacacccagggctcgggatgtgttgaccccttcttcttgcagcttggagaaagttgccacactgtctgggggcagtttggaacctgatgcaggtaagtgggcaatatacagtttttttgagctgagcatctagaactttctctgtatgaaaaattcaatctgtacaaaatttggggcaggtgatccatgggaaaacatatatctcttgaatgacaaaagggtgttgaatttagggggcagcttagagcacatccactcatctagcatgctgagtgccaggcaccattgccaggcactggggatacagcagggagtgaaagaaaaatccctgccttcatggagcttatatcctaggggtaggggggcggggggaggcaaataacagataatatgggaggatcgcttgaacccaggggtttgaggctgcggtgagctgtgattgtgccactgcattccagcccatgtggcagagtgagaccctgtctcaaaaccccaaaacaaagaaaaacagacaaataaacaaataatgtgtccagagatcaggctgcacttaagagtagttttgtctaccaaatctaagtgatttctgtatttttttggattaaattttttttgtttggtttaaatccacacacagacacatgtctgtgtgtcacaatggtcatatcttggttttctggagaatgggcagtcctggctctggagagcccaccagcttccttttactgttctgcatggaaatctttgcataatgttttgttgtgttccatattctgcatttcagaaggcaagaaagattgtaatgtgcttttgtggcacgtccaggtccccatgcctgttctgggctgtggtccacggctaccctctgagggtgaggtgtacagtttgtcctgcactaaatggtcccgggggctattcttctgttgtccttgggtctgctttttatagtttcctctgtcctccctgttggcaggctgtccctcccaacttgagctctctcatcctttcttcatgtccagatacttccagcatgcacagggaaacagtcaaacattgactggtgtcttcaaagagaaagctagttagcaaattgaaaaacatcttcatcatttttgccttcgtgttccacgcctagtttatgagcagtcttagactgtggacagaggcacatccgtgtacagtgctgagggaccttcccctggtcacagcagctgtggaaatggcgcaacgggtggcttttccaggggacacttctggaacagagctgggggaacatgagatgctgtggagttgaacgggtggagcaatggacccagtcgcgtagaaagggcatgtttctgctgcaaagcgacccttcagcatcttggtctacgtcctgccctgtccaggacagtcctgctagtcacatgaggcttttgagtacttaaaatatgactgatggtactgagaaactaaattttaaaaatttaaatttaatttgaaaaacagttacagcctgccaacagggaggagtgaaaactataaaaaggcagacccaaggattcaaggtattgggaaacttttaagtatgttcggaacaacttgggtatgtcaatttacctttacaactgtaaattttatgagttctagatactgatgaagtatttcaggaaaatgtagcatctgcattgagatgtgctgtaagtgtaaagtacacaccagagtttgaagacatgatatgggaaaatgtgaagtatctcaataatttaaaaatatttattacatactgaaataacatttggagatactggattacataaaatattaaagttaacatcacctctttcgtttgctttttaaaacgtggcttctagaaaacttaaaatcgcatttgtgactcgcattatatttctattggacagtgaacatctagagccttctctgactcttgttcaggtttgaggttgttacataattttatgtggttgagcttgctatttattggacacttacacgtgccagactctgtgctaagaccttaacatgtttttaatcctcccaagagccctacgagctaggtactgtgacccccattttaaatataaggttgctgaacctcagagaggtgaagtaacttgctcaaggtcacacagctaatagcagagctgggaccctagaattagacaggtctaggttaaagccttcctcccaaccatgataccacattgcctcactgcagtcccatgagttaaatgcccatcttggggctccaaatcccagagcagggatgtggttaacaggtgaccatgaggaccatgagcatccatgggggaccatgccgttgggtttgctgtgcatgcgcctgcagttctccttcgagggggtcactttgagaggaggtgagccctggggatacctggggagcattgccaccctgctttgatgggtgagagggcatctgggggcacagtgtctatttccagctgcagccttgtcccattttgtggcaaagtgttttcaccaacatcatgagctggcagtgccaacagaattgtcatctccacttcacagatgagcaagctgaacctcagacaaaatgagatccttgaacttgcaaccagaactagaactagaacctagggtctggttccaaattcagagttcttcctaccaattaaactgggctccagaggtcagatgaaaggtataacagggcttgtgtgctttggaggaaagtcccagaatgtcactttcatggtgccagaaatgcttccataaagacatacttccttctgggtaagttgacctttgagtgagagggtttctgaggtcttctgactgggtgaagggaaatggcaatgtagtcaggtgggcccctggcagggtgacaagtgggtgaggcagggctgctcagatgggaaaggatacagtggtggagtgggccactttcagatccagggtttaaaaaaattactttcaatgacacatgttttctacatatttatggcgtacaatgggatattttgatacacgtatatattgtataatgatcaaatcaggataattagcatatctatcacctcaatcatttatcatttctttgtgctggaaatgtacacaatcctctcttctagctatttgagatattgtagtgccttgttgttgactatagccactctactgtgcaataggatgccagaacttcttcctttctaattgtaactttgtacccattgaccatcctttccacatcctttctccagcttcactccccaggctgtggtaaccactgttctactctcttctctgtgagattaactctttcagattctgcatatgagagagatcatgtagtatttgcctttctgtgtctggtttatttcacttaacattgagtctttcaggttcatccatgttgtcacagatgataggatttcaatcttttgaatggctggctcgtattccattgtgtgtatataccacattttctttatccatttatttatcattggatacttaggttgattctttacatcggttactgagaatagtgctgcaatcaacatgggagtgcagatacctctttgacaaactgatttcttttcctttagatatgtaaccagcagtgggattgctggatcatatggtagttctgttttttatttttgaggaacttccatactgttgtccatagtgactgtactaatttatatgttgaccaacagtgtgttagggttccctttgctccatatcttggctgacacttgttgtcttttgtctttttgatagtagccattctaatttgagtgaggtggtatctcatcattgctttgatttgatgaattaatgattctctgatgatcaatgatgttgagcattttgtcacatacctgttagccattttgtatgtcttcttttgagaaatgtctattaacgcatttcctttgcccattttaaaattggattgttttgctttattgagtcgagttccttatatagtctggttattaacccttgttagatgaatagtttgcaaatattttcttccactgtgtagactgtctctttgctctgttgtctgttttcgctttgtagaagttttttagtttgatgtaatcccatttgtctatttttgcttttgttgcctgtgctcttgaggttttatcgaaaaaaaaaatccttgcccagtccaacatcaggaagcatttctcctaatgttttcttccagtagtttcatggttttgggtcttacatttaagtctttaatccattttgggatgatttttgtatatgagataaggacctaatttcattcttctgcttgtggacgaccagttgtcccagcaccattaattgaagagactgtcctttccccaatgtgtgtttttgcacctttgtcaaaaatcatttggctatagatgcaaggatttctgggctctctattgtgttccattggtctgtgtgtttttatgccaatattatgctgttttggtggctatagctttgttgtacattttaaagtcagtagtgtgatgcctacagctccctgcccactgcccccacctcaggattgctttggttattcaggatcttttgtggttcagatccatgtttagctttcactctaccatcactgacactgaaaatctctttcctaagggctgctgatcttctcctgaagtctcagaacagatggctgccaagtaggacgtccttggagaaagcagattctgggcttgcctgggtcttgtctctctgttcaagtgtcttttggagccctgggctgtgtcctgacactcccatttactacctatgaaaggcagttgttttacctttctgaacttcagttttcgcatctgtaaagtgggactttaccttgctgagtgaggattattagcacagagcatgtgaaaggtatggcatccagcctggcagctggtggtgcagtgaacattggggctcagttgcatgtagacacctgagagttctttgggatcctccttgtctttccgtgggaagctgttggccgaggagaaagtgcagagcagcagctgtgagggggccacacacatgggcaaagatgtacattctgctcaagcacactcctgggctctgccagaaagggtctttggatgcccttggagaccatggagaagggggaaaagagggaggcaggggctctgcaaagctgtgttcagcaccagcctggcagagacaatgatcaaacatccctgcctccccatgcaaggctggctgagggttcaaggaagcaggcttggggcactcctagcctcaaaggctggttctggaggcttttctggcagagctggccaggttctctaccttttgaaggcaggttggctggaataacgaagatctccataggtgctttctgggcagagagtgtttacacaatccaaaatttgtaatctcttctgggagacatgactgcccttagggacttctagtagaccaaaagaaaagaaagaaaaaaaagaaatccccatggctcatatttggatggatattttcaagaaaaatatctggtctagcaaggcagccccttgagaaactaattgtgcatcaaggtggtaccaggcaggcattttcctggttgggggaggggggcctctcccctcgaactcagcaggaacaatgtctgaatcctttagatttttgcagccctgcccttctcttcctagcatacttctcttcctagtggtgccaaattttatgaagctaaagcacccaaactgagcatatcatttgtacccagagaaaattcacagttcgttttgtgctttccagtgaagctgcacccagcaaccaagcagaaagcgccccttccctctgccctggggtccagtcacaggggcaggatggtggtcagaccaagaggtgacactctgggcccttgtcatttaagcagctggcctctctggctggcctggatttgttaagcccaggcagctccttgactccacagatggtcaccaggtgataagtgattgcccagcccttcctcctttgaactgagcattgtgtctcttcttcctgggagctgttttgcactgtcagttcctagggattaggtgcgtgtttaggctggatgaactcatgaatgaaaatattttgctttgttctttcggcagtggagacctgtacagtgagtccctcttttctctctcctgtctcccccagcaccacctgctcaggtccaccctaataacatcagccaaggcctctacagcagcccccaagctgcctctggatagttcagacaaggcctctgtgctgtgatggaaccaggtgacccgcagcctccgggccaggtgagtgctttcttgatattttcttctggttcatgttatattcttcagcacacgatggcagaggggcagccccagcctcttctgtgttaagagcaagggaggggttggggagaggaatcggccccgtgtttatgtgcttcgcccagctttgattccggtgccgtggacttcctgaaggtcctgggggtgtgggtcatgagaccagggaactgagtcagccctgtcatgttggaagtatgggctcatggaagaggcaggaggatcagagttcaaatcttagctctgcctccttttagttgtgtgaccttgggaaagtcatgcccagtttacagatgaggatcctggagtcccacatcttccttgccaaactgctctgaggcctgttagtgtgtctggtgccaaacatcatgcctggcatggagttggcattatgtcacaccgtccttttcctgccttgtttatgggcttggctggaccagcagtctgggccaacacccacctatgccccatccccataccctgagaatgaggaagacccaaaggggtgcttatgggacctcagtgtgatggatgaaggcatcagctcctaagagaattatcactgcaattgataggtcgatgatgttgctggctggctggttcacagccatggctaattcctaccattgcgtgtctctggtgctccctgggagcttgaggtcggtggtcattctccagagcgcagctgtcttactaccacctcctgcagggagttgctgggtactgcctgtagaggacataggctggtggctacttggaatctgttctggagtgcagtggattgtattgcttagttgtaataatttcagttgaggattaaaataagccttgggccgatggctggtgagttggcttggctgggtgggtgagaggaagtgtatgcatacacctaggtatatgcctcagtgccaactcctgtgtatgtatgttgcgaggtgggggcggggtggggctgggattattattagggttttcctattttgacatctaaccagtggctttatcaatgaacaattgttttaaaagtgttattctgcacaagtaatatatattaatattagaaaaaccgggaaaagtagaggtaaccactgtcaacattttgaagttttttcccctataaatatatgtgttactttttcttacaaaatagtatgatccatttttttaaacttgttctctttgcttaataatatatcatggtggccttttaccctgacaccatcatttgtgatggttgcatggtaggaatgttggcctgtggtatgaatatactatagttttcaaaaccacactcctgtatttggatatataggttatttctgagtgttagccctcacaactacattgtaactaacatctttgttccagcattttggtgtacttttctctaagagaaaagtttggaagttgaattttggggttaaagggtgtctgtgttttttgttttgttttattttatgttttgttttttttttttttcttttttgagacagagtcttgctctatcgtccaggctggagtgcagtggcgcgatcttggctcactgcaacctctgcctcctgggttcaaatgattctcatgcctcaacctcccgagtagctgggattacaggtgtgcgttgccatgcccagctaatttttttgtatttttagtagagacagggtttcaccatattgtccaggctggtctcaaactcctgaccttgtgatcctcccacctcggcctcccaaagtgctgggattacaggcgtgagccaccatgactggcccaggtgtctgtgttttttaagcttctgatacttttagctaaatagccttctagaaagttagtactgagctaagtcagaggaaaacaattcctttccccttctgcatatgttccctgggcctgccctaagtttctaaaggaacaggggaggggaccaatgtgtcaaaaagcccctcaggttcctgccagatctctcaggtgctgaatccattttacatatgagggattgaggcccagggaggtacagggaccaagtgtatctgcctgaggagggcctgggagccatggcctggctgagccaaaggcatcatagggcgtgagggagccagctgcctgcgctgggcccagtgacctgggaggcaaaggaaaggccttgggctggtggtgagaagagccaggcagcagggtgggagagctctggacctccagtccctgctggcttcttcctcagggacagggagccagtgctgtctgggtggggtgcatgctagagcggggaagtccatttagaggttccagtgagtgccagcctctcaacccagcccttctccagctccatccttcccctgtcctgcctaccgggctctggagtgcatcatggaggcagggatgggctggcacacaatgggttcttctcagaggcttgagcaagtgccaagccgaggggatggtgggactggtacctagagggacaacagtctagttgggcgatgggatggagtccttcagtccagaggttagggaatggtgtctgagaaagtttgggctgtgggaatccttctttcgggtggtccttatcaagcagtaactatgggccagagcctggcccaggaactggggatatagcctaggtgaagaggacacaccagcctctgccctcaggtggtcacagtcccatggggatgactgactgggacaggcattggtgactgatgactgcactgaggctgtgggcatgcggaggagggccgcttggggaaggcttctgggaggaaggcacatctggcttgagacctgaagaagcagggaatggagggtatgggggaaagggcatgtggtcacggcagagcggagagcatagggaaaggcctggatgtcagcagcaggctgacgagtggcctctggcagacctggtacacttctcagggaaagccagctctgtgagggtgcacaggaggtggaccgcctaggagggagccccccagggcaccaggcagggcagcgttgaggaagctgcagtgttggcccacctgtgggtgctgccagtggcatcatggagcttctctccatgggccaggcatggcaggtagggcagggtccatgggaggtggtgaggtggtggtcaggggagcctaaccacccttctctttactctgaaacatacaatctcgattcgctttggaatgcatccctcagaaggctaggaagaccatttctcttggttcagaagctccatgttctgcaccttcctcctccagtagggcctgagagcctcaggtgagagagagcccaaggcacccttgctatctggggagacttcatcttgggggaggaaggcaggtccctgcccagtgctgcttctctcaccaccaccagatccctctctggtgcctctggaaagatgtcccgacttctcacccaggcacacaggccctgtggagtcagcctcatgtcccacatctcagcctgcacacccactacatccacgggtcccgctgtctgccctcctccccaggggacactggtgcccccacacctccacacctgtgcttatctcacttcctctacccaggtccctgtctcttttatttaagtcctgctcatcctcccaggtggccatagatcaccacctctgagaagcctccctagctttcctagctctcttaggccgagtgcagctctcctggctcagggcaccacccttggtgctggtggttgtcactaccccacacactcccttgtgttggtgctggttctgctggcaaaggactgcaggatgaggggctccttcagccggcctatccttcctgtgtgtgtccccatggggcctggcaccccgacactctgtaggggctcaggaccccatttgctgaggtgagaccacatttcctcaagaagtggcaggagtcactcagtgggcacgtcttcacccccatgttctagagtaaagcagtgatgccgcgcggtgatgccactttctgagcatgacatggttagcagcacaggctcagaagacagcagatctggagggaggcctggctctggctctgactgtctgtgtaacctcaggcaagtcatttaatctttctgaacctcagttttctcatctgtttaatggagacaaaaatctgccttacaggagtgttgagagcatggacaaagacaagggtgtgtcatcctcctagccccagggcccctcatggcccagtctctgcacactcaggcagccagaagtaattagaaagctgaccctttattgtcttctgaaagaaggctgaaggttgggcatccctgtcctgtgccccagcagcactcttgagccctggccagtgcaggtcttggccacccacggcccttagggtctctccccacatccagcttttccttttctcttctcctgccccctttccaggacttgattatgtgggtggaccctgtctctcaactcagcccttctgcagctccatcctcccctgtcctgcctaccaggctcttgagtgcatcacggaggcagggatgggctggcatcgagttctcgttagagtgggtgcggggagggaaggatacttgcacatgggtggatgagttctgttttagatgcgcaaggccccagcccatcacgaatgcttgctgggaattcagtaagcatttatgagctacctactatatgtcaggcaccgtgctaggtttcaattccccagaaactctgtgaggcaggtggtggtagcttcattttacaaataagaaaattaaagctcagagcgcacacgttgactgaggttgcacaactggttcgaacatttgtcaccccccatgcatggttactgtcagctaggtgccgggctgtgtcggggagctctctggggagagagagccctttggagtcctgggtctgccccgggtctggcaggaagaccatttggatgatgagagaacagactggaggcaggtgacaggcagatcctaaatgtacaggattaaatatttacattaggtaaagatgagggttaagtgcctcagaggcaggcaaagggagagtggagggaactgctgctggggcttacctgaagagcttatagagaaggctgcaggagaggggacatctctggaggctcagaggagccaggagggggctggggtggatgccggagtcaggctggtctcctgtgaggtgtgtgcaagtgtgtggtggcccgggaatgtgggagccacatacttttgtataattagctcggctcctctgcagtggtggcaattagccgtaggcgggagacaggacttcctgtggccaaggccacttctgcacctggggccgcttacctgggctcctgctgtccaggcttgggccctgcgtgtttccggcaggggcagccaagaagcaggtggggctgttgggactgcagggtcacagcttctacctcgcagcaggaggagggaattgtcccagcccatcctgccgctcagccctgtttatatcttctctggggccctgcttttgagaagggcttttgctccctctcctcacctgttgggggctgtttctgagcctttctcactcttcctggctgtgggtaggactggcagcaacctagaggggattagttcccctggtggtcagtagacgccttatacacctcttcccatggacagctcaatggcaggaatattctgagcatttggcttttgaggagccccacctatcctgccataatgaaaaatgtcaaaaatgagataattaatgctgccactttgtttctctttagtgtccagggaatattactttattcatctaatgttatcagcaataataacaatcactgtctttgtgttttcttttttttaactggccctgcctgtttctcttctaaattgtgagatagtagatgtgaaaacttggaagcgggagtgtaattattcccactttgtaggcaggaaaaaccacaggtaggagaagtgagttgcttgcttagcgtcacctggggaaggtgactgtggcctagggccactgatgtgccaagtgctaccatgctcaggcttttgcagcttagctggggtgaagctgaggctgggaactgggctctccctccacaccaaggtgggtgagagcaagttgctggtagctaagtcacaaggagggatgtcagtatggcacctgctgcggtcagcagaggggcagctcagccctgcggttggctgggactcagtggtactaggcttgtggcacatcctggggatgagctggctgcctgctctcttagccactgtcaagcaggctgagtccctggttccttcatcctccactgtgcactccagagctggaaaatgttctaaaaatccttgaagcaatggcttttcccagccaggcacagcctgccacatgagaaacccaaaacccgggacaggtgagtgtgctgaacacttgctgtgaacagcaggcatgaggcctaaaaccccccaggtttcacaggtacgggaggattcgatgagatctgtgtgatcaatatgaagcgtttggtatgtgcctggctcacagtgagtgttcacttggtgttagcagccattattattatgttagacatgattattaacccatttatgcctgaggttgcaattttttgaatttttgcaatcagaacttggtggtgaccttgagcagtaggatataaataactcccacatgctcagtgttccaataatggaacactaggcataaatggactaaagaaaaagacagtgttctgtgaggtaacaggggcctggcccaggaagagagtgctccacgaatagtagttgtcattagctattggcactttgtctcctgcatccccatcttcccaaggaccgaaactccggtcgattctcattacttgcactagttatgttctataaagtccccaccaacaccgaattagcaaatactaaaccactgctcctagggacaatacaaagttaggttcctgtgagcttctggtcacatttttgtcaactgatcaatacataaccttgttttatgtgtgttactgtttaaagcaccttatttaatatatgttgatgattcagaaacatcgacttcatggccagtagcgttgtaactcatgcttatcatctaacacagcttgtccaacccgtggcctgcaggctgcatgaggcccaggacagctttgaatgtggcccaacacaaattcataaactttttaaaaacattatgagattttttttgacgatttttttttagctcattagctatcgttagtgttagtgtactttacgtgtggcccaagacaattcttcttccaatgtggcccagggaggccaaaagattggaagcccctgctctaacacaactattttctctataaagtacatcatggccttcttgctcttaggaacatttcacagaagtattcttgggggctattttaaacagcaaaaccaccaacaaaaagaacaataatataagaaaaaagaaaaaacacataaccctacacacagcagaaaggatacttgttgtctgggtgtggcggctcatgcctgtaatcccagcactttgggaggccaaggcaggaggatcatttgagatcaggagtttgagatcagcctgaccaaacatggtgaaaaaccatctctactaaaaatagtaaaaattagctggccctggtggtgaacacctgtaatctcagcttctcaggggctgaggcaacagaatcccttgaacctgggaggcgggggttgcagtgagccgagattgtaccactgcactccagcctgggcaacaaaagcaaactccatcttaaaaaaaaaaaaaagaaaaaaaaaagaaagaaaggacacttgtttacagtatgagctgagacaagaaggcagagggtttaacttcagctggacacttgtacatcaggtgactcaggtgtttcagtactctatgcatgtctgcaaatgaccatgaaagcaatcataagtgttgattttggaggttacgaatagaatttagtgagcatggcctagcccagatgtttggaggttgttcaaggctgggagacagtggacagagccattgagccataggaaacatggagagcaaggaagcctccacgtggtcccacagccagctgctggcccagccctgagcaaagggaggctgaggactctgaggccctaggctagactagggctgagcctgaatggctttgtccatagttaccctgatggattttccacacggagcacttcagctgtttatggcagtgtgtttatgtgggtgggttgggggatatttttattttttggacatattttaaacatatacatgagaaggaatataccgttgcaggattttcattttgcgtgcccttctgtattctgcccccattggttttgcaggggactggcagaaatgggaacgtcatttgaattggttgtgtgtggagttaggagcctgagcattcatgcagaggaaggggatgtatatgaattccccagtagagaatccccccaggcctggctcaagggggaaggtgaggaagggtgggagtagggctggggaggagcagagcagggcacccccagtcttctagggctcttggcagaattacctaccccccatgaatcttctagaggctgactttgagaccttggagggtccctggtccccaccagtcaccttagcatccaggtggtgaggcctcccagtcaccacacagcagagctggtgctggggcccgggcctctgggctgtggacctgtgcgcttttcacatcagcacagtgccacggctgttccctctcacagcggcacttccttttccttcttttgttagagactgctgttagccccatggagaggctaagaacttgggttttggagtcagactgcgcatgttggaatcttggcttagtcgcttactggctgttcgacccaggacaagtaacttctctgtgtctgtttgctcgttttaaaataagaaggctgggcgcagtggctcacaactgtaatcccagcagtttgggaggctgaggtgggtggatcacctgaggtcaggagtttgagaccagcctggccaacatagtgaaaccccgtctctacaaaaatacagaaattagctgggcatgatggtgggtgccggtaatcccagctactctggaggctggggcaggaaaattgcttgaactggggaggcggaggttgcagtgagccaagatcgcgccattgcactccagtctgggtgacagagcaagactctgtctcaaaaaaaaaaaaaaaaagaagaagaagaagaatacctattactcagggttgcattgaggatttaaccagttaatagtttaaaaccatttagaacagtcctggcacaaaataagagctatgtgagtgcttgtaaagtaaagaaaatgtatgaagttgccgtgtgatctggggtaagttgcccttagcctcaggttattcatctaaacaatggggtggatattgatacctaccacaaagggtggctatgactcagtatgatgaagaatgagcttacgatgcttagcacaaggtaagctttacaaaactgtcaatgatttgtatcattgatattattattaattggcagctgtctcccggttcaattggcagtgtcttgccttgagttcagatgagggagagagaaaatgcaaagcacgagccaggagttagggaggcgagtcgagactgccgagtctgcattcacaggaggccagaggtggcttttgggcttccccctggcaaggaccctgtccccagacaggtggtggtctcaggaatgagtggggaccagttctgtgtcctccagccacatcctagagggaacctaccttccctctcccaacaggagcccaagaagctggtcaacagtgcttccttggcagagtctcctgcccaggcgtctgggcagatgtgtggccacaggctctgccaagcagggggaatgccatttggaagaagtgggtacgtgcaaaaaattcccttctgaagttcctctggaagtctcaggatatgcttcacaggaagcgtcagcacaattttctaatcaagttgaagtctgtggcccgtagttagaaacaataaatgaaatgcaatttgagcccacactttgcctgagtttccatttctggaagtgggtgtggatgagaagctggcctttctgagggaagaacttgatccttgaccctgaccattcagcccccagcctcaccatcagcttgcaggggtgggaccctaggactgtattttgggtaatcattgcaaatcctgattttgatctggcaggtcaaagtccacacttctctgtaaatcaatgcacaccattaagcccactctttgttttttctccttccagagccttctacctaccatgcttagagtttagtcttggagatcattgtttaatcaatattaaaccattcacgtagtttaagtgtttacttatgtgctttgaatcattgcttgcagtaagaacaagtgatgcccctaatctgccttcactacactccccaataccctaattatgtaatttagaaaagaacatttcctgacagcagtttctcagtgtgcagcaacaaatgccgactggggacgggacaaaacaaccctgtaatagctagcacatggagcccgctgccttggtccaggcggccctggcttggggcagacgcccgtccatttgggttaaggctttcaaatgatggcatattagtgccagtagacgtaattccacatgaaaggagctgaagctaatagcccatctccagtctctcttagtttgtggaataggccctcattgcaaattattactgacccagacagtcaggaagagatatctcacccagccggggagactgacgcagccaaagacgtatgcaagaggccaaggtttagactaaactctgctttatgtccttgccaacccccacctctacagtccaggggcaaggcctgagtgtccccaatacatccttattccttttgggggcagtttggaggctagtgtgccttttcattcaagcaaagtaggtatttgaggggctatggggtatcatgttatgtgaggggcagaatccatggctttagattatattagtttaagtaccatctaatgagggtggtggttgtgggggataaggaccccaaatgcctttctcctcaccagcctgctggtgtcagtgactcgtatctcaaggctgctgcccggtgagcagagcccagcttggccttctctggccaagtgaggcctaaatgctcactgtgacccaagctgcttccataacaggaatgaaaatctacctttcctgcttccccttcccccatgagtggtccaacaaatattccgttgctatagaaacccagcggaaggctgagtggcctcacctgtctcagcagggtgatcagtcagcatttgggcatgggtgcacagccgcttctcccaggcagagcccagcagctgtgggctggtgttgctatgcagcctgccagctgcctaaagccccaggctcttgaaagtcccagaggatgggtaggggatgagggagaagcaaagtgagctgaggaaatttaaatttggctgtgaatcttaaaccaattctttagcctttctagaagcaccagttgctatggtgatggaagcggtgccaattgcaagagttgtttttgtggttagagtgcctgtcttagacaaaggcagggaggccaacccagcagcttcagtcctcactcccttctaaggattgaacgttgtcaagccctagctcaggaggaggggtgacagcctttcagaatgcccatcttgccctagcagttattctaggggtctagggtcccagaagggagtggtcgccaggcattccaagagagaacccacaagtaggcttaccaacagagaaagggctagtcagtgatggcagattttggagttgaaaatttctttctcgaggcaaactcacaatacagtgttctttatggagccttctgccacccagagtctggtcacctgcccttaggggtctgctccttcaggccacattttgacttaggcctcaaatatcagatcccctgaaacatttcctaagtgacggaatggaggccttttctatagccgaggtgcttgtgtagctcgttaactctcaaagtgttttacaaatatttattcaccttaggtcatttgcaaacctaacccctgtcatcccaccccaaggttgtcccctccagcctagttgcccaaaatgaagtcagaagccttggactaagaattccacgttggctgattttgaaaagcttgcctgaacggtttatttctctagtctgttcttcttagagttccagaatgtgtcaggacttcccagtccaggcatgcaaagccctttgccctccctgccagaggtgagagtattttatttatgaattcattttaaattactttcaaaatcacttttaatcaaattaagacgctccctctgggattctgtcaaagcatcagaataagagggcattggcttggagcaaggtattttaggacaggtaaccagttcccattgacttgctttcctggctgacatggacaggtagagaaagcctatgtcattttgctctctgagatccctgaagtgtatttatttccttgtaaggaggaaggtccctgggaattggaggcctggatccctcccaggggtgaactctgtgtgccgaatgttggtgatatttctcccaagactcacccagatgattgctgggctcctgcccctccccatcttcccagcaacccaccacactgaattgattgggtttactggcctcaaagtggccaaacctgaatttgcctcagcttctggtcagaacttctgactaatgaaggctgacccctggtgaattttcagaagccatgacttgcctgcactgagcctattctgctgataagataggcttttgtgcagagcaggcaagagggtagcagcttcaataaggtccatatcaaggtgatactaatccttcggctggctaatgtttgccaaataaatagcctcattaggaagggctataaaagcccgataagattcttctaattatcccccaaagcacagatacttggggtttcagtttagcataataggagacgtggagaaaagagggaacaatgtgtgtaagtgaatattttcaacaccggcctcaccgccgctaacagcggcacatctagcatttcatattttgctttgccagagcagcaaattgctgaacagaagggaaaaaaagacaattacatattttaggttactatttcacctttgcaaatcaatatacaagccattaaaagtacatttttccatgaatgataagtgtaattacctcttcttgccataaaaacttgtccttattaaatgtaaatatttaaaaatgattgaaatatacttgaagggtgctttatagcttgattttatatgctgacatctgggttgcctttcctaaaacactctatttcttggagagttattaaattagtattttgaaaggactaacactagacttgttccttgtttccattttaatttcgtacatatttagatttaccaggaattcggagagggtttatgtttagctaatgcatcattatgtttgcggggcttgcacacacgtagaagccatgatattgtttgcagagggaatctttcaagaattggtaactgcatctccacatttattttgtacccttgcaaagtataaaaattgagattccaagatttctggctgtaaatgtttaattttccaattcttcttttgagcaaggaagattgttttaaatatttacttagcttttaattgcacatcatttcagatagcgaatgccgatcagttttattgtagctctgtcggaggttatttaactcttagaaagatgtacactgtgatacttttttcagcttcactctttggaagagattttttttttctttaaacattattatttttagttgctgcactctacctctatttttggtaaggtaagactgttcaattcaatactttgagagaatttcagacaatgatagaaaatctaatatttgaaaatataagcttcactaacatacctaattccagatggcaaaaagaccttgcccaaaaatgtgaaagaattcagtatgagtggctcaaatattttttcatgataaacaaatatttctgggatggatgtgtttctgagctctgcataggaaagcagccatccatgcaagccgtgctgggctacccttcaaaccctctttactcttttcctttcactatgttaaatccttgagatgtgtaaagatgttatgataggcagtgggtcaagtaatctgcacatgtagctttttataaatttttctttgcagaggaaaatttttcttcaaataaacctccccaaataaatggtttgtaaaaacaaaagtctatttgttttgaaattgcacacaagaaaacatgttataacaatatctttgagttccgcctgagaaaagaaatttacctatagtcagcgatttccttcatgataaggctttaaaaaataaagttgtctcttgggagaaaataaacatagcgaagtggagatatttataatgaggtgcctttattcacttgtccagtggaactgtttaactgttgttttatctctcctctctttctttctttataattatgttcatgcaaattcctgaaccttaagcattttagaaatgtgttatcttaaattacacagatacttcttgaatgtgcaaatgtgccattttttcccccacttgaagtagaaactgtaaacaagtcttgaaatttttttttgcccaaactcgtggcaaaatgtctggggtttggggctattttcacagtgccactgaaggtgagcaaacgaatgggaacatgcgccgatcaccagtcagtgacttgggaatttttcaggaggcatattttcttacgttaatgcttttgtagattccatcgatgttcagacatcaaagggcatgcaattaataatgggcatctggagggccgatcacatgtttccgatgttaaagtggtgaacgacaggaaaatcggccacggtcaggtattagctgtaatcatttttaaccaacaacgaaggcttctcttttgtgcctctgctctcagaaacgcaagccttcccatacaaaagggtcccatagatgcttttctgctagtgaatgagtgagtgataaatgatttgtagacctacgtctcagtgttgattcaaataaccttaatttctccaataaactcaaacccaattttgtgtgaaaccccacatggacacaaggcaacagacagttgtattatttgaatctttagttaattctttcaggtttgctcctttatttgtattttttaaaaaaataaacgaatattttctagtactagaataagattgcttcaaccaaaggtgaccttatgagttatttatttcctgtcttttatagtagcctgtttatcttttccaaagtgatgtatgttacccaattccaagtaatataagatatgcaggtaagactgtgttaaagctcaacaaaaatgttctagagaaatacagtgctttgggctctaaacactccagcaggtatagaaacctgcaactctttaaaaataattctcatttgagtaggtcacagataataaaggaacacttgtttctgggaaattaaaaaaatgacatgaggggaaaatatttatttgctttctacattggtcaaatgactagtggatattaaaaacctgtaaaatagacagatgcaaccaattctctttcattaacaaatattgcaatttcacaataaagtaaatgcattaaaaaatgtctacacttctgagaagctgaaatggtcagaacttgagcttgctttaaatgtttaaagactgatattctaatcagttgggggaaaattattattataagtctttaaagaactaacttgaattttaaagcctcctttggctgttcaggtagcaaaaactctgatcaactctgtgtacatttctgtacatttgcctcttgactcaatctgcccggtcaccagctttgttttctttctaagtataagccgtatgtatcggcagcacattttaaagttaatttgaagcagggtctatattgccgtcagcaaatatgttataagcttattatttaatagtgattccggggtaaggccatcatctccttcctaaatccaaatataaaagttgaaatcgtatttgttaaaactgtcatgttgaatttgtggcccagattgttttcccgaggcctgctgggccagagctcgaatgccgctcccagctgcagacaccccagcccaggaaaactgctcgcggctgagtcgctgagcctctcaaaccgcctgcttcccccaaacagagccacggcccagccggctcgctcatggcttttccacattgtaaaatcatttgatttatttgtttggtttggtttggtttttagaagcgctgcagaaattatttcctactggcagagagggcacttggtgttacactacattagtttcacatcattagtttagggttctcaaacttaaaatggtaaagtatatgcgaggcttctagagacctcagttctgaccagagcagaacaaattaaacctgatggattcctttcgctgcctgtgtagtgtggggcaatgcagaacaaagtgctgtggcgttgcggaaggggttccctctggcagttttggaatttggtggtaggaaatgttagttatttataaaaaggaaaaattcctctgttaccattctggttttcacaaaaaccgtaattttatcatcacggcttgtagcaggaagccaacaaggggtgccgatgacggccacgaccccgtatctctgggctgtctctctcacctccatcggccactgcctgcttgctctttaggagcaaaggacatgatttagaagtaattcaaaaccccgtcgcgggacccagaacagcccagatggtctggccctggcctggggtctgcgggggtgggggtgccagccccgggggtggagtcgaggtcggctcccggccaggtcccgcgacgggtctgcacgcagccagggaggcctgagggggcagctgcggggctggcggccaggagctgcttcgcggcttgcggcgcaaagtagaggccccgctagctcgctcccgcacgccgttctgcgccttctcttcctagccccggcaggctctgtcttcccccgtgggtcgcagcgagagggagacctcggcctctgccgctgcagcctgagacccagccgcgggcctcaggtgcgcgctccccgaagctctcctgccacctgttggccgccggtggtgctgacgctacggggagaagccacgcttcagtggcttgcctggaattcatgacttgtgcgctccacgtcctgggctggccgacctgctgagggtatctctgagagcaggagccaggccgtcccgggctctcctgcgacagtgcggtgggagagccttagcgggagccaggctgcgccatggcttcctctggacagttctgctggcgtgccctgcttggcggggtacagtggggcaagcggggtataaacccgcttgttcagcttgggagcaggctctacttcccaagagcagcacaggggcttccgccggaagtcaggaagaaggtttgaggagcttcagatccaaggacggtgccatgccttttcattggaagtcatggaccaccctcaaatatcatggattagccattctgttcccaggggctgggttcctaggtatccaccacaaacaggcttgaatctacccacacaaacaaccctatcaggaagtctccagcaaagtggggctcttggtggctgttttgggttttgggtagaaggtagtatagcagctatatttctaaaccatgggggcaaaactagatatctatgtcctgaggggactgagttttgtgaatggatttggcctgtgaggatgtcacatggggctcagtagcactgaggggagaggctgtgtgtggtgatactctcattcctgtcttggggaagggggcctggagccatgactttcccctaggccttttcagaaggggctgggaatcacagtagatgtttgtcaatggaggagccttggccccatttcagacgcaatgttttctcgttctgtggtggttttatacacaaaggctgtgtcctgcttggccacgcctgcctgcagcatgtgcaagcatgatacttggcgtctgggtgcagcagggcatccgtgctccatgctgcgcgtccagcatggctggactgcccttgcaccctcattttaccagcacaggtcaagcagttcccatggggccttcagctggtagcagcaggacccatgggtatctaacccagacaccttctctctcccctatagagggagttggctgtcaaagcccaaggatgtctgtttttaggtgattgtctcctggcttatctgaggccaaaatgttcttacctcctggtctctgagatcatagaaagagactctggtatttggccaaatggctgctcagaacctagtcctgaaaagttattttcttagtcaaggggctcatgcaagccctggactaggggtgatttagttgtgttttttcagctcacctcataatttaatgtagaaaaaattatttggcatgttttctcctgggtgccgactgcctttagagccagccgttctgtacggagaaatgccccgtagtcagaaatcttcttgttatgccaggtctgcgcattcagggactgcgagtggctcactgaaatctctgaggctggccagccaaggagggagaggaatcctacctaccctggacttacatttttatggagaagaaggaatgttaggaaagtcagtaaacttttagtccctcctggccccatgaacatgaatagaagaagaagaaaaaccctagccgactggttatttaccccgagcacaaaagcagcccccctcccatcatctcccttttatttccagccactctgacagaaatgcattactggctgaatacaccttcccacaatgccatccatcacacaggtattgggggaccaaaggtaagatgaactttaaacacacctggcacagctggctcccacctttgtgcttggagtggctgccagccagctggctgccctgtcccccttctcaggctctccagaggaatcccagcagactgacttctttttgtggccacatattattctaaaatcaggctatgcaactgccttgggagagtctgggcaacctctcttgtaagtagccctctcagccccgtagggctccaaagagcttaaagctgctcagtcatgagaattttccatgggaggaaagactctctggggtcctccactctctcaccttcagaagcaaatagaacaggtcttccaaggcccccgagtgattccgcccggcgtgttgctgatgctgtccctctagtacttgtggattctttggaagagaaggtgggtgattgagctgtggaccgcttctccagttttatgcatctggaactgagagactttcacagaattgtagcaaataaagagagaaagtactttattagcagttattctttacatcactaaactcctgtctctcaccccaggcagctttaagatgcagctcagctctcaaccttgcctatgactgggtaggaaattaccctgtctggagggagaatgactcctgagtcattctcagtcttcctccccagctgctgcgagttcatttgttttaactttccctctcccaagataacatattccgggggccagtgaaaagaaaatgtggtgttggaaggtcttttaagtgggaacattcttggttgtgaggctgagctgttcaggaagaccttgatgctttcctggttcacaaagccgagaggtgatgaggctatagtggcactttggatttgggggtgataagactgttttttgtaaaacactggaattctctgtgattatcagttggggaattcatcatggtatttatctggagaggaaagaaggcaaaatggacttcacaacagtcaactgggtcactcgttgtcaagcaatcacttagcatgtgctctgaccattgagtgtcattgctattagccacttaatccccacaagaggccatgctctaggtcaccctcattttagagataaagttcagccctgcttttcttctctacctgatctcagcatagacagctgagcattgctttgactccagcaagcagaacaccactctcagagcccttgttattagcttgaattgaaattgcatcttgacctcaaatgagattcaagagcataggaacaaatacttttagaagaactaaaggagatgataaaactgtcatcgcatatgtcaggcctttctccctggatttccatgtccctgtttctctctccctctcctctggatgtcctactggaatcttgtagtattcacctggctatgagggagaacattgtgaaattccagaattgccacagcaactttggtaatgtggactccttacttggtctgtcctgtcttctgccattgcaatctgatggagctgtgggcgtcctgatgccagatataatccaaccaaataaatctctaagaacataaaataaaagctatctcacagtttccttttgtttcctgcacaaaagctattctcagtatatgaatggtgtcagatgcaataatccagaataaatctccaagaagaaaaaaatgcatttcaaagtgaatgatcactcatttcccatcctccccaccatttttatattgggtgagtcactggggtggctgccgacagctcctgtgggccggccagaattgggaggaagattacaggggcttgctaaggcctggggttgctgccagatctacacaggtcattgagctccagctggggagagttttgggttttggccctctgggccatgtccatcctggcagagggtcagaagaagaccacacccctggattctaggcttccataatggccttgtcttctccaggggatcctacaggtatgttcttgccaagtatatccactgtagaaggctggaaacacttaagtcatatatgctctttgggcagattaaacttgatgattctggggctgccctcttcagggcccggctggttgcccttcttggaacgcctgcatattcactggggaagggcagtgtgacatagctgtgggggaagaatatgctggggcatttgccaagtctagatttcaaaaggccctttcagaattggaagacttttgccttgaatggttagtcttaactctattatttaccctagtctactgtctacattccaaatttttcctttcagcataagatccgggcaatgatcacatattgtttcttttttttttttttttcaacttttagattcagagggtgcatgtataggtttgttacttgggcatattgcgtgatgctgaggtttggagaacgaatgatcccatcacccagcatagtaccacatagttagtttctgttttgttttgtttgagacagtcttgctctgctgcccaggctggagtgcagtggtgcgatcttggctcactgcaacctccatctcccaggttcaagcgattctcctgcctcagcctcctgagtagctgggattacaggcatgcgccaccgtgcctggctaattttggtatttttagaagagatggggtttcaccatgttggtcaggctggtctcgaattcctgaccttgtgatccgcctgcctcggcctcccagagtgctgggattacaggcatgagccaccgcgcctggcctttagttttttaatccttgcctcctgccccatcagtgcccagtgtctattgttgccatctttatgtccatgaatacccaatgtttagctccctcttataagtgagaacatgtggtatttggttttctgtcgctgtgtaagtttgcttaagagaatggcctccagctgcattcatgttgctgcaaaggacatgatttcattcttttttatgactgcatagtatttcatggtgtatatgtaccatgttttctttagtctaccattgatgggcatgtaggttgattccatgtctttgttattgtgaatagtgctgtgatgaacctatgagtgcatgtgtctttttagtagaacaatttgttttcttttggatatacacccagtaacgggattgctggatggaatggtagctctgttttaagttctttgagaaatcaccaaactactttccacagtggctgaagtaattgacattctgatcaacagtgtgtaagtgttcccctttctctgcagcagtgccaacatctgttgttttttgactttttagtaatagccattctcactggtgtgagatggtacctcattgtggttttgatttgcatttctctgataatgatgtggagcattttttcatgtttgttggtcacctgtatgtcttcttttgagaaatacctgttcacatcttttgcccattttaaaaaatgagattgtctgttttttgcttgttcaatgtttcagttccttgtagatcttagttccttgtagatctgttgtcagatacatagtttttgaatattttctcccattttgtaggttgtctgtttactctgttgatcgtttcttttgctatgaagaaactctttagtataattaggttccactagtttaatttttgttttcattgcaattacttttgggaacttagccaaaaattatttgccaaggccaatgggtagggccttgccaaaaacctagggtattttgtaggttttcttctaggatttttatatctgaggtcttacatttaaatatttaatccatcttgagttatttttgtatacattgaaagatagggatccagttttattcttctgtatgtggctagccagctataccagcatccttcattgaatagggagtcctttccgcattgcttatttttgtcaactttgttgaagattagatagctgtatgtctgtggctttaattttgagttttctgttctgttctgtttgctatgtgtttgtttttataccaaaccatgctgttttggttactgtagcctttcagtgtagtttgaagttgggtaatgtgatgcctctggctttgttctttttgcttaggattgctttggctattcacaatcttttggttccatatgaattttagaatagttttattccaattctgtgaataatgttggtagttcgatagtaatcacattgaatctatagattgctttgggcagtatggtcattttaacaatatcgattcttccaatctgagcgtggaatgtttttccatttgtgtcatctatgatttcatttagcagtgttttgtagttttccttgtagagatctttcacctccttggttagatgtattcttaggtatttttattttttgatggctactgcaaatgggattgtgttcttgatttgtttctcagcttgaatattattgatatatagaaatgctactgatttttgtacattgattttgtatactgaaactttactgaagttatcaattccaggagccttttggtggagtctttagggttttctaggtatagaatcgttgtgaagagttagtttgacttcttttcctatttggatgccttttatttctttctcttgcctgattgctcttgctggcacttccagtactatgtggaataggggtggtgagagtaggcatccttgtcttgttctagtcctcaaggggaatgcttccggtttttgcccattccgcatgattttggctgtggattggtcataaatggctgttactattttgaggtatgttccttcaatgcctagtttcttgagggtttttatcatgaaggaatgtggattttatggaaagctttttccatgtctgttaagatgatcatatggtttttgtttttaattctgtttatgtggtgaatcacattgactgatttgcatatgttgaaccaaccttgcatctcaggagtgaagcctgtttgatcatggtgaattaactttttgatgtgctgtggaatttggtttgccagtactttgttgagaacatattgcgtttatggtcacacattgtcaggtctctttaacctttcatctggagtggttattcagcctatgtcttttatgacattgatgttttcttgaagaccaggtcaggatgtagaatattccaattcagtttaggtttgtcagatgactgtctgcttctcattggtgatgttaactttgatttcctggccaaaatcttgtctggttactgcactgtatagttaccattttcccttataactaataatcgatctgtgggaagacactttgaagtgcaaatattctgcttctcctcaaaatctacaccccacccctcctgctgaatttagtgtctgttgatgagtcctgcctcagccagtctttactgcatggtcagaacatggtgattttccagtgctgctactttctgcatatttcccgcttagcgttcttctctgattttgagttttcccgctttccctctctcctttcttcttttctcctcctcttctgctgctgctgctgctttatcactatagcctcattgattcctgttttatttaatgggctcaaatatattattgtcattatttgttttgtgctcaaattgtcctaggtttagccagtgagatctccttcaggcttgtctcctgtctgcttttcatgtgccaccatcattactttcaatacttctttattttctggcataaacaagatgttccaggcttaccttttaccttccctgacctagtcctggcatcagctgttttgctaaggaactctggttcctttaagtggggaatggtatttaaaaaccaagatctaggcactgactatgcctaacactactggagtgtcattgtctccaggctccttcaaatctaggatagatatgtacacacatacacatatatcccctatccatcccagctgtgaaatatacaagtatgtatgcatacacatacacattcagagttacacatacatatttgaaaatgtatgtgtgtctgtgtctctttgtgtatgtatatatgtgtcatgagtgtccctactcccatatttggatctcccctatgtttagaactctgacttccagcattatttcacatttactcagtctcaatcctatactgtatatagaagattgtttcaaaattggtacacccatactgctgtgagaaacaagtctaagtgaaagagttcacaattagtttgcagttctttttcttctatgctgaggacatatagtcaatatactttgttcaacaattactaggattagtgctttcccacatcagtgtggttctgaatttgggttcatcagcagttttcttaggatttatttgcaatacagtttggctcgtttgctttcaatttggtttttgttcccctcatccttgttttttgattctgtagtttatgaatatgcttccaaaattaaatgttatacaaaaaaaataccgagaaaagtgtcacttctgtatccctttcactctatctcctccgccattccccagaaggtaaacaattttatatttttctgatttttccttcctatgtttttttttggcaaaaataaacaaatgcatgtatgtttcctagtttcctcttctttcttacatagtgctagtatatattatgtattcttttgagccttgctttttccacctgacaatatattctagaaatcactccatatcagttcatagagattgttcgattgttccatccttctttacagcaggaaattactccattgtatatatgtaacatagtttttttttttcaaccaatttcctgtgtttgagaatttaggtagttttcaatattatgatgtaatgaataaacttgtatgtatgtatattcttgtgggaggtgtatctttagggtaatttttttagaaaagtaagattgctggatcaactaagtgaatatgtagtgttgttagtattgctgaattcctcttcctaggggttatataatatgcattcccactcatgatgtatgaacatacctatttccttcctgctttgccaacagaatgtattgttgggattttgaatttttgccaatctgatggatgggacatagtatcgtagggaagtcttaatttacacttctctgtgtgtaaagttgaacattttttttcataggtttcagaggcattttaatgtcttcttggtgaattgtctatttatatcgttgattgtctttctataggattttttgaggtcttttttttttttaaaggtgtattggctccttaccagtgatacatgtaatattcttcaagttgcaaatattttctccaagtttgatgtttgtcttttgattttgcttgtggtggttttttttggctctgaaaatttttaaaattatagttatcagttttaaaatttgatttcatttggaatttgattcataattagaaagcttttctataccaaggttatagaagaattcactcatgtttttctcttagtactactgtagtttaattttctacgcttagatctctagtctatttggaatttatttttgcatagatgtgaggaatggatctagttgtattttctcaaatgtctatccataccaacaccacttattataagatcatctttgcttgagtgatttgagatatcattgttatcatatgctagatttccacatgtagttgggcttatttctggtctttggattcgattccactggtctgtctctttgtgtgctattaccatacctttaattatagaggctttgtaatatttaaaaatacctggtagggctggttccttccttagagctttgcattttcagtgttttcccgcctaccaattcttgcaaattaatttttccatatgaaccttactatcaacttgtctggctacagaaaaaagccatttagaatttttaaggcatcatattaagtttataaattaactgagtaattttataactgtttataaattaaatttatatcattaatttaatgatgagacatcctgactatgaacaaggggtatcttttgcatttattcaagtcaacttttatggtttttaggagggtgttatggttttctttgtataggttttcaacatttcttgttagatttatttctgagtattttattattttcattgctattataaatggaagtttcttttctgtttacatcttataattagttattatttgtgcctataaaggccactgacttttagtgtttattttatgtcctactgacttgctgaatattttactgtttgagttagttcagtggctctcagtatatggtttgggtacccttgggggttcctgagattttactagtgaattcacaaggtcaaaaccattttcatgttactaagactctcatatttatgatactaagacataattttcccttttaactttcattctcaagtgtacagtggagttttctggaggctatgtaatgtgtgctatcataatagattgactacagaaacatgaaaatccagccgttttctattaagctcaacaataaagaaatatttaaaaatgtaaaatgttgtcattcttctcactgaaagtttttgtttatggttatttttcaaaaatatgcatttatattcttactttaaaattaatatttaacattttctcagctttagtttctaatctgtaaatatcaatagatataacccacataaacaaaagctctttgaggtccttgatttttaagagtgtaaaggaattttgagaataaatgttttgagaacttgtgagttttatcatttattctttaggatttcttgataaattactgtgtcctctgcaatagagttagttttttgtcttcttttctaatcctcaagcctccttttgttttctcttgtctatgttagctaatacttccagcacaatgttaatagcggaaaagtgccttgttctttccttttgtgggaatacctctagtgtttccatattaagtaggatgctgaggtgctgattgtattgttttatttactgagtttctttctctatttgatgtattttcattgttgtctaaaaattcttttggcatttagaaaggcttatgtttttgatctagtggttgccatcatatttataccttttatagtgcccttaattctcccctttcttaaacttttactatctagtctgtcagttttacatgatatcctttgactctcacctgttacctaaacgacaatcaatggtcatattttgctttctcctttggtactattttaagattacattctttctactttgtcagaacatgtcatatttacagaatcttctgataccatgaccccaccctagttttaatcttagctctgtaattaaatgtattaaatgattatcggttcttttgcagaagctcccccagttatcacttggttggatgaaggatggatataaaatccctactcactataaaatccctactcactgccaggaagtaccttcctggcagccagtactgtgaactaagtttcagactcatgttcattattttgcatttagtgctatactttttacctctctggggtgattcagagtttcttgaaaatgctgttccactcttacccaattccgtgtgttgttcttagaaagcctgaggtcagcctacattttttatcagaataaaatttgacctttttgcctgaaagtcatgaagattttttatttgtcataaaaatctagtagttttactaggatatgtttcagagttgttcattctagatcatttctccaagccacacagtggaccttttcattatgttgatttaggatttatcttatttctggaaagttttcttgggttatatttcaaaatatttctattttattgttttatttttcttcttcatggactccaattatacataggttagctcatctttgcctgccttccatttcaaccactttcgctgattttttttaacctcgttctcaattcattttcatttggtttttgttttactacctttgtaaatgctccctattaaattttcatttgaacttattctctcttgggcacattgtaatttgttcttcatttctgaaatagttttggtctttttcttaaatttatttcctgaaattgatcaactcccattgcatttcttcctgattttaaaaggttctcttctaagttttaaatctctgattctagtttttttaaacaatattcaaatacttattttataatatttaactcagtttggaatgttacatgacagtttacttctgcttcatggttgattttctttgtgggggagaattttaattagttgaaatgttttggtgcatattttatctttaaaaaaaaaaatcagctccactgattagccgaggaatactaataacaatgtggagttagtacgagttttccctttattcctaggcattttgtggtgagtgcctatttcaagagtgccctcttctgtcaatatgatgaagtgcagtttattgaatgaatagagggagtaggagggcttgtcttgttttctgtcttttttttcccctgcagtatgcttaatttcttctttttctttactgccatatctctaagagacacctattttctatttattttcttctcttcccaaaagcagtgcttctctgacattgtcacttctgaccctactcactttcaagtaccttcctgacggccattactgtaaactacgaagttccagacttatgttcattattttgcatttagtgctgtactgtacctctctggggtgattctgtttgtcttgtttgttctctctcctccttttgtttccatggaatttcttaagactcccgtttcctgccttctacacctacagatttccagtaatggtaggtgctttgttagaatttggtacttctctactgaaatgtaatttggaattcatagtattatgtgactcctagtaatgacaaagacatgagtcatacatagattttatttttgcttgttgttttttcccctttgttgatgttaatttttttttttaagctgtttgaagtggtttggatttaggaagccaccattacctttcagacttattgctctttaaacagtgaaaacattggttttcaaaggaatctttgtcatttcaacaaatgctttaaaaattacttggattaatatagttggtgttggtaagaccaccgaatgtgttgatcatgttttcacttattttcagtgggagaaatgccccctggtggaagattttagaaatcttttcctacaggagaggatgcaaacctctcttgggagagaggaggcccttatggaaagagaattgtttctcttttaaaaaataattttaattttaatttttaatttttattttaaaattttatttttttaggttcgagtgtacatgtgcaggtttgttacataggtaaactcatgccgtggaggtttgttgtacagattatttcatcgcccaggtactaagccccagtagtacccaatagttatcttttctgctcctctccctcctcccaccctccaccctcaagtagaccccagtgtctgtcgtttccgcctttgtgtaaaaacacttgtcctgtggaagtcatttcaattttaatgctagcattttctaccattccttagggttcaagaactcctgctctcatctatgagaagctggtcattggcatattgttaagtatttagtacttttcttttaagcattaaaaatagtcaaagtttttacattttgtatcttggtagagattacttgtccgagccgccttctcttcacctttacagttaagaagagctttggtggctgctaactagggaatcacaaaatcaggagattgtctttccagtgaagtaaccacatattgattccttcttggagtggctgatttggtgtctccatcaggggtttcttaaggcttttattactcaatttccaataattgccttttttttttccctaaaggaatcttcaaaacaactgaaagtagtataggcaaagatttcttgaacaagttgctaaaactattaatcgtacaagaaaataagcttatacattagacaacattaaacctacaaacttttccttatgaaaagacagcattaggaaaatgaagaagcaagctacagcatagaagatacttgcaaaacctacaactgataagtgacttgtgtatgtatataacaacttttacaaactgataagacaaagaggacagcccactagaaatatgtgcaaaagacttgaaaaggtactccataaaaggatatgcagatggccaaaaaataagaaaaactgtttggcttaattagtcattggggaaatgcgcattaaaagcacaatgagagacacaacacatcaacaagaatgactaaagtgaagcaaagcaacccagaagatacccaggtgttggcaaggatgttgaacaccagaaatctcatacgctttggataagttaaacatatgtcttcttatgacccagacattccattctatgtgtacaacaaacagaaatgcatacatatgaacctcaaaagacatatggtataatgtccatagtaataccatttgtaatagctccaaattggaaaccacccaagttcccatcaagagtgcatgggtaagtgaattgtggtttaaattcatactatggaatactataccgtagtggaactaaacagtccacaattatatgtaacaatatggaatgaatctcacaagtataaagttgtccttcaataaaaagtagaaacaaaacaaggaaaccaagggacaaaagtagctgggtgaaaactagaagctgatgctcagatgggaggtattcctgtggctttgtgtttgtaacaagatcctccacattcaaaacaggttggcaaggacttccagtcttagttgggcccccagcccactgaaggggccaacagggccacctggccagcctctgagccgtggttctggggcaaacaggagggggaaagccttggcctggataaaatctaaaaacaaagacagggtctcttcaccatcagaagttctagttttgagaatttctttttgtttttaattaaattttaattacccaggccatatagaaatatagtttcttgtaaatttaaaacatacgatgtcttgggtttgccttaaaataatatagggctgggaagtgggtaggcccatggttgaaacaagattgaccatgaattgatgattgttgaagctgggaaatggatacctgggaccttgttacgctattctgtttttgcctgtgcttgaaattttccatgatacaaagtaaacacacgagcatataattactgcaaaggctaatgccactatagatcgccaagcctcagctaccagtgcctgctgctctcttcctccactgccccctcagtggataacttgagtgttgtcttgggaggaaacagatggcacattctaactaggataattttactataaggacaagattgtaaagttgtgggcaggggaatccacaaagcatagtgcggcactccagggcttgctacagcagaaagcctttctcaccttaggcccaaagaacaagaacctggaagaggagagtgtgggcaccttgaaaggagccataatctttggctgagggaagtggccagtttttggagacctcctggtgggaggactgggaaaataactacttttgcaccaacctagtaagtattccaacctcattctctccccttcctttggtctcctgctggtgctgcaaggcagcccactgatgcagttcatatagagccacctcctggggcccagagggtggatcgtggccctgcaggggcaagtggaagatatctgatagagggtgggtcttgtcagatgtttttccgtgcatttacgtatgtgtctatgaatccagagacagtatgtggttttgttttcattgcttgtttgatatccatgggatcatacagcatgcttcattcacaactgtggctcttactcgtcagtgccccagtgttcttcctgtgccagtacatcaagatcagccttgttctgttcttgtggctgttgctgttccacagtgtgaacatgatgtagttcattttgccattccctcttggcagaacttaagttgcttccttcttgagaacttgttgtcttccctctgggagctctcttgccatcttgggaacatctgggaaggaagttgccatatgcaatatatcgtttgctcccatggagtctcatgcatggctgaaagctttttttttttattgtatatattctttatctgtccaaacagccctgatttttggcagctgggactggtaggaagagagtcaggtggggaagacaatgaggactagatcaggcactggaagacttgggtttgagtttgagctttgccacattgtcacttgtgaccttgggcaagtcccttcgcctctctgaaccccaatttttcacctgcaaactgaagatgatactcatgctttctctgcttgccttcctggatccttgtaagggtaccctgagacaaaggatgagaaagtgctttgtgaaaatctgcacagatgcagatattccttctacgctctgacttgaagtctggccaggagacgaaggctttttgttgttgttgtttttctttttgcatgctcccagcataatcaaagaagttgtttgtttggtttggtttttttggtctgagtcagaagccagtaacagtttcaaagtgcaaggctggtgctcctctcctccaagcccctctctgcagtgatgacaatgggagtgttgccaggaagcatactgtctctctgccccaccacccctgtgccctgacccccagctgtggccaggctcagcttcctcgagcgacagggctaccccagactaaggacaatctgactctgaacttttgggcaatcttttccatgggctaatttgctataggattgctcgtttttcctggaagaccgagtggctcttaggagtggatttttttgtccacacttagaagaccagcaaatggtctttccctcttctgtactctgaatcagagaggcagtgtgtgccaatgtcaccaccccacagacaagatgaccagctagggaaggggtctgtctgtgttcctcacttgttctgaatgctcagaactcaccttctccagaaagcttcctcttgtaatgaaccacagctgatgtttcttgagcacttactctcttccaggcatcatgctaagtgttctccatgtaccattttgtttagtcctcaccataatcttattgctgtcatctccgttttgtaggtgagaaaacctaggcccagagggtttaagccacttgactgaggtcacacagttaaaggcaattagcattcaaaccccaggctctctagaggtggcccatgtccttggacactaagttctatgccctcctggctcaccctgcccttcccgatgtcactctgcccttggttgggttttctgtgtgatgactcataatatttcttacccacatgtgccttatgccctaaaagatagtgaatgtattttctgctcttttctccctccccagagtgactgggaaagagttatgtatatagcaggagcttagtgaatgccaatttcttgtgaaaatcccactgggggtgctgttggcaggcccagcacaccaggaaggcagcattggccctttatggaagttatcaggaagatgaataaggcttgaaacgcgagcccctggcaggctgactcagaccccacagaatggctggccctggcctttgaagagctgagagctgtttacatcctactaatggacctcgctggctgcaagcagtcaatgtggctatataaatactccagcctggggccatggagtgagtgaggacatgaatgcgaggagaaaccccctcctcagcctcatctcctcctcagtgagggatccctgggcaggagaagccatggggacaggaggactctaatttagcaggaagccccacacggcaggcctgtgcgtggtaacagaatggtgtctagttgatgatgtggtatgtagacgtttctccccacgtgaagttctttgcataaataaatggtgaccagctgttagtcttcctattagcatgaacatccatcacagcttgtttcaaatctaagtctgggagggagaagcttagactcccatgaaaggcaaatgttacaatggtaatccagcccagtctggcacacatctgcttagagaaactcgcaaactggaaatgttggctgggatctatatggggggttgggcatggggtctgatgttctctgtaagtgtccccacccagggagctgcatttttgtcagcagggaagacgtgatgagatcaggctcccattggggcctgtcaacatggtgccgatggctgctgtactctccagggtgcccttccctatctcccaccagtgaccctggcccacagcagaccttgagaaggtacaggtaggctgggaagggaaaggtctcctcccttagggctcagaccctggcctgcatgttgtggtcatggaccacaggctgtttgagatgccctcttcaggggtagctagtgatagggcagaatgtcaccatcggtcctatggtgagttttctggtgccattctctgtctgtcccaccagtctctgagagggaggcaggagcctgccctgcctgccccatccacacctccccaaccagggaaccccatcactccctctattcattgtggatgatggtaattatttttaatatctctccctgggaactcagtcattcacccacccattctacaaacatttattttgtacctgtagcgtaccaggtactaggaatacatgggtgagcaggacagacatggtgcccattttactggagctgtttcattagagtgggaaggatagtcagataaagcacaaagagactaaaagacaatggcaagttgtgaagagtgctattaaacaaatgggatagagggacctagtctggatacagtggcttctcttgggaggtaactcttgagctgaggcgtaaagactgggatggaacccagtaagtgaggagcagtgcagatgagggactagcatgctgcagaggctctggggtaggggcagagcttggtttccttgtggaattaaaaaccatcagtgtggctagagtgtggtgagtgagggccagctaagagcagctcctggtggaattgcaggccgtgtgccagtcttgtggttgtaggagctttgcaggggccgataaggccagcagggttttatggagtttgggggtgggtgtaccgtgagtgaatcgctttatgtgcattggtataaaagcattttttgggggcctagtgcttgccagacagggtgttgaggcagattaaatttagcttgaatttcctcttgaaagcaaagagcccacagaggtctttaatttgggatgacatgatgaggcatggaggcagagcagcagtggtcctggtttctgtgagttctctgcaaaatggtttcccagataccgacacactcttctctctccctgtcagcctggggctccggcttatatgagtgcttgctgcggatgtgaccagtggtctgcacacagtaggtgcacagtgcactgggactccgtgcagtgcgagctaaggagaccctgtccttgggaggaggcctcagcccaaattgcagatggggaaggggaaaacagcacttcctcaagctatagagcatttgggtgcttactgcttcccctgtctgcacatggagaaactgagacctggagagaaagtcacaaagttcatgactagctgataattgtgttttccattttgtgttagaaaagtactaaagaaatcgatagctcaaatagctactgttagtgctgttaagatgcctgggcattcctaagagtacccagcagctgtgtcctggagaaccctctgtgtatccagtgccctttattcctaagaaatgaagtcatctctggcctgagaggctctgcatccttatattttaggaaggatgatttctattcttagtcttctcgctttccctgcagagtgatagagtgtttacaactattacccacactcgcctctgtttagccctgtaaagaacatcctcagcacttactccgcattaggatttgagctttaaatggaagacagcagggtgtggtgggaaggctgtggccccagcagtcacattgcctgggttctagctgtttgaatttggagaagtgacttgacttttctgagcctcctgtctccagggagacaggaggggcagatggcgattcttgcagttgtgactgtagcttgcgtggcagatgccagttcttaatcaccttccacacacagcttagtggttctccaacctacagtgtacgtgagaatcacccagagggcttgtgaagcagggattgctgagacccgccccgagaggttctgattgagtaggtctaaggtgaaaagtttgcatttttaccaagttcccaggtgatgctgatgctgctggtcctgaactacaactttgtgcagggctgcacacactcactgaattcatctctgcagccccttagtgttgtattgttattttccctttgtggaggaggaaatgaaagcttagagaattaggtaacttgcccagggtcgcacagctgctaggtggtgaagctggaatcccagtccaggtctgtgctgtccaaagccattgccttcacctctagctctaccatggtgctacctggcgggatgaggtgctcagtgaaggctggctgcagttcctttgcctctctagaccaacaacaggcttgggccttgatccaagattacagttgacaccaaatggttttcattattgttttgtgataaggcagaccaaataatactcagaaaacttagatgagaaaatccagggttgaaaggatggtaattggagagatgccgattcactagtcataggccctcaaagctagaggtggtggcttcctccagcctccacgcagtgtcctgcgatgtccacagtgcgaggggtcttccggctggaaggcttccagtggtgggtagctcactccccactctgacgctgggacaaggaggaaggacttgcttcttaaagtggaggttggtttgatggagccagcgcaggcccgctgacagaagtcacagccttctgtcttgcagtgcctctttacccaagtgggtgaggaacctggtggctcaaaggtccaaccatcagcactgtgagctccacaaccctgcacagtcggtgtgcgtaccatctcaggaggcctgagctccagggcagcagcaagaaccttccagctgggcctgatgggaagtgggggactgagacaagtgcagggtggggagggcacctctggctggggaactggaaggagcagagaggagggcaggggacagaaacgcagctggcatgctcacagtgcattgtttggcctctttctgtaaaccctctcctcactccctgaccacgtttcccctgtggaaacttattttctactctggtcagacttttggcagccttgaatacgaagtgttctagaaggaggagcccccatcccccagcctcagcctgagctcgaggttcctgtgggggcatgttgccttcctttctgaattcttggtccaaacgtttctgcagctttccatgtgagttctctggaagccagtttaccacagatacttcagccaggcaaccccatcttcagcccccactgccacccccactttttttttttttttggctggcaagaaggagtaaatttagggagggccgttgtctgtgttccagctcccccagtcctgagcaggcctcgcttaagctggtaccttcatctcagtgagctcagccctaaactctctgggtcttagctggattaagggcctaggttgttgctgaggaggaaggaggtacctctgtaattgctgtttaaatctgcctaacaatagccacatgtggagcccgatttgagggttattaaatatgagcgcccttcttcccccaaacatgcctttgtttgcatagccgggcagcatggggaaggggagagacaaaaagctatagagtcaaaggggagcttcagaggccctgtttccaggaagcaatgggtccttgggtaggtcacattctggggggcatcagaacctgtcacccgccgagccctctctgcctgtaacctctgaggtcccaggcagaggcagctgcttccgcaaaacttgtgggggtctcaccccagtgcctgctcctgtgttcgaaggtctcatccccctgcagcagccccctgcagtcttatgggtgacgcagagggaagggtgggtgctgtggagggagccctccgacgtggcccctctgcagcaatttggggacagatgggcgtgtgctgctcagtgtgtctctggtacccctgtcctacaacatgggtgagggggaagaaaagcgtgtttggaaggcctgctgttggctcctggctcttttctcgtggggtgtagggaaggccggggagctcagtttccctgctctccatcctgagacctgtgagcaactttgagttgcacaggctcatttggatcattgctgttttggagatgtgctgggcacatgtgtgtgtctgtgtgacaaagaactgggttgggtgaaggcctggagtgagcatggagctgcctctcaacggggtgtgatccctgggaggatgcagctagctacctaggttcctgcgtggctctcttgtttgggtgctgtgctactggctgcagctgtggggcctcctgatgcgaaggtcaagcagcagcagctggctccaggaccctgccagcaggacagcaggtgtcggctgtctctcctgggagcacttacccactggccaccacagccactctaggtgagccccaggacagacccgcttccctttggagggtcctcacctgtcactccccagacacggtggctttgtcaaccatggagagtagaattaaaatcctgcagaaagttgtctttataggtgacagattccttgatttttgctttaaagtataaatttatgctaatttgtaagctagattattaaagttaaaatctagaaaaagaacctaaagaataaatgatgaagacaagaaccgacagagaaattacatttgtaccatatgatagatgaagaatatacaagagttcttacaaatcggtagaactttcttgtttgtgacgatgtgggggtaggaaccctcatgtaatgcaggtgaaaatggccacggcatctctgaaaggtgctttggcaaaatgtattagatatatttaaactatacacaaagctttatcttttctctgtttctacaaaggtatgcttcttacagactcttctcccaggtttttttctttttgctaatgagcagttgaattttccttctgtgggatgcagttgtgtgttataagttttactatatttataatttgtattgaaatgctgctacagattttttctaccctgcccatagcccacgttattaacatttctaacagcacgttagtaccaggctcttctcaaatagaattaaatgctagagtggggagggggttggaggagaagggggaggaagaagtgtgggctttggtattaggtaagggtttgaatcctagcagtgtacctttcttcctgtgtggttttgggtaagttacctaacctctctgagccttagtgttgtatctttcacctgggactagtgttcaccaagggctattgttgcgataatcaaaggaaggagtgtggatgaagcccctgagcgctgtgcctgggaatacttggtgaatggagctattgttactgggtgtatagagttcctgtgactatgacttagtcacctgggtgcagggagcctctcggttcggttcctcaggtccagtcccctacctcttggcagcactggattctaggcatccccagagatagccatctatcttaccctgtctcagaaacccccaggggaagggaagcccagactcctgcttacccaagcctttcagcctgccaccctcagagccagggacttctcctgagtgtctacacttaaaccccattgccagatttgaggcttccttcctctgtttcctcagggagagaagacagatttccctcatgcaggaagacgtctgactctgtggcaagcagctctatgttgcaatctccctgtgaaatcgcctcataagaagagttaaaaggaggaactaaaggaggctgtggagagagacatgtgccctataacatcctgaaggaccatagggctggatatgcctgcatcttcctgtgggactccggtacttagctggcccctccatgtctccctctgcatggctgtctcaaagggatctgagacagccatggtcatggctgcactcctgacccttccacccagcatagcacagtcaccttgcctctcttccagtgtctccgtctcaggggccacctgggaggcatccctgacatgccctctctctagcccccatgtccaatccatcctgaagccttgtcagttttatgtccgacagctccttagtccctccacctctgtccatcatcgctgctgccacctcggtccagtcacctttacctctcatctggacagcacatcctagctggccacctgctgtcaccttgatcttaccttgctcttctgcagtcctttctccactcaacacccagaaccatctgttcaaaacccaagactgatcatggctctcactttcttaaaccttctaatggcttcccacttttctttgaatgaagaccagactgcttagcatgacctatgagccctcgtctgttatcactctgccccttgctctctgctgcccaggcactttttgctttcctttctcagttcctcaaacatgccatgttctctcccatcccagggccttgacacatgccctggcctcttcctggacctctttctgctctaccccttgttgtctggttaactgtcgctgatcctttagatctcaactcctgcaaagcctcccctcaggctaggtcaggtgtctttatcgggagctcttctggaactgagttcctttccttcaggatccttaggtgcctttgcagttagatattcattagtgtggctatctgattgatatttgtcttgatctttgcctcccccccatccccccccccccatgctctgggaaagcaggaattgtgttggatttgctgtccatttcacccatgcctagcataatgcctggcacacagcagatgctccatctgcacctgtgcaatgaacattgctctctgaggttcaacaaggaccagagcttttccagcccccactttggggattatcatggagcccatgcccactttccctggcatcctttctgtggtcaaacatgccccccaccccccatgatctttggggttgggtttggagtttggaacagccatgagccaaggatctggtgctttatgcagggcagttgtcaagtcccaacttaatgagtagctctgagcttctgaatggctgggtgtactcagagcctttgtgaatgggattatactcaaatgctagaagggcttttgctatttataagaactctgggataaagagaaaacaatcctttggtaaaacaaataattaccagcaaacaattgccagctaatttgtcccttttgtgacttcagtttattataggtactaaaagagctttgccagccacctattagagaaatgagtgacatttgctggctaaaaagtctttgtgtgagtaagctcaaggggtctggtggtaatgatgtcttattggtcagctggctctcccttccaagtctctgaagtgatgtaaaggccattaataaattgtcactgtttactaccaccccccctccaccctgccaggctattggacagccagttctttttccacattccccttcctccctgttccagctaaataataccctctggcagccctaacttgtcagtattgttgggtgacagtggcaatttgactggcaggtggtctatgggaagagtggcctgagttttcctcccagctttgtcactggcttgctatgtgagctggagtgtcgcttcacctagctgacctcagtttcccctacctgatgcatctcttccaaatgtgtagggcttaccctaagatagtggattaaagtgctttgaaaagtccaacataattcaaatccagggaaccctgaagattgaaatctaccagttggcacattgctaactttccagtgttacaacttttcagcacttggtcttctgttccaatgtgaccaccttgcataggttcaccttatgtccctgggcctcagtttctacacctgtgaaataagatgggctgattctggattggtgagtaggagaactagatgctgtcatttttctcttctcccacaattaaggcagccatcgctagtgaactccagggatgcagtactcctcaacagagccccctggagggccagccagggttgcacctggggccaagctgttcgccagttgtggggagtgaatcttcacaaatcatcgggaggtacagttgagaatcgaggcccagtgacactaagtgactcgcctgccattgaggagtgagcacctctctggatgctgttgggggaggcaagaggtgttgcccatctcaagtgatgggcaagtttgggacacatgagaggggcccaactcagggccaatgtgggcccgttcctatgtgtgtttcaggggcatcacctttcctcctgcccacctcaaaggtggcttttgactttgtcctctaactgaggtagctgggtttgtgtcttttgacctcctgcctcctcttctagggtaaacaaggcagaccccaacaagaatcttgccagtccctgcaggagcagattagtggccatatccctttctggggtcgggaacctgaacctctttcctggaacaggtatttggggctgggtgccctaggaagtgctgtctttttgaagtaagctggtttctcatatttcgaggtgctcttcctcccagagtaccctaggcagagggttatttgggtgttgggggggatgagttatggggcaaacgcgctgctttgtgagcattaggaagtgcaggtgaatgggctggagctctcctgtcctccttcctgtgttggatagcctctgctgcgaggggtggctgggggttgagtggggaaggatggggcctgaggagctgggagggcagggcgatgtgctgggcttgggcttctgagggcagcaggcccacctgaagcccccagctgtgtacagtggggctgggcttggaggcaggggcctgcctcccagttcaggactcaatggctcgagttcccacgagagaggcaaaggtcttcttttggtctctgtccctctctcatcccattctctattttatttacattttgcttaggacatttcatgaagacattatacagccaaattcccaatgtgacctccaaacatcaaacatatgtattccccagcccctccccaggtgtttccctggcggccacaggcccctgtttgtgaattctgggcatctccaataggcactttcctctgacctggttacgctgtttaacaaattcatttgggggtgagctcagagatgaggattggagaggagaaagaattgtcttttcttcttaactgtccccaggacgccctgagcaagcttggaggattctcactaatctaatccctgtcagaaaaggaacgataaaacaattcaggctttagaagccaaatccccttcctgcactcatactatttctatatctctgccttaccgtttttctcctttgcaatgaaactgagcttcggtttctcagtgagggtttcagtggataaggatttcatatttcactcttccatttttcgtatttaaatttgctttactctccagtttgactttccactgacccttgaagaattggcgtatttcaaggagggggaaaagatctcattataggaaatgagaaaaatggagcagagttttaaaacttttaatgactaaaacacagtgttcccagtcggtattgtattggggttgaagtcactgtttggttacaagtcttttaggtctaaacggggttgatgacatctgtttaattttagatgtctggaatacattcggaaaataatgaaatccaaatgtatgaccaaattagagaacaattttatctgcgacaaagaagtttttaaaataagaacaactatttcgaccaaacaaagctttaaaagacccatcaaatctttggtcatctcgccttgtcttttcccagtgggtctccatggttgagagaacattgattttctcggtgtgtgcctcagacattattatgtaattttatacccattttcccgtcgtttctctgggcatgcgttctgctctgtgccatcagccctggagagaccacgttcagggaactgaggacgctttatgggaaagctcctttgataaagcaaaggtctcctgtcacaacactcgagggccacctatcacctgtttcatagtgacccaagcaactgtgggaaaagtcctgggaagataaaaaaaaaaaaaagtgccaaggccttgccaatggggcatggcgctaccaatggacatcaggagaaagcagtattcccaactcttatcgtgcctgtgtgacctggcagtgggccagtgtgaccctgtgtgaccctctatgcctgtgtgaccctctatgggcctcgcttgcccaatctgtatgaagagctcaggcactcagggatcctgagaggctggcaggggttggcctctctccaggaagattctgatgtggtgctgaggcactgctactgggatgtgcattaagcagttcctcccatactccctggaagcccagcatctgggatgatgtggagactctggtcacatgggtctcctttattgtccctaccccaggaagtgcaacaagggtagtgtcagcagacagacattctcagagtccactccactccagaccaggtccagtgttcagccatatccttcatccttggtgggactttcatgtacagatagaaagtgaattatgggcaaggccttgcctgatgccttaaaacacttggctactaggcaaggtaattccatccctccagggtatttgagccttccaaatgtttgcagactcttatcctgccctgtcccatccctccagtattggctgaagcctttccccgagaaccagccccttctgtgttgaggtgccccacccccattcagtgctgtttggtcaggctcagtcgtcccagagtcagcttcctgaaccactgtcccatggagaatgtctgcacatttcactcgagacttgggcttgttcgccagatgtcccagaagtggaaaaaggtgtcctaagtgcttgcccttgactagtgaccacagataagcctggagatggggatgatacacttgtgatgcccaggctatgcctgggtaaagctgggtcttggcagggtctccagcctgggccgacctctgcagaaatgagcgggctgagtggctggctgcatgaatagaggggtggaaaatgctgaggggtacccaggcccacctagaactctgggctggggtctgtgtattttgttagccccttgcctgtgccatctggccccttcttgatgccccacccagctggggggcatcattggctgtgctctaggaagggttgaaggatcatctgattgctgtgatatttggcaggtatgtttcagtacattcatgggggcttccagaggatcccagaggcctcgtggtcaagggccatggactctgttttctcatggtcaatgggctgaggttagcaaggagagaggtacaggagagggcagagtggtacatccaacaactggtagttggtgaggaactgtggttctgtggttctacgggaagctagggtggagtttcattcaggcctgggaggtggtgggtggagatcatggagcactgagctggcagtcaggagacatggcccctgcctctgaagttccacgtgaccttgggtgagccagaagcctcgctgggcctcagttcacaatctgtaagatgtggagatgaataccaacctgagaggcttgtggtgaagcccagataataacatggatttgaaaacaatgataaagacagcacattgtgaagaagttttaattttgtttttaccaatggagatataaaaggggtagtaatgataacagccagtccatttctgttgcttttttcactcatttaggacagaggagttgaaagaacatggagttaggggtcaggctgttggatttctagtttttccttcctaactgttgtgtggccatgggcaagttctgcctgtctttggttctttgtgtccctgcctatcaagagggaccagcaactcccacccctctttctcccctgggctactcacatgccagtgggtggtgtgagcaagctcttttacaggctgggaagcacttgggagtggcattgatggtgttgggctggcagtgatggttttggttgctgggaagggtgttcaggccttggtgccagattgactccaggggccatgcataccttgcagactgttccaagctggatattttcctgtggcccaggtataacctgccaggcaacgaggctgtagggttcagtctctaattctttggctggcagtcaagggctgggtggacgaaaggtttgtcaatgtggctgtaattacagctcttactttttggatattaagtgtagcttaatgtaataactatggtacaattgacccagcatgtagggctgtgtctagctacttggtaggctgaggacataaagatgcacagtcacattttactaaatacatatcagaaggaaccctggggccaggcttggtgtgctgagttttagctggcattgtccctccggaaggggccctgtgcaggccttccatcccattgtccagatcacgttccatgggctgggcctgggggtggtgcccagatctggtgctggcactcagggtgtgtgggccatctgtcttctcagtgccttgtgtgtcaaggggtgaatcagttccctgcctgccaccctacatgggaggagcttgggttcagcataagtaggttccatgatttgtaatgtcaccttatcatgaactgactcaaggccctgtcatttgactgagaaggaatgcagggcagaggaggtgtggctgtttgaacctgttggtgggattagcagagacagtgttgagttcttagtcttgagatctgttggctccacttggccctggttcaggaggaacatgcgtggaacccttgttctccccgaggcctgctcccagaccctatgatggctccatagtatccacaacatctcgatttcattgagcaagtgctgtgtgccaggccctccttacatgattatttccttcaaatcatcacaataacccaagaggaaggtgctgttcctagctccattttccagatgagtaaactgaggatcagagaattgaagagacttctacatagtcccctggccataaatgggggagccagaatgtgggccctgcctgtctgactgcagagtgggtaatcccaagctcaaggctgcctgcctggcagtcccctggctgaggggaggtgtgacccagggccacacacaggtctgaaggggttttgcctggtcgtgggaaggtagaagtggcagctgaggctgggagatcaaagatggccactaagatttccactctcttcacccccaaccccaggccctcacattattcggaacactcaatcttcaccatgttgagcctcgtgggaaagaccagggtcttatgggaggtaggtgggtcggggaggagggatgcagagatgggaggaagcagacattcatgccatggtgactgaatgtcagatctaagccaagcactgtgctagatgctggggccatagccgtgagcatgacagacaaggtcttgtgccctcctggggcttctattctggtgagatgcagacagcacacacacatataaacaaacacgaagattgtcaggggtgagaagcatcctgtagagcattaaacctgggtgatgtgatgggtggtcaggctggcttccccaaggaggtgacatctcagtggagatctgcatggcaaggagtcagctgtgagaagatcaggacagagcattacaaggagacaaagaagcaactgcaagagccctgggggtggaacaagcttggtgtgttcaaggagagaatggaccatgaaatccagctgggcgtggaatccagaagggagtggcacatggtgacattgatgagacaggcagggttcagatcctccagggctgtcctggccaatgtctggaagtttggatgtcatccaagtacaatgggatggcgatggcagtgacatgattagatttgtgtttaaaaagacccctttgttgaatgaacaatgaattgtagggagcaaaggtgaagacagagaggtcataggaggctattgtggagtctaggtgaaaatgatgatggtgtaggctcacgtgggacagtggggagggagagaagggatggatccaggtgtgttttggaggtaaagtcagtaggactttgatggatcgccactctatccatccaattgctcaagccaagagctattcctgacttccccctttctttcaccccaacagctgtttgctgagatggaggagaagaggaagtgcaggtttggggcagtgggcagtgaagatcagtctgatttgagaggcctattagacatgcaaatgctgatgtcaagttggttgtgctgagtctgagaggagaggcaggggttagagacagacctgttgcaacatggcatggcagtggcacaggactaggtgacacctaaagccacaggactagatgaaatggatggagagaggagacaagtgaagaggtctcagaggagtaagccctcaggcaatgcagaacttggatgtggaggaaccagtaggggagcctgcgaaggtacagccagggagctgtgcagtgtttcgggaggcaggagaaaggacgtgttcatgggaaagactgttgagagttggcttggacctcagtgagagccagtttggtggagtggtggagatgaggcctgattcgggagggtggagaagagatgtcagatctacacagttctcaaggggtttttgccaaaacaggaagcatggaaatagggtggcagcttgagagggatgtgggggtcaaggcaaggttttttaagattagggagaaatcacagcaaaactgtaggctgatccaggggacaggggaaatgtaatgatccaaagagagtggggacacggacaggagagatgactgagagggtgtgggaggtgggttagggtgtgcagagtcaggggccagcttgattaggaacagggatgccatcttcaggcctggtccctggagggaaggcagagaggagaggatttggtggaaggaccctaaggctcttagggtctctgcctaaatatctgtccccagaccagacctctctcctgatcctcctgcccatctgtctcctgacatctctggccaggtgcctgtgagcacacatgtccttttccacctgtgcaggtcatttgacccacttctactgtcttcactgattcagcccattcttccccagcctgcctcttgtacccttcctccaaggggccttcctaggttacttcaacccacagggctttctttctagctgaggtgctggagcctgtgggagggaggctgccttgtcacatcttttatgctaccattatgaagctctctgcagctggggagcatgctgtgagtttgtggagtcagagagaagttgggggcttaggctctggagtctcactgaccttggttcaagtccgaggtccttactaattgtgtgacctttgacagcttaaaaaaacaaaaacttctctgagcctcagcttcctcatctgtaaagtaggacaggatttatctctctggcttttggtggaggtttaatgagatcatgcatatccattggattggacacattagctattgagtgctactagctcagtacatctcatgggtctcaacgttatccaatgttattctgtcccttccatttcttcaatgggatcttagggagtcacgtgagttttccatgcctcagtgtcctcatgtgaaatatagggacaataatactctccttagagggctgctgaatttaatgagttgaggtgtggaaacagcacgtagtaggtatttaagaaacagcctgctgctgacaatgatgaaaatactagttactgcttacattcctgtttcccccacagaacgccgaacccctggaactgtggagccacctctgctctgtgtggcaaaggtgacctccctgtcctctctggttagcctcttcgcacatttacttctcgcagtttcccacggacccattcatctctggctgtaaggttacaaggctttggaaattaattttaaaaatcacactctctgaccctttaaacttcatttcaaatcccctcagtgccttaatgacgctcaggctatttcgggcccctgggagaagtgtggctgacagtggctttttaatttacaagacaacataggaacacacatgggcccaaatatgtatctgtataatgaagaataaaaagcataatcccctaagtgggctgtgttagtgagcatcaggtttaataggggattaggaggtggaattaaagttgcccagggggtacacagggagacttcaaacaccttttggaaaacaaattaacgtggtttgcaaaaaccgttttccaagggcggcagagggttttccttgggcttccctgctttcttttgaaatgtatttttaacacttgtataaacactttgggcccgtgacatggggcttcctgtgctcccttcgttagctggtgtctctgggagaagaattcggctcattatctgggtgttttgatctccatgactgccgctgctgctgcgcccggcccggggcgggccaccctttttctttcctgttgcctaatggtatggaaccagttcgtttgtggctcagcctgcttccacatcttcctgccaagcctggcctcccagaggggctctcagttttctagagaaccggagttcttgggcaggagcagtagtggcagctgggtggctggagtctggccctgtcttaggctcaactgagaaactggcaaaatcggcctttgtaccagcctccctgaccccttcacttatttccccttcccctctcttcaggtgcatctggagtggaatgtgaggcctctgtaggtactgagttccccatccctggaggtattcaagcaatgtcctggtggaggttttaagggcctctgtgagcagctgtggacctggatggtcattagagtttcttgtaaacctgagattctgtagtttacactttacaagtggaatctgagcagggccatgctggcccttgatagcaacaaggatccctgtgatagaagacgcagtgctgggctccaagcagaccttcaggaacccctgttctactgtccttgctggagacagaagagacacaggcttttctctttgggaggctccaggcttaggctcacccacagcatttcctttagagatttgatcctgcagagacttgggacaaaaactccaaattatgtctacccaagttcccttttaaagtccactttcttcctgtgtaaaaagggggcaataaataataacagctaatacctattaggcacttgtgtgtcagacacagcttgaagtacttaatcacttatttcataacttcttaggaaaaggtactgttttttcccccattttacagaggaggaaactgaggcccaaggaggtcagccaacttgctgaaggctacacagcaagtaagttgtgaataataacatctgccagttgctggggatctgctgagctcttcacaggaaggtggaggtgcccccttgaccacgctgggttctgctgcagtccagccctcctaagaggtagaaatgacattagtccctcccagccttgtccctcttcagctgcccagggctggcaggagccaagcagtgagagtggcatttctcatcccaaagacagcagagctcctgcggcctggccagccagtggcatctgggctgggctgatgggggttcacattctggacgtttcccttacctttgcaagtgggctggtggttggaggtgagctttgtgaggctgattcatgccgagttcacataaggccacatgtcccacatgctgtatctccctcctgccactgtcaggaaggtgcctgcaggtgcgtgaggccagaaggagggagcgtctctatcctaggaaggagttttttctgttattttcttgtctgtctagtccatgggtaagggcatgagtggtcctggtagctttgtcagccctgtaatcctgcttctcatgaagctgcatgtaaatcctgtccccctctcttcacccctgcccctcacctgccagctgtctgctctgctctcacaagggactctggtctcatgtcacagagctacagtcaccagggataggctgccaggagggaataggacatttctgctgggttcacagatctggcttcacaaaggaggtggaattcaggctgaaccttgaggcatgaaagaatttttgctagtagagaaggggctgtcattgtctgatcccatccttggaaagcactgtgctgaacttgcaacagctatgcttctatttcatgttcatgaaggcctgtgttgctgtctgcctgttataggtgagagaacagagcaagcaacttgcccaatgttccacagatagatctgaacccaggatggaagcaccctcatgttctctcccctctggcagcaggggggaagcatgagcttcccaaggaggcttgggaagacctggtgtgttggctgaacagctgggagggagagggtgggagagaggataacgggacttgagactgggattggtggtggtggagggggctagggtgatatgtgcccagaacatcaaagacctcatttagtggtgtgttggtaagcatttaacaaccagctgctcttcaggaaaaaaagtagaaaagtctctgatgtgaggcatttgccaatttccatggtgtaaatattcccaccatggctgatttcaagttatcagtttgatgtcactgaatactaggttcttgtgagctagcaggagctggctttggcactccactggcctcatctctcagattctggtgcttgcagtttatttgggaaacagcagagaggtaataggaggagagttgacattgtcaagcctttgtttgaaaatgcaactctcagggttatcgagtcttgggaaaaggggatggagaacatggccaattagaaggccactgctgactcttgggagcagtagggcttggggccaggcaggggtgggaagggtccttggaagagacgggccagatcccatcatattcagtgaagtgaaaatctttccctctgtccaggacctcaggaatctcttgctctaaacatgcatttctcagtgagtcttctcagaggcagtgcagcactccctcctcctttcccctctaaggtcaggttggccctagagcaattttacaggggagtgcttggcttccttttgtgcatccatccagtccagttatttaaaaccaatgacaatgacatacatttcccaagaaatgacctgggaatattcatttgggaaaaaataaattttcttggaaagaaacccagctggggaattgaggataaaaggctcatcagcctttgtgctcagctgtgacagaggcctgctgagcttcagggacatctatgggactggagagcatgcagtgggagcctcctgccctgatcctgtatggataagggggcaccaaggccagagtgtggccaggcagagatccaggctggcccagaaccagcaacccaggcttcctgggggaagatggttttagctggatgttggcgtatgggcaggacctggaagggcagggatctctgggggtctgagagtggcttcatggctgccatttgcctcttcgctctcagatccattcttgcccttcccctgcttggctctgtatcccaagggctggccttgcaaaccacaggtcccaggcttccttgaaaactgactctggccaagtttggccaatgagaggcactgacagatgggagggcaggcggaagagagaggaaagggtatgtctcctccaagctctggctttggtggtgtctctgcagcagttgtgtcttctctgtgtctctagccatcattcatcagcctctttctgtggcctcagctctcccagattgaggaggcccttaggtgaccttagttcctcctgggtggccctggtttctgggctctggaagcacctcttcctgctgctgttcctccagagggctctggtgttgctcatctctgtttgcctcactgctccctgcttgtctttgtagctcttgcaactttgtaactagttcacttcgttgatttatggggcatggactctggacttgttttcctgccgagatcctgctatcattcttgcctggcccttcctccctcatcctgccctgctctgccttgcccaggatggaggcccgctgacctctaggccaggtccccattctgtggcttcgtggaagcctgtatgttagtggaaagaaagggtgaggccagagttcagtcttgtgaagggaaacacttgcccagggttatgcaccaggcaccagaggtctcagctttgataggcctccaggccccaggtgtggctgcagaagggtttgggtttagcaacatgcctgtgaaggggtccctgagatccttcctcagaactccagggcttccaggaacaaagctgggaaaccaccagtctagtctcagcttctattttatgcatgtagaaactgaggccagagaggaacagggactttcccaaagtcacactggctccgagcagactggcagagcaggaactcaggctccagtcccctagcccagcgccttgaggctcagcctctggattctcggtagctttgggaagcacaggggcatggggcagataaaggtatgtggtcaggagaaggcacccagccctgctgacaggcccgcttgctgtcagcagaggcctcaactgaactagtgctgcctcggaccgccctcctcaggaatccctgcatccagatgcctgcttcagggttggcagagacccatccaatgcccaggtgcgcctagcatccagcctccaagtgcagggcatgagtgtggagacgtgccctagatggggcttgagagaaagccctgagcccactccagcagcaccctccaacacccttacagagaagggccaagttgcataagagctgtgtggctgcggctgtgctttgtacagaactgagagggctgcgtgcccatgggagagggatgactcagcattgctgttgctaagggaggccaagatggcgagccaaggggccagggcaggggcagcgtgtgcagagccctctgggagcaccccagtgtggagcagagagtgcccacaattccctcttcaggccagtggcctgctcgtgtacgcattgagtcttctcccacatcatgttgcccctgccccagctgataagctctcttcacagttctgcatgctcaccagctccaagcagcagccttgggtttgcacacatttgaagtctttggggcatggaggggtgtttcaggcagaaggtaaatctcaggcaaagcaaggatccaggatagtgtgccaatgggtagtcccattggagtgggagatggtatccccacaggagaaagtcccataaaagacctctagaaaggacaagtcattacctaatcacgcaaggccttcagcgactggcttgcccacacttgagtctgaaaatcaggggccattgaaggttttggagtaggtgagtgctggtgccagagatgtgctccaggaaggtggagagggagtgcacagggcatgtgagtggagctagaggccagcgtaggccaggcagggtggggccatgcagttactaacacagcatggaagagggctggctgaggactggccacagagggcagagtcagggttggtcagtctctctccctgggcctccagggtcagagggaggagctgcttccccactgcaggagggtgtggctcaggagcgtggagtggcagtgaagaacacctgtggaatggcaccatgggcccctcaggctgggtctcagtcatctcatctgctaattgggaataatatcatatacttcctaggaccattgggaaggttgaatgtctgtagaagccttaacacagctcccagttccagcaggtacttaggaactgcaggcagagcaggcccctgattcacagactagctgatgattcctctcaagggtccaagccaatacccagcctttcaagtcttcctccacacagtcttttccaaggcctcttcacaacttttctgtggccccattgggtcaaggtgggtgactgccagggcccttccccaccctcggggcaccttcaccttactgtgccatgacttcagtgagcaggaaccagcctgccctttttacccactggttaccgaggggtccaagtcagatttgccccacccatcccgcccagtctcctggcttggggagacagagggggagatttgctgtgaggtgggcaacctgaccagactgcatgcacttgccacttctatgtcccccctcctttaatgattgtcaggaagggttctcagagaaaggctttttagtgaggagatacgaaaagaaggtagcagttaaccaaaatgtgtttctgggaggagccctgggttctcttccatcaagagaggggctaggaggagtttgagaccagcctggccaacatggtgaaaccctgtctctactaaaaatacaaaaattagccaggcatggtggcacgtgcctgcagtcccagccactcaggaggctgaggcatgagaatagcttgaacccgggaggcagaagttgcagtgagccaagattgtgccactgcactccagcctggacaacagagcgagactctgcctcaagaaaaaaaaggcggggctagggccaggcacagtggctcacgccagtaatcccagcacttctggaggctgaggtgggcaggtggcttgagcccaggagttcaagaccagcctgggcaacacagagagacccccttctctacaaaaaattagctggacatggtagcatgcagctgtcgtcccagctactcaggaggctgaggtgggaggatcactttatcccaggaggctgaggctgcagtaagctgtgattgtgccgctgcactccagcctgcataacagcaagaccctgtctcaaaaaaaaaaaaaaaaaaaaaaaaaaaaaaaaaaaaaaaaggctggactaggttgtaggggagctcggctaaacccctcttcttgagaccccagactcctttctggggttcttgagctgaaactagggtcctgctgggaggcatcctgagggccactggcaacatggaagagcacggaagcttccctgagggcaggtgaggggcaggtgggcatggagccaggccttggggcccttggcagggcggctccgtccctgggaggtgagggctgctgctgctggctgctgtgccagcccagggtccgttctctgttgctgctgggtcccggctggcctgccgcctgcccacagcttgcttgggctgccaggcctttgtcttcgtgagttcctggcttcgcccctgatttgggtggtggatacagatgactgacacagagcaatgctttctggacacacagggcactccctcctcctcttggagaacggagggtgtgtgccaggacagaggctgtgcctggcatgtgggagagagtgagccacaggagggtaagggctagtcctcaggccacatggagagcagcatgagctgtttttttctagattctgtaagaactcttcctgctgagtgaaaaactctctcctactgagaaagaaaaggctggggagagttgtctcctccctggatagttcctgcactgtcctcagaagctggggagatggaagatgggagaaggagagttggttttgcttaagactggggagctgagtcttaggagaatccaccaaatcccatggttttgctgaggacctgctggctggcaggagattggacaagatgaccctttggtcaactgaacctggcatctgcctccagggcagctgatcttggcaccatccccccccccaccaggacaggtgccacttccggataaacatttgggcaggatgccgaggctggccccatttcagagcatgacctctgccggcatccctccaggtgcgaggctcgggacttagaagttgtcatgaaacagaatcatggcactcttgtccacactggcaggggaaataaaactcaaactgaagagagtggatgtaatgttctcaagcgtaagtttttcttccataaatttttaattaaacctttggcacccattatgccttcatccctggaaagctctggcagatgccagaattgtagaaccattttcaacatgtgtgaatccagtgagacgattcacagctctgtggggcacagctgtggtcggaacttgaacagtttgtggtggcttaccaattgcattttcggatagtaagattgtgcctggtctgtgtgctggaatttggcacgtcagtgctttgctgcactgctcagagggacctggtgacaagtgtccaggccctggaataggtgaagacatcagtggcttggagccctgtttttcaattctcaaaagtctgtgttttcattttgataaaaatctgttaaaattcatacaatctcatcaagattatctgagtactcacctcgtaacttggatttacggcaccactgaagagaccctttacatgtcttcgtaacggtgtttgttcgattgctcgcgtttgcaccgagggaaggccgaacactgctgaggtccacggtacaaaggaagttcagtttgcttgcatttgtttaggtaaagtgaaggtggaacaaagctcatgccagtgggcaggacggaggccaggcacccattagctggtgaccagggtcacgttcatatggcaaacagattctggcttgccatgtggcaacttgctggagttcattggcagtaaatgtgctgggaactatgtgaggaagagattgctgggattagaattaggaagaaatgaactaaatgtctatttaaggcagattttagtagcaccatgggctaatgtggcttcaagtgaacaggacagctttatagagttatcaggtaatccctcattaaaactgatgcctcagggttgtgtgcagggttctggtgttgtatcaaggctggttaacccgaacttacaaacaaagccttaaagttattaatgctactttgtctgtttgcatacatctgtttgcaggcagtcactctctgcgttggtattaattaaattgaaatacagaaacagaactggcccgaggccacatctttctactattaaacccattcttggcaatttaactttagcaaaacacatcatctaattttattggtagttttgtttgtattttatttccaaatttgctttggcttttatgtgttcaagggtgataaatacaaggagtggattgcactaatttttgtttctatatacatatccattcatttacccgggatatattgcctgagctcctgctccgtgacaggcatgttctaggcagggaggatgcagcagtgagtaaagatgaagaaagctctgccctcgtagagtctaccacctagaggcggaaatagcccccaaaacaaaaagaaccctgaacaaaccaaaaccccacaaacaaattagtagatatacaacaaaatattcggtggagatgaaggaaaagttagctgggtaagaagatggagcaaaagaggcattccccttaggcgaggtggtctgggtgggcctgtctgaagaggtgacatttactcagagacctgtgtgaggcaagggagtggagcacaccagttggggaagcgggttttagcttaggaagcaggaagtgcaaagacccctgagacgggcatgtgatcagtgcatgttgtatgtttcaattatgctgagaatgaagattttatattcgtcagcacatgggggtttgggagcctgcagcaagaggtggggtagctagcctagtgtgggggcctaggaggaccccagatccagacagaggagaagcctggggggcagaaggcttccctcaggcttgtgagctgacaggtcggcatagcaccttggctgagggagggcagagggaggagccggggggcacccctccccccacctgcagcctgttccccccacaacatgggcgcatagagcggtggttctcaaccttgagcagaatcacctagagggcttgttaaaacacagactgctgagctccaccccaggatttctgattcaggagacctggggtggggcatgagaatgcagttcaccaaggttcccagatgatgctgatgttgctggtccagggaccacaccttgagagcactgatcgagagcaaacgcagaccgtgccaggatttgccaagaatgactgtggagagaaagtgaggcacaaagccttcactaaaggtgcccccaggggtttgactaggtctgcagtgtcccttgctgaacaccactgcgtgtatgtgtgacaggtgttgcccatgcatctcagtccatggtcactactgtcaggggcctgactacataggtcagggaagaggacccctgtgggaggggaacattgaacagttgatcgtgatgcaaaggaaagatattttcttttggtaaaaagtgaagtgggagcccttataaaccctgatcagcccaaagttggaaagaataatgttattatcatgaagctcgggatggatggggttggggcgcagctctggcacagggtcccgggcagtcggcactcagtaaatatggactgacactgagaagtggtggctctgatgttaccacctagagaatgcatttgtgccctgtgaatctggggtccagcggctcttctgtcctgccccttctctctctctctctctctctctctcgtcctctgactccacaggctttagccttgtctcctagccggggcatgtgtgaggtcctttgcaagtgactggggactctggaaacatgaggtggtgatatccaggggtgaactcctgacacgtggcttgattttcccaagtcaagaccctctgcttttcctaggggtctaccttgggtgtgggtttgagcattgcgggaggaagaaggagagggaggcagtgggctgtgctctgcctggaagcatgcaggaagctgatgggaaacagctgagccaatagctctgcacacacagaaaataaatcctggcttccgaagaagctgcagaaaattgattttttgcagcttcagtggtcatcttgaaggatttgggggatggaaatggggcccatttctcatctctgttctgtgctgctgggtcaggtgttcctcaggcccgggtcagtatccctcgctcctccttgtctccccaccactctgtgtagagaggaaggggccgagggctggtcttcctcagcttacccctagtgtccagctgctttctgcctgttgcctgccctttgggcccgctgccatggatgggagaggtgcgcatgttcgtgcagccaagctgggattatggcatttgcacagggatgtagctgtgggtctgtgtgtctgggttgttgggggacaggctggggtgggtgccctttagagcttggcctctgcatgactgcctagtccctcagtgaatgctgcaattaattggctactagggagacattagccagctaggtaggtctgctgtaaccatccccctgtgtctgagcaggcttgctaggggccagggccgtgtctgggaacaagggctggccctctggcatgtttcccctacatgtgtggagagtggacttatcccaggcccaagggatctgaagatccccacagccagggaggaagctgcagctccagatggatggttcccggaactcctgttggctttggatgatttcatggaaaacttggccagggtgctgtgaggcagagctgtgacctctcagctcagcagccaacacaaggagttccttcaccttgtagagacatgcagtgtgggccgccacaaccctcccctggctctgtgtcagccctgccctgtggagccagctgggtctctctggtccccagcctgtgcctggctgtcaggagggatgcattctgtcctgctgggctgatgtgaaaccccatgagctcaggccaaaagagccccactctttgtccacatggggaagtagggattagagacaggagtctggactgctgtggtcgcttttgttgaggcttggaatttggaaaggaatcgtctttcctggtggtcctcgctgatgtggcataccagtgtctctttccccaagtagcgctgccttgcatcgctcgaatgtttccatcttgcttgacttattggaaggagccacaaagtgaacaccctgccaaaaaagatcaagttcatcgggggttttgatgctgaaatccctgaaaagtggcaagcgtttctttttccccgtcttgtttatagtggcagcttctgttgcttaacacctggtggccctggtgcttatgcttggggtcacaatggggatgtgaggagggagaaggatggaagaaaaggagagcattggacagttgatcgtgatggaaaggaaagatattttcttttggtaaaaggtgaaatggg

SEQ ID NO: 578 - DNA, 20001 bp, Homo sapiens
agacaagtcatctaacttcttaaatccttaatttcttcccctggaaaatggagctaataataatgactaccttaaattacctctgtctgggagtatgagtttaaaaagcaacaaaataagaaaatggatgttgaagcattttcaaagcataaaacaaataatcattagtatactattgttgtcattatgccattgttattactgagaatcagaccaaaagatcacttttggctctatagggtaacagagaggtgagagaacccatctcagttttctcctccaatttgaattcaactaaaggttgttggaagaaagcaggtatcatagtttcaaaactgtgagacctctcacgaggcaattcccagcctcttatttgcagctatagtgcaccaaattataatgaattacatgcacacacgttcactttacataaacccaggtcacttctaagcattttcaggaataaaaatacattttaattgcttgtcctgggcatatctttaaaaggcctttgcaaatggtattaggaattattttggtgggaagtaacagaaaccagctctacttgcctaaacttccatatgaggcatttattttcaagataagcagggtcttacggatctcatgagctgggctgagttgcctggccatcaggaaaggctgatgcaaaggcagtcagaaccctcagaactcctcctccaccccgcttctctgtgtggtgtgctcacattgttcctgactctttctcatcagatcagcttcctcttcccctgaacatagcaggcaaaatataattatatgtgactgtacccaacttgacatgtttgtgcccagtgcccgagataaatggaatctagctctttgccccaattccacacccccagagatgggacttagattggcctaagttgtattaagcacctgttgagatttaggaggacccaataacacccaaatatcctctttccaacccagattttaaagcatttgagaaaataatagagagatggagaagtaccctatcaactgtattacaaataaaggtagtttaaatgtgctgaaacagtgggattccaattgggggcaggagcctttacccagtggtaggaaactggcacagcaaatgctccctggaagcagagagcacccagaagaggcaagagggatggcctgaaccaagcaaacccatgtattcatctggaactcatcaatcagatgacttactcctcctctgttggaggaaggagtgaaggaggctggtggtattgtagaggcagggcttcctctgcctggatgagtttcaggcctgagaggacgtgttctcccctcgtacagtgcttactcctcatctactcaactgtgtctgtgggcatgggatagagtcatggggacagtcatggttcttttggacagcaggacaattaagggaataattgtgaaccaagtgtgtacttcaaaaggtgtgtactacagctatttctccttttagataaatagagaatccctggagggttatgattgggccttgagttcaatgctgtcagaaacatggcaggagagaagttgagaccactgcactactcttcaaataaggggactcttcattcaatctctgctcttattgtggcaggagaggtttcctgtccccttcaccctctctggcctttccatttttcagccttacaagaaggagttcttgttttgttttgatctagcctagcatgtgctaaagttaagcagtttggtgcagtcagcattggggtttgggtggggtatttatatcttgtagttgttccattatgaacaactgcaaggcacaagctgattctaaggaggcttctgttctactaagacacatagcagaaatatgattgttgacattaaccaagctttatggcttgcagcttcacccccctccaggagagaatgactttactatctagaattcaagttagctttgtcaaagatcagatagttgtaggtttatagccttatctctgggttctgtattctgtttcattggtctatgtgtctgtttttgtaccagtaccatgctgtttgggttattgtagccttgtagtatagtttgaaatcaggtagtgtgatgcctccagctttgctcttttgcttaggattatcttggctatttgggcttttttttggtttcatataaattttaaagtagttttttctagttctgtgaagaatctcaatggtagtttaataggaatagcactgaatatttaaattgctttggacagtgtggccattttaatgatattgattcttcctatccatgagcatgaatttctttatctatttgtttgtgtcatctctgatttctttgagcagtgttttgtagttatcaatgtagagatctttcacctccctagttagttgtattcctacgtattttattctttttgtggcaattgtgaatgggattgtgttccagatttggctcttggcttgactgttgttgtacaggaatgctaatgatttttgtacttggattatggatcctgagacttcgctggagtcatcagattaaggagcttttagaccaatgctatgtggttttctagatatagaatcatgtcatctgcaaatagcgatagtttgacttcctctcttcatatttagatgccgttgtttttctctcttgcctgattactctggccaggatttccaatagtatgttgaagaggagtggtgagagaaggcatccttgtcttgtgctagttttcaaggagaatgcttccagcttttttcaattcagtatgatgttggctgtgggtttgtcatagatggctcttagtattttgcagctggttccttcaatacctagttcttgagggtttttaacatgaaggcatactgaattttatcaaaagccttttcttctactgagataatcatgtggtttttgtccttagctctgcttatatgatgaatcacatttattgacttgcatatgttgaaccaaccttacatcccatgggtaaagcctacttgatcatggtggataaactttttgatgtgctgttggattcagtttgcaagtattttgttgagaatttttgcattgacgttcttcaaggatattggcctgaagtttactttttctgttgtgtttctgccaggttttggtatcaggctgatgctggcctcatagaatgagctgggaaggagtcccatctcgtcaatatttttcaaatagtttcagcaggaatggtaccagctcttctttgtgcatctggtagaattcagctgtgaattggtctggtgctgggcctttgttggtaggctatttattgctcattcaatttgggagcttgtttttggtctgttcagggattcaatttcttcctggttcagtcttggggggatgtacgttttgaggaatttatctgttttttctgaattttctagtttgtgtgcattgaagctatggatctgatggttatttgcatttctgtggggtcagtggtaatatccactttgtaatttctaattgattttatttggatcttctttcttttcttctttactagtctagctagcatagtggtctatctattttattaattttttgaaaaaaccaagtcctggattcattgatctagttacgcttttattatcctaaaggatcttacctggttttgtaacaaattgagcattactgtctcagcattacttactttctttgctactccttatcgaatcacaatttttcatatcatctttggaactagctttgatatccatctgcttctctcatgaatacataaaatcaaatcttaacaagtgctcactgtttgcattaaaattatattttaatgggtgggtaataatgactcagtttcctgctgggctctaatttctcactcttggcttccttttcaaatactttgctaattttttcataaagcagattctgggctccttccccagaaattctgattcagtgagctcttggagaataagtatttttgaatgttcttcctgtgattctaatgcattactaagtttgactcactgccttgattaatattaataatcatattaatactaacaaatattaaatttattatcttagataaaattaataatagtagctattgatcatttccttattaccagcccctgtgctatgtgctttatatacattgtgccttttattcttatctaatctctatccaaaccctagacaaaaagaggcggcttggaaagctccatccattttttaagggtaccagacaaaatagaatacaaaaagagtgctttataccgcaaaaataagaatagctgacattaatcatgctgtttctttttgccaagttcactgataaggaatttacacttgggtacccctccctttgccccagactgaacttcaattatttttgcatgattacattcattcattaaatcatcctaatagcatttgtcagccttctaccattttctagctactgtcctaaggataccaggcaacactgcaccttatctttaagaagcttatcagcttacaaagccagggaatcactttttataaaaaaaaatcaggccctggccaatttgcatacttttctacctgtattccaacacttgctcaggattatgatctcccaaattcatggcctaggacgagaatcattgcagagagatctgtccagacctgattacctctaatgttgcagaactttctccttagttcagctaaaaccgggctcttgtcacacagccaggaaggattaggctcatggacacatggaagggtgagaaaaatggaatttagtgggtgaaaaggaaaaaggaaaaataactctcagcaaagtgagagagagtccttctagcaggtttcccacctcacagattgaatcccaggtcaccatacagggacaggagaggccaggctcctcctcactgaaacactgtgcacttcccgaggctctaccccatcctcccagtgtgcagatggggattagtcaaaaagaatccgctgggaaatggcaggcttcatctaggaccacagtccagcttttcagccttgctattttaggcttgaaggtggggtttcaccggggcacccttggctgccttctgtctctatcactagatcttttgggccctttgttaaaaggcaattattttaggtactacctatctccacaaactctcaagcagagtttggcaggtattgaaaacgttcagactaaatcttttggttggctaagaaatagttatacagtacagagcctgtagattgcaagggttgatgggtagaatctgaagatctttgaactgggtaggaaaaattatatttttattttcattaacctctaactcaaatgaatcattccttcaattatgcatgtaggtaataaaacaatattaaccacattcatgactatgttatcaatacaaatcacaaatgttgttatattatgttatttattatagctatctctaaaaatcatatttatcaccactttgatatcataatgtttacttggcttgcctctagatcttgttatttcatgcatgagtaaagaagcgtatatattattatgtcacaagtctttttttaaaaatattttgaggctgggtgttgtggctcatgcctgtaatccctggactttgggagactgaggcagacagatcacttgaagccaaaagttggagaccagtctggccaacacggtgaaaccccatcatctactgaaaaaacaaaaaaccaagaattagctgggcatggtggtctgtgtctgtaatccaagctatttgggaggctgaggcacgagaatcgcttgagcccaggaggcggaggctgcagtgagccaagatcacactactgcactccagcctgagtgactgactgagactctgactccaaaaaaaaaaaaaaatgttttttgataactctattttcatataattggcttcctttgtaatcctgtatatttataggtattttaaaacattctaagaagggaattgttaggctccaccacacacatacacattaagaatccctaatatcactttgttgatgctctgcaacatagagaaatagagacacttgacattcacaaaagagattccccactaatgccatgattatctaaattcacaaatgccaccacagtgcagcaggtatgaatctcaatacacaacttaggtgtgtaagaagtttaattttctgtaacttaattcctattatgagcttctttacatcaagaggcaaaaacctagtatcattcaattcagggtgcattcctcctttagagggtggcatttctagagagggtagtgtagtacccaggcattgtgggacaggctttatcaaccgctattctcctctgctttgatagcctcggccctacctgacctcggtccctggtaccacaggtggttgctggctggttcttggtcctggcccagggctcctttggagctgtgtctatctgattgttggacccagcccggtgtgttgggggtgccctgctcttctctgcctatgcatgcctgtcctaggtccatcttcctggaactatcacctagctatttctactctggggcttcaccttccagggcataacgagaagctgggcacagctctttttttcactcagatccctcaaacctatctgaaattttgtcacccccactccaagaaattcatccatctgggcatggattggcagaggagagagagtttaaagagccacttttttggatataaactggggtcagagcttcctcgcttccctgcacctccttacctcctcttaatttgagcaaactttccagtctaggaggctaggaagatttgcttctaccttctctacgcctggctccccctcaaatcctatgacttgaaatgcaaaggcaatggtttttaaagttcaaaatcttttactctgtgtcttgtcctccctggagaattcaatctctctccccttaggcaaatttagggaaaggtgaaggggttaaaaggaaataccaaggaagacacaccaattcgtgcaaaatatttttccaccacaaaaacatacaaattcacacaccaaatacatagaacatagttaaaggaattaatctacccattttcactctcagtgagaaattccacaagaacatagaaactaataaaggtgtaatgagatgtggatgttgtcttggagaggctcactgattaacaaaattatttacttccatgcatcacactcttatgttatgggagtcaaaagagagactccataaagtacaaattgttccctgttatcttgtaatactttcaacagttcctatctaagccccaaggttgtaggagggcttcttgttctatgcttctctaacaccctgggtaaacatcaatctcaactcaaaaacgtacacagagtaagacagcaaggattgagcaatgactatcaagattttgctgccaagcagagtctaagctctggagtgtatggtaaatattttttaaatgtctgtatattatgatgttttgacatcttaagcctttctggctggggaaagaatgcatgtctttgatatgcaaagtaaccaatctagagccaagcctcctttgtctggcctgtatatcacaggaggtaatatttctctgccttaatcattccagagccaagtgtcaggaaactcagaaccacccctaaagcccaaagctcaccaaagttattccaactggctaaacctaaactgttcactctgctctgccttgcctttcccacggaaatgccaataaaggcaatggcctaaacctttccctggctcctgccgtctgcctcctgaccattcctcctgaccacggtgtgtttcccatgtggctcctgcagggcgtgcctcttgtctctaagacctgtacttacaatatatatttttttctttgagcctcttctgtgtctcctgttgtggccacatctgactgattatcacataaaataatacgcaacatgggagaggaattctgaagggggaaaagtgaagtgggtattttacaacaaaagacgacaaactgcatctatggagaggaaaaaaagcaaagcctctctgttgctgcctagcttcttctacctgggcttgtgggctgggttggcacggagctggctgcagaggcacagcatctatctcatgaccagagcatctagctgcccctgttgcacacatgaggggtcatgttgagattatggcttccagtcactcctgcaccttctgcaggctagggagccaggtcagcggaagccaccactttccagtcattaccagttaatctttcaacctcttgtgactaagctcatagagggcagaaaccatactttactcatccttgtaacccatcaccctgcacaggaactagcacacagaaaatgctcagcaacactcaacaggctaggcaaggaagctcatgcctgtaatcccagcactttgggaggccgaggctggtggatcacttgaagtcaggagttcaagaccagcctggccaacatggtgaaaccctgtctctactaaaaatacaaaaattagccagacgaggtggtgggcacctgtagtcccagctacttgagagactgaggcaggagaattgcttgaacccaggaggcagagatggcagtgagctgagatcacgccactgcactccagcctggcaacagaatgagactctgtcccccacccgaaaaaaaaaaaagaccgaaccccccaatgtttagtgagcactttcttggtgtgaagttctgggcttacacttgaaatgcactatcccatttcatcctcacaaagagtccctgaggtgcatgcagcatcacatagaggacatgcacatcgcctagggtcacacacctggtaagtgacagagccaatatttcaatcaggagtggctgactcctgaggctcagctcctaaacacctgcaatgctgaatagaaagcaccgagaagcattctacaacttcctcgagcatcaggagactgctctttagaagtccagggcagctagatctggagttgatgtggactgtaggacctgtgtttccatggttgcaggtctgccaagatttctgagtaagataaagcacagagatgagagcctgagcttttttgtcaaatgataaatcctgagatagttacatttgtattcactagcctcttttccaaaaggttcaaagagagctcgatgtccagcagcaagaaaacacacacataaagcaacaacagctgaatagatcaggcgccccgagttcactacattttggggggatcatccctcaggttcaagctttctcttctgtaaaatgaggagattgtgattctcactgtgattctccatctgtggactgacaacaaataatattttaaaacacaatttccaggtttccgcgctgcagcgtttttatttcagcaggttttcggcaaagcctaggagtttgtatttttaaagctcattgagtgattctaatgctcagcctagtttgggaaccactggtctgggtgatctccttggttgcttcctgactggattacccattttggggattaaatccccgagttctatcagatgagtacaggggtactatagaatgtttaagaaatgttaaactgagtctggggatggggaccagaaaaagtatctggagaatgtgacaatactaatttacctgatgaacgataagaaagacagtgcctttttataatgaacatcttttgattttgcaggcccagcattcgttttcctactgttgaaaaaaaatgtcttgatattcctctgagatatcactccattcccatctcttaatccctgtgttttgagtgggtttgaagccatggtgctggtgacctcaagggctatctctgcttggctgcccagtgtaggcatgggacccaagctaggccaataggactcaaacccagagtttttgatggcttggttgtaaagctaggactttttaatcttggagctgctggcagccctcttccgtcattgcagggaagaagcctatgtacaatagggaaaaatgaggccaacacatagaacacagacagtgtaaatcaacctctaaaagcacaatctgtcaggttttaaatagtgatgcattttattacacctagattgaattttgtcagtgaccgataccatgtacatatttaacagaaggctgccagaatatgataaggtatttgtaatgtcaaagaagaaaaagaagactaatatcttttagaataagcaagaaagtcctgtaaatcaagaagaaaaagattgcaaatgagtacatgatctgaatagaaaatttacagaaaaggaaactccaaaagttaacaaacccagaaatgagctgctcaaaatcatgatgatcaagaaaagttcaaattaaaacaattaaatattactttatacccattaaactggcagaaattaggaagctggatatcgccaaaggttggagggaatgtggaaatacaggaccctccatgtattgctggtgtgactgtgcaccactgtagcttttttgcaaggaactaggcccaaattggtcaaattagctctacataagccacaaacccagtaacctaccagtgctgttgcaggttctacataccagtggatttctctcaggttcacaaaagggcatgtgtaaggttcatagaaatattgtctgtggtagcagggagctagaggtacccatcactaggagaaggagtgaggaaaatgtggtagatccacaccattgattattatgtagcagtcataatcaagaaaaaatatattatacaaacaaagtgagaaaaggagaaaacagaataaggtctatagccaagtaccacttgcacaaattaaaaatacatgtacacaaaacaatttatattttgaaaagacatatccaataaaagtctatacatattaaaaatattaaaatggatgcccccaaaggatccttagttctatgggtgttaaaaaaaaaaaaaaagaaatcaaacaaatattggacaagtgcaataatgggaagacaaaataaaaaacccaggtgctaagagaaagaataataagagaaatttactttgcacaggttggtcaggaggggcttctctgagatctctggtatttcagcttcaacgtgaccgtggactagcatctgagtgaatagttctgggaaagcagctgcgtagaagaaaagccaagagaaaagcttggaggagggtaagagttggataattagggaactaaaagaagtcagaggatggtgacccaagaaggcaaagtctctcttcttgagagtttctgcgttgggggatggtgtgggtgaagctgggaaatcaaaatcatcacaaacagtgtacaggtttggagctgtgggaggactttttagcacaagcaggcagcagactttcccctgatagcactgtgttaatactacataattagcctgagctgtaaaatccattctctttagtctgcacagtcattacatggaggaaggaagacacttttcaggtaaacctcctttcagtattgcagcaaccagagtgcatttggaagaaataagtctgtgattgtaatgggaggtctccatgtggaattaacacaaaacctgcctgtgaggtactgctttgaactcttcactagtccttagtctgaagtcatggaggctgtggctgcgtggtatatgggtaagaactttgggatctgaaggccttgtcctattcatggtgtcaacctctgtctggtgcctgatattctagtcagtagatgcacaattatatctatgggatggatataaataaatattttacttactttaaaaacagaagtttgaatgaaaaggtcatgatacagtatgactggttacacccctgctatcacacacacatacacacacacacacacgccaaagccataaagaaaagactagaagtaagtggaggaaacatacagaaatgttgacagtgattttgtatatatattatatggaggatctatgggaaaacttaacttatattttaaaattttgaatattccatattttctagtagattatgcatataatctaatatagatttctgtaatttttaattttctgttttttgatgtgattttctataacataatttttttaatagaaataaataatttagtataggaagaaaaaatgttgttaaaaataccctgtctcctcctcttaggggatgaaccatattcacatatttttgatggctaatggtcatacatatatatgtaagattagatagatagataataaaaaagaaagaaaggagaaagaaagaaagagagagagaaagaaagaaaggaaggaggaaagaaagaaaggaaggaggaaagaaagaaaaagaaaaagaaagaaagagagaaagaaagaaagaaagaaagaaagaaagaaagaaagaaagaaagaaagaaagaaagaaagagagagagaaagagagaaagaaaagaaaagaaatccggtatttggatatgcaaggatagacctgaagcatagtctaagggggagctgaaagctgtaatttttgtgcctgagtaaacaacaagaaatgtgggtctgcacctgcatctggagagatggagagcctaggagacagatgggcctgagcaaagtaatgacaggcagaatccaagaaaacatggccatggagaaatttcccatgatggggttgctgtaaattattgagaatagcaatgtctggctttccgtgttaatttctggcaaggaaacatcttcttatgggccaggccatatgcttggagctggggttacaacgttaaaaagagagacaagatctctgttttccaggattttgtgttctcgggagggggagaataataatagtaatatttataatatttataatatgtatatagcattaaatatgcaccaagcactgttctcagtgctttatatgtattaactcctttaatcctcacaacaacctcacaacaatgagctcttcatttcacagatgcaaaactaaagcacaaaaaaaattaactagcctaagaccctttagctagtaaatggtgaggttgagattagaactcatgtagtctgcctctaggattagtaaataaatgtagttataggctgtagtgaatggcaggaaaggtatttgccgagtattttgttggcaaataactaggcaggatccacttttgaaagattggtcctagaagccctttaaagtggcatttaaagggaaacctaaatgatgaaaatgagacatgtctaagctgaggtgaatacttttctattatccccatacacagcaagttgactagctttggggttaatggggctttggaaaatgaaggaagaaggtggtggcaaaatggttctcaaaaagggtgaccaaaggagctaaggcagggggtggagatgacactgaccaggactagatataacacatgctcaattttctccaaaacacagtaggagaaaatgattctcaaatcagaagacccaggatggtatttacacggacaatacagaaaaaggcaaaccaggcagtagacactagggttacacatcagagacaggagctgactgcaaaagggaagttgtaatctcttcctctccaccctcttcaaagtaccttttgcataatatccttaaggccgtttcctaagaggcattattacaagatggcatgatataaagtgctaccaaattaaccacgtttcacagtgttccaaatctatgcccacaatatacaacgagattttttaaaagcaagaaaatgagcctatttttaacagagggatatgaatggtaatgctgcccattcatgaatgaccattgctaagtggaaaattattctaacatattttattattcaaaaatcatcaggactaaatagctggtaagatgaagctttggctgtccaaataagactcattccaaactattgccttaaactttggtactgctgaaaagacttttggtagatttgatatgtttgcagatgcatctcctttggtgccatccctgctgcttctgaagagcccctacacttggtgagcaaaacctgttgaaaatttctgctgattcctgccactaggaagattttcttagagagccaaagggctttccctcatgtgctgcagagatcttcatgcctcttctgccattccttctgccctccctttgaacattcacagtttcttggtggcctggattagacgtaccactgagactatatgctttcagttaaaaaatattttctttaatctttgcagtaattcattttgctataaaacaaattaccccaaactcagtggcttaacaaaacccaaccatctatctcagagtttttgtaggtcaggaatttggaagtggcccagctgagtggtactggtgcagggtctttcagcagattgcattcaagatgttggctggggctgcagttatctgaaagcttgactgtggctggagggtcaacagctaaggtagctcactcacatggctccttatcatgtgggcctctctacagggcttcttgagtatcctcatgagcaatccctgagagagtaaggcagaagccataatgtcttttaggatctagcctcagaagtcacacaatttccataatatcttagtggttatacaggtcagcccttgttaatgtagaaggagactaccaagggcacttagaatcatggggataatcttggaggctaactaccacaccagtgaagggtatgtactcagcctctgatttaaacatatggaagcatgtagaaatcaaactgaactgacctgcttaaaaagatagtcagctagcacactcctttctatatggtgatataattaattcactcatatttatttggggataaattatctattttgaagattatcaaagtcgttatcaagatgattatgattaatcttatttttatttataatcccacttattgcattctactaggtgtcaattatagggctaggcactttacccacatttaatcttcacaataatcctgtgaggttggtattaccagctcctctttacggataaggaaatagatgaagagtctccagtttacaaataatctaaaagaccattgagtgtaaacgcctcacagaagggaacctgtagcttggagagtttaagagactcttctgcagtccatagtgaatgaatgactgagttggcaccaaagccctggccttctaagtctgggaaaagttctctttcaattacatgaagcagctttcttgtgatattttctcctaaccaaaaagctagaactctgataagacatctaatctctgtgagtctgttaaaatgggtataacaatagaacttataaagtgctgtgaggatttcatgagcaaatgaatgtaaagtgccaagtgcagtgcctgccacacatcaagcactcatcatatgatagctcttattcctgtcattgtcagtatcattactgatttacgaacaggaaaactaatctaagccatcattcagcaccttgatggtggggatcatgcattaaagtcagcgctgtgctggactccacatcacccttcctaatcaaatcaatctgctgagctggcataacatattatgaactagccagtctcttctttactctagtaccaggggcacacacctctcacttaaatccagccaggggcacgtgacccttactttggctaaaagctggatttaagatgtttccagttggcgtgcatttttatattttaatagttatgtatttatcttaataagtattagaaaaataaaactagtagataaaaccactgatttaattgataatcttcccttggggaggctaaaatggatggatttatggaagaatattaagtaaataaataaatggtggcatgcaattacaataagaattgtaaagatgaaatgtaaattaagttttggaagcactgatttaacatatgttgaaaataatgatagagatttgacagttcataatagctttgtttattgttattattctttttattttgccagtgtactctcttctgaggtagctcagcctgtgttctttttacacataccactccatgcctctcttcttgttctaaccttgccttagaaattattttccactctctttacttagataattcctctgatcctttaaactttggattaggcatggtctcatttgagaagaaggaatctccattgccctttcaatccaggctcccaaagcatcgtctttatacctctatccctgcatttagcactttgtacagaaattaaataattttatgcctctctcccctacttttctggagccctatttgtcttcacatccccagcaccgaacaccgtgctggcatagggaagacattcagttaatggttacctgaaatgagctattaccacagactgaaaaagaaatacaagcaatgttccttcttgctggtcccttaaaactcactgcttgtccaatgcacaggggcaatcatgaaagagctttgtaactattctgttttattcatgaacctagtggctattaaatatttctcagcttgtcaagtgtgggaaaggcaagagatgaatatggtgaagaaacagtagcattgttcaggctctagaatgcacaaacttctatttgctgtaactggtaacctggtttgaactggtaacttttaattagaacaaaaccttggggaaaaaaaaatccctcccacatgcaaatgcttccatctgtgatcctattaaacatttgctagttcagcaaaaacttgccaaactgccacattatctcttcttcttgataattaacatttgatccagcaatgaggaatggtggaacaaacacagactatgggactcattttaaacaaactgagtattaaataaaacaagcctgcaacttcattaaagtcctgaataacttgccagaaattgctttctcctctagtgtgatgaatcactagactaggcgatttccatcaggacaggaaagaaaagtgtattggaagagtgaagagatttagattctatctctaattttgcttttgggtaaggctttgggcaaggcagtgaacctacttagacattagtttctcctataaattaggggattgaactaggttatcctaggacttttctaggtctaaaaaactatctttagttcatttatacatataataaatatttattgagcatccactctgtggtaggcatggttctggtctttgcgggtagtcagtagcaagatagatgaggtctctgctctactgagactgggtgatgaagataagccttaagcaagtgattatgcatgattggacaaataattatttaagcgtggttgcactaagcatgttgaaaagggcagagtagcatgaccatacatggtcaggagacctagagtagccccagaggtcagagaatgcttccctgaggaagtgagatttgacagctactatctgaaagatgggtaggggtggcccagggcaagaacagggagaagactgatccaagtagaggaaagaaactgggtgtttgaagaactaagagtaaccagtgaggggctgggaagtcacatgagctgaagctggagaggccagctgtgcagccagtccatgcgggactttataggtcatggaaaatttaatctccttcagtggtaaaaggaagctgtcattaaaggtgatataattagaagtgaaaagattcacagtaactctgactaaggaaacttacttctctctgtccttatccccaaactataataggctctggttggcaagatcttaaattggattcttctggattcactattgcagaagaaatattgtaatctgaggcttctttagggttcttgagtaattctacatggcttccggacctctaacccttgcaaataatcatgtgcttattttgcacattactgcaatattccaggaaagaatatgctggtagaaccttaagcagaccttcactgatgggttcccacacaaatgctctaggcaggaaatagcacctttgtaagaaccatcatggacaatgttttgaaggaagtcagcatattttttgccttttgaactctataaagctcactttccccatttctcttcttctctttgtaaaagatctaatagcttccatttagaagttgaggtgaattaaagtcatgtgctctccttttttcaaggacactagcattctagatttaactcctattgcagatggaaaggctttgtactttattttaagactcttagaaatcagccagctggtgggaaagaaattgcggaagtttgggcagtgaaagggttgagttgaggatcttcacaagtgtgcctgtgtatattttgaccacatgtgtcacgctaaccatgaactatgtaggagccacttggaaattggttatagcaaaaattccctaataaatatcctgggaggtttatctattttttattctacctaaacaaaagtattggttttttcccccgcttttaaaactacaaccatttcagtggtatgcattgttgctattcttgatgcctgaccatatacaagtcaatccaattattggaccaaaacctttctctaggaccgatttggagttcacaatcaatatagtaatgcaccatatttgccacttatacttggttactttgcctatctgatttatagacaattgagctgccaacaaaaaagaaagaaggagaaaaataggtcacactaagtccaggccctttatttcatggaagagctttggagtatggaactggtttactaactgagactccagcaaaaaacccatgtgtctgatgacctgctttactatgaaggttagttagtcacttagcaatgaaacaggaaggtctgctggaggttgtggtagtaagaaggtgcatattcagataatgaagtgacagcagaggtacccaagtaactacgttctgctatctatggccaaactgcaatagtctttaaaagttatcagtatttaaaaaaaatggtgtagtatcatgtttaagaacatagattttggattccagtttgaccacttcatagctatgtgaccttggacaatattatttacctatctatgcttgagtttccttaattataaaataggcataataacacctaaggctgtggtgagtagggtaagtcttcagtgagccaaattttaagtggatgccacaaaatcatattttaacgtaatttaaaaacaacctcaaatttaatgcaaaaaaaaaccatgatgaacaaaatatcaaaaaggctttgtgtgtgaatgactgaaaatactgacctttaaatctcttggaattttaacaaaaggttgtagagtcacatacacagccttttctcactgccactgttgggtagccattttgaactttcagtatcttttgatttaaagagtctgagaatgttcacaattatccagtcttgcttatgccatattattgactcattttattttgtttgttttacttcccccactagaatttaatctctatgaaggcatggattttctaaaacatgttgaagctgaaatagttttagatttacagaaaagctgcaaaggtaatagagataattcccatatattcttcatccagcctcccgaatgttaacatcttataaaatcatggtacattgattaaaaccaagaaattgatcttcatagtattggcacaatagtatcgaatgaactatatatttcatgtagatttctccagtttttctattaacataatttttctgtttcaggatccaattcaggattcacattgcatttagtcattatggctctttaatctcccccaatttgtgacagtttcctctttctctttctgcttttcatgaccttgacacttttgaagaatactagtcagatatttaatcaaatgaccttcagttttggtttgtctgatattttctcgtgattagactaaggttatgaattttgggaaagaatatcagaagtgattaaagtacattaaaaaaat

SEQ ID NO: 579 - DNA, 55006 bp, Homo sapiens
aaatagatgaattaagtattctagagatgtaaactttatgattaactgtatttatattacgtggaatagagcgaggaaaaactggaaagaaaagaagaaaaaaccccagagaagaaaaatactcaaccacctttaagagaatcatatgcaggagcaatttctcagtaagcataaaaattcattctcattattgaaaattcaacggaaaattaggtcttgataataaaagaaaaaaagaaaaagatgtagaatattcatatagtgcccacacatatcctaaaactactgagacagcttacagttcttgaacatataccaggcaacatttcctgataaatatttaccataaatttttgacattaatggttacctgacagattttgctgaagcaataggaaaattattagacaagttaacaaatggtacccattcacaatgaaagaaattatgacagaatcaacatcttcaactcctcaatgttttatataaatctttctttattgcttggtttaaattgtgctcaagagatgtaatataaaatataagattatcaaggagagttatattattcacactgtgaatattatataatgcactgtgtattacatttaacacactgtgaataaagtacctacttaaaaaaacatatattttaattaaattaaggtttttttcaaggtggagtagacagcagaaacagtaatatttgaggaaggattagtttatttggtccaccaactgtttccaaaaaaataagagtaaaaacaactataacgaaacaaggtcctcatggaatgcaaatgatcaagaaaatggctttgctacattttaaaatgcagtgtaacaagatggctaagattgagagatgtgaaggcagtcatttgctagctatgtgaccttgaacaaatcatttaacctctctgggcctcagtttcccctttttaaataggctaatagtggctgtctcagtttttataagagaactggttaacttgaagtgcattaacacaatacctgcacaagttaaaaactcaatacaaggtagtgccctggtttggatgtttgtcctccccaaaccccatgttgacatttgatccccagtgtggctctgttgggagtttgggcctaatgggaggtgctaagagtcatgggggcagagctcttatgggtagattgatgccttatctgaggagtaagttctcattctatcagttccactgagagctaattattaaaaagagcctggtacctccccctactggcttcctcttgtaccaggtgatgtctctgcacaggaagccggttccatgtctgcttctgcctttagttgaagcagcctgatgaggacctcaccagatgcagatgttcaatcttgaaatttctagccaccggaatagtgaaccaaataaacttcttttctttattgactatacagtctcaggtactctgttgtagcaacactaaatggactaagacaagtagctataattatttccttatattcatgttatgatgatggtggagaatgttgagcgctgtacgaaagttcaggaggggatgagaggagaaacggaagggggatgagaggagaaaccgaaggaggaaaagaggaaggagaaaacaacagttcgccaaaattgtgcccaaaattgtgtgggcataatttgtttggaattaaggctgtctgtggtcacagagtgttcacacctcctttactccactttatgcttcctgagtgaactcattcacctattttcacagcagccaattttaacctcctctgatttcaatataaagtgtttagtatgttcacagagaatatgtaagtcttcaggcaagcctttagtttccagtcctgctacccactttgtatcttcaacctactcctttctaaagattgtttctccaccaaactatatatgactctcactctgtcgcccaggctggagtgcagtggcacgatctcggctcactacaacctccgcctcccaggttcaagcaattctccctgcctcagcctcctgagtagctgggattacaggcatgcaccaccacgcccagctaatttttgtatttttattagagacggggttttgtaatgtttgccaggctggtcttgaactcctgacctcaggtgattcacccacctcggcctcccaaagtgctgggattacaggcgtgagccaccatgcctgggtatatatgactttttaaaagctgtttccctctccctacatcccttcagaaccaaacttctcaaaagtgtagtcttcgaccaccgaaactcctcttgctacatttcaccagtgcgctcctgttactctatctgggagaaaattttcatgatttatttcaattgatcactgtggcatctgacgcagctgactatttgcttctcaaactcaggttttaagacatgattatctggagtatcttgtactaactctctgactgctacttatttatctcttctgtgagctccttttctgtcttccactatctaaaatacggggctcaccagatttccatttttagctgtctttgcattttgccttttaaattttatgtattcacaaagttagaagcaccacttatatgctgacaatgctcagttcgtctctctatataactgcttcctaatttgtacacctatattttccaatcgcctgctggttgtatccatttggagattccatgtgcatagaaaaaaaaaatcaccatttcccaaagtgaactcactatctgcccacatgcctcatccccttgacctccactccccttcctgtcttccctacatcagtaaaggatactatgagaatcatgggattcaccaagtcctgtcactttcatcttataaacacaataattttatatcttctttttttgcattcctgtcttagttcatcacatcttcctgaaattttgcagtaggttttcaactcatcttccaacgttaaattttgctccacttcaatccaccctctacacttcagaaccatcttcgataggtgtgaatctgttcatgcaattctattgacactatttcatgggcccctacaggctttggacaaatattcaattattgagcaagacacaaaaatggtcttcatcttttgatccccacctacggcttcaacaccaaatctaccctttcctcactcccactccagtcttttaaaatgacttccaaatccctaataccatttatttatcctgtgtcacaccctcctctatgttattctttctgcttggaacatctatccacacacttctaacccccttcttcacctgactcgtttccatgtaatatattagtatattcccactatgccctgtgtatatcctctttcaaagcactcatgaccccacattgtgattctttctacacttgttgttccaaatggtgaatgcctgactttgtgcgctatgattctgtgttctatttccccacataaatagtacagtgtgtagcaaataataaattactactatagaagtgaatttttcactcaatacttgtggcattcgcccggggtcaaatatccaaacaaccatttgtatataaagcaaaaccacactgggagagacaccataaccttgtcgtgatgtaatttataaacatgatggaggaagacagaataaatacgtaaaatataaaccatttgaaataccaaatacccagacaagtgacaaaatcaacaagtgacgaaggaacttataggagacaaagaccatgaggcacttacttggctgctaagaaagtcttacagaaaaggaaagacgtaagctaggcataaatacagtaagaatctgatgtaactataagaatagtaaacgcctacctgggcggtggtggctcacgcctataatcccagcactctgggaggccaagggtggggaaatcgcttgagctcaggagtttgaaactagcctgggcaacgtggtgaaaccccatctctattaaaaatacaaaaattagttggtcatggtggcacgtgcctgtagtcccagctactcgggagactgagatgagagaattgcttgggtccaagaggtgaaggttgcagtgagccaagattgtgccactgcactgcccaggcaacaaagcgagacaactgtctcaaaagaaaaaaaaaaaagtaaacacctagataatatatttcatgaggtcaggggatgggttggtctcattcactactctgtccataaggcctaacacatgcttggatcatagtagctgctaaataagtttgttgaatgaaattttaaactgtgcagctggtgatgcaagaaaacatctgtttaaaaaacagcagcacttttctccatttgccattccataaaaaggtaatttgtgtatgtgtttactagaactctttcctcaaaagtgaaatattgcttcactctttggttggcaaatgtgttgttttaagatggagaagaatctgctttaaatgaagaggaagctatttcagtccataatcctcagagccaaaatttgaatcttaaaatgcacttttcatcaaagaatcttaacaaaaagattcctgccaatttaaccacgacatctaaaaatatttcattccaaggccaagctttctgctcaggagcattctaattgagaccacattcttccaaagatctattgagctgacagtcacctaagtcacatggttctgacaccaccagtagcttcctcagtaaggactcacaactgcatgccatttaggagttctgcattttcctcatgattttctagattttcaaattttcctggaacttctttatatccaatagagctactataactagccaagtcagagaaacatggaactttgagttgcaagccaagttaatatatcctttctcaattaaaacatggtaaaactgagacttagtaaattatattgccaacccaagcacacttaagacagcagctggagtggacattgggtctcttgagttgtcttcattaagtatgttcatagacgaccaataaacttacatgaaggcataccacagaaagatactgctggctcagttccagaccaccacaataaagtgaatatcccaataaagcgagtctcacaatttttttggtttcttagtgcatacagaagttatgtttacactatactgtatctaataagtgtgaaatagcatcatgttaaaaatgtacataccgtaattttaaaatactttattgctagaaaatactaacaatcatctgagccttcacggagtagtaatctttctgctgatagaatgtcttggctccatgttaatggctgctgactgagcagggttgtggttgctaaacgctggcgtggctgagacagtttcttaaaatgagacaacaatgaagtttgctgtatcagtggactcttcctttcacaaaagatttctctgtggcatgctatcctgtgtgatagcattttacccacagcagaaattctttcaaaattgaagtcaaacctctcaaatctggctgccgctttatcaactgagtttatgtaatattctaagtcctttgttgtcacttcaacaatgttcacagcgtcttcaccaaaagtagattccatctcaagaaaccacattctttgctcatccttaagaagcaacttgtgcattgaagtttgatcatgagattgcagcaattcaatcacatcttcaggctccacttctaattctagttctcttgctatttccaccacatctgcagtgacttcctccactcaggccttgaacacctcaaagtcattcatgagaattggactcaatttcttccaaactcctgttaatgttgctatttgaacctcctctcatgaatcatgaatgttcttaatggtatctagaatgtgaatcctttccagaaggttttcaatactttgcccagattcatcagaggaatcactgcctatggtaactatagccttactaattgtacttcttaaataagacttgaaagtcaaaattgctccttgatttatgggctacagaatggatgttgtgttagcaagcatgaaaacagcattaatctctttgtacctctccatcagagctcatgtgtgactaggtgcattgtcaatgagcagccattattttcttgttgttttgtttgttttctaattgtaatctcattattattattattattattattttgagacaagttctcactctgtcacccagtttgcagtgcagtggtgtgatctcagttcactgcaacctttgccacccaggttcgagtgatcctccacctcagcctcctgagtagctgggactacaggcacatgccaccatgcctagctaatttttgtattttttgtagagacagggtttcaccatgttgcctaggctggtcttgaatgtctgggctcaaggtatttgccggcctcagcctcccaaactgttggaattacaggcgtcagccattgcacctggttgagcagtaagtcagtaagaatctttttttttttttttctgagcactaagtctcaacagtgggcttaaaatgttcaataaatcatgctgtaaacagatatgctgtcatctgggctgtggttttccatttctagagcacaggccgagtagatttagcatcattcttaagggacctaggatttgagacagcattcacttaaggtaaccagctgcattaacacctaacaaaagtcaacctgtgccttgaagctttgaagccaggcattgacttctcctctttagctatgacagtcttagatgtcatcttcttctgatagaagactctcttatctaataaagtcttttgtgcagaatagccagccatcttcactgattaccttgcatcttctgcataaattgctgtagcttctccatcagcatttgctaatacaccttgcacttttatgttatgaagacagcttgtttccataaacatcctaaagcagcctctgctagcttccagcatttcttctgcatctcctaagccttcatagaatcaaatacagttagggtcttgttctggtaatctggctttgtctctaagggaatgttgtgactagtttgatcttctatcaagagcactaaaactttctccatatcatcagtaagccttttccattttcttatctttcatgtgttcactggactaccactttcaatttccttcattgactcctcctttgcattcaaaacttggctgctttgagcaagagacctagctatctgcctgtcccagcttttgacacactttcctcactgatcttaatcatttctagcttttgatttaaagtgagagatgtgcaactctcattgtagggctgtgaattggcccaatttccatattgttgtgtctcagggaatagggaacctcacagagagggagacggacagggggatgacccattggtggaactgtcagaacacacacaacatttatccattaagtttgctgtcttacctcagtgcagttcatggtgcccccaaacaattgcaatagtaacatcagagatcactgatcactgatcaccacagaaaatataataataatgaaacaatttgaaatattgtgataattaccaaaatgtgacacagagacacaaagtgaacacatgctactagagaaacaggctcattatagacttgctcatttcaaggttgccacaaaccttcaatttataaaaatgcaatgtttgcaaggcacaataaagcaagctagaataaaacaaggtatatctatattctggtattcacccaagataggtaaaatgggactattactcccctttaatgaatgagtaaagtgagcccagtctatctgtgaatatcctcaggatgactaagcatcagaagtagaactcgcatctgagactcctgattcacttcagggtctttctatcattgtgatttacaaggagcatcacactgacatggacatttatttgtccagtacaaatgagtcaatgacaatttaaatggtctggttccctaccattcttcaaagaaagacatgctatatcataagagaaagttacaattaccagagactgcagtccacaaaggataatgagggataaatgtgtctgttaaatcaattttgaagtttcatttaagtaaccaatcaaccattctttcacacctgaagctaatcaaaaggccctaacactcagacctacatacagggtacaacacaccataaacatctgttatttagacaccagagatggaatttcccatctgttgcttcaaaacaaataatcatctttaaaaaataaaacaaacatcacaaaaaaatttctttgaagataattttaggttattaaggttggaagctgaaaaaaatgttaatttttcaacaagtgacaatctagctggacaaatccatgggtgtagcataaggctaagtaaggaatctggcttggaattttcaacacttggttctaatcattaatgttgcaatgttgtcccatttacaacctgatattcatttttgcacttcaacatctcatgatttttcagcaacagtaaatagctttaagtgatgacaccttgccttaactggatctatattttgactagcaggtcttggcattgtttccacctcagatatctctccaaaatgttgcatgtaggcaaaaaatgaatagaacttaaaggaaagaaaaataaaaattctaccactctaaacaatgttaggatataatacctttaagttattagctaacctactgcagcaacctctagtcatctcatgattatctctttgggttctaaatttttcttgatatgtttcacaaaatctcattttgtgatgctctaaagagggaggtggtggtaaaataagacttgggactgagagaagagcataaaaaaagcaaaatgcaaaagagaggagtctgaatcaatcacgtgtaggatgcacagaatcacacctgatttctatattactttgttttaaacagcataatttagattcacattcctgagacataagaaggtacccacattaagacatcttttatttttatgctgaagctcaaaatataaactgataaaagacctttcaaattcaccaaaagtgaatatttgtatatctgagaaattaaatactatcccaagaaacattctctaaccacacagattttcataatgtgagggaaatttttggttctgaaacatccaatattatctttagtctgcgtttatattgcatgtgataaaaactttctctaaattagaatatgagaagattaatgtcattaaaacatttcagaaatagcagaattcccttgcatactcataaggtataagcacagtattcatttgcttcagaatcttatgaaatctcgggattatctcttatctttagacagtgtatgaggactatgttggttactgagcttcttcttgtttgaattctgggaatatggaaatttatataatgttgagaactaattttcaagtcctgaggggtggcttagaaatgttttgcataaaagtttatatactatacccctttatttaataattaatccaatttctagacagaactatgccaaaacacaaccttctgaaacgtgctgtgtactatcaggactgaaagtaacactggaattctacattaaaatgtggcctatctagagggacttctccaaagcatgagattttaaaaacacagagtagaaaagtcactggaggaatgcccccaagtatgtgggggcgtctgggacgcttgtcatcgcattgcatgtctgcagtgttccaatatgggcagcagggggagctcccgattgaagcaaaccccccaacacgtgtttcctagttgggaacacaggctttttcctcttaacacttgccccaagtccacggaggcagccactaaggagtactgctgtcaattaactgtacaagcttaggacatgtggtgaatgaattgctaaagtgaacggggatgacacatgggtctgagcctaccttttagaaacaggatggccaatttttattttggtgggcaggagggattaaagcaagcagcaaacaatggagttggggcaggaatgggggatgggggcttgccattaacagtaaacagtgatctttgaaagcaacgagtgggcatcagtattccagggcctttattagttttgtttgtaggctatattctccattaaatgtcaaatcaaaactctcccttcttcccatgaccccacatcaaatccagaaaatcacttaatgaactgggtttctcattgagcctgaggagatgaggcttctgtagggggtctcctgcacgtggttgcgttttacacatgaatgtgtgatgcattttactccaagtatctgaaccaggttgaaaaaatccttagggaccagaaagagtcaactctctaacctcaacacagggtattctagggtgaaattccatgctctcacccccacctcatacacatagccaagcacacccccacccccaatagctggctcatttctccttcctgtccccaaacgaaagtttgcaaagaagtagtcataaatgtcaatactcaccatattgacttcagaaaccatatcgatgctggcaatgtcaatgttcatccccacagccacggggggacctgcaaagcaagacggccagccacgtgatttctttgaacttcattcattctcagcaagagttatccctgagcataagacactctgcccaaaacccttctgcactactcaatctcaaatttttcaattctctgctttttttgttaaaaaaaaaaaaaaaaaaggtagcaggcacacactcctctaacaaatgctgtattgaatatgcacacacgtatgctgtgaacaagggattccagctctgtctacatatgcatatgtctcagcatgtgaatgcacacaactcacagaagcacaagaatccttctagtctaagggatttttatattttgcgctgaaaccccctcctcctcagtctttcccacccccttctgtgcacaggttttaactctttgagcttcataagagtctgaagcaatattaagtgagtctatcagcatatctagggctgcagccagagagagattcttctttcccctaccttctctaaccctcccattttctccctaccctcccatcccccagtcctccccatttctgtgaggctgggaggagtggattatatccagacatgagccactgtaaccctggccagaagaactcttccaaagtaggcaggcacagggggttaacgccacctctcaaccaactgcctgcacgtcttgtcctaaaaaatgttaacggtggccttccgcaagccgggttctctcggcacaccattaactaaacttaagaggtttgtgtctcaacaaagcaaaggcagggaagcaaaggattcataacagtgaagctgaaagacagcagtcaccaaatttgagtacacactaagagggtctcattgaaagaccacggaagtggtgggtagcaataatccagcttaagttttgatcagtttctcaatatggtaaaatagagacacattcaggacaccacatgcacccacaactagggagagggaagagagcgcgcacaaagctcaaaagacagcttcggctgtggctggacttatttgcaaggcaaccccattacctccaaaatctggtctcagacgaatgtcatagcctttcaggagtctatccaccgtctctttaaccagcgacatattactagggtcattgacactaaagaaagaaatgacaataagcaggcatcaataaggaagcaggcatagcgttttcagcatcggatccctactacatttccctgctcacagaggtatgcagacagaacccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggaccgagcagatttccttgtttaaaaaaaaaaaaaaaaattaaaagggaaaaaggaaaaacatgtatatgtataatacatacatatttgaataatatagaaaagtcaccccacagcagcatccagaataaaatttttgttgttatcctttcgttaagacaaaataactacagcgtctggtaagtttcggtagttgcaagaggcagttttgcaccgagcgggttgtgggtttttggtgtgtgtgtgtgtccttttaaatatgcaaaaccagattagaaaattagaggagagcaggtgtggcgtgccagcggaagataggtgccggtaagcccacttctggtctcagccggacacggggcaaggagtttgaactttatttccttggcaaatagcatgccctgcctggggcgagactgggatggggggggcgggggttgtgcagcgggtgggaggaggggggagggggcgttgggagtcgaagcgggagggagggaaaaaaccaatgggaggaatgctgagcaacccgttggatttggggcggggggttggggaggcgggtacagaataagaaaggcacggaaaaataaaaaaggaagaaagagaaagaaaagaataaaataatggctggtctcttctagtagtcaaagagcaagcttttcttcactactcacgagcgatttctttctcctctcctcaccctttgccccctattcccagagaagaaaacctcggggtcctgttttctcgccgtgtgacgttcctgacccgctagtccgggttatttatagcaggaggggaggggggcgaggggagcagaaaggcaatgctgtctctccaggtttcggtctgattctgcagtgggaattattagtgggcagggtggggtttgcatgagggggagatgggacgtggaggcgtgagggatgcgggtgacgggcgccctagcgcaggtgcgggggactggagggcgtgggcgaccgcacagagcaggaagggcaggtggccgggtgggacgcgccccggccggtcccccagcgccccctccgctgcgcgcacccgcgcgcacacacgtgcaggcgcactccccacccgccgccatccctccttacctcgcaggcccgcgctcgccgcccactcccgcggcgtgcggagctggcgcccccggcccctcgtccgggacaggggacggggactcccggctgttcaggggctgtacctctggatacaagaagccggagcggtccctagaaggcaggcaaaatgaggaagagcccctcacctccggaggcactgtgttctcccgcggtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggccgtccgaaggaaccggagtccacaccagcggctctccgggtactcctgagtttatcttggaactggggaagaggcgggaagagtagacgttcccgctacccctcccccaaccccaccctgggtgaagaactggaaaggccagagctcaaatctctattctggaccccaatgcttagcctctcactgctgctgccaatcatggtcactattaagtgagttcctacttcgtgccagagcgctgcattcattaattctgacaacagttctagcgtttagctatcacttcagtgtccccattttatagattcagaaattgtctcactgaagtcaagaagctcgcccaaggtcactcagatggcatgaggtgaaaccaggattggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcccgcagagttggcggcaggcggcggaagtagctccacaggcttgcgaccccggcagccctgggggctcctcagggtcctgttccgtgctgcactcttgacccacttaccttctgataacctttcccctcccccaccttggtcagagggtcatctgggggtagtttgtggggatgactccgggggaagtgtggaggcgggagggctttaaaaggggggaatccgacagctcctctgggatggatgataaacaggaaaagaaagccgagttccttcaccgaccaagggagtttctaggttaggaacaggtaaagcccagcaccatgaacatactgctgatctaccgcgcggcgctctatagactcccaggctcataggagcccatccaaagacgcgcgcttactcacacacacgcacacacacatacacacgagggtgggggaggaaggtctgtaagtctcccatctgcagttacttgggtttagcgttacctcagaatgtagaactatagccaaggaaaactgctgattttcctttctctttactcctatacacagtgagaatcttttgcaccagctgagtagaatgatgggtagggggaggatcggggttgggggggtggttagggcattatcagcatgatgtccagaagattcctaaagcagtttagtctcaagtaacaaaatgatgaagtcctaaaatgctccccttcccctcgaacctctaacacatctcaaaatagggttttccttctgaccctcagttacccacgtttttctttctgcaccatcagccccttctacctaggctcgcttcagtgtaagttgagagaacaaaattcagtagacagaacaaaccacaaatactgtcacccatctataatgataataataataataataatggcccagggaatgatgaaacaagtatatattaaaggtctactatatacagaaagttaagaaagagaggggcaaagagttaaaatagcttgcatgtcagcaagtaaaattgtgtagtgtaaactgagagcataaaagaaccggaggtaaatctttgggttcaaaacccaggtcaaatacttagtaactttgtaactcaggcaagtcatttaacctctaagccttagtttcctcttctggaaaactgagaaggaaaagaataccctctccactggattgctctagaatgaggtacatataggtgtagtatttggctgtgattaataaatattagtaatcttttaatgaataagccataatgaatgtacaggaaaacaaacaaggtttagtgtcactcagctatacaaactgagtagatatagatttggtgccattattattattatttaaatatactttaagttatgggatacctgtgcagaacttgcaggtttgttacataggtatacacgtgccgcggtggtttgctgcacccatcaaccggtcatctacattacgtatttctcctaatgctatccctcccgtagcccctcaccccccaacaggctctggtgtgtgatgttcccctccctgtgtccatgtgttttcattgttgaacttccacttatgagtgagaacatgtggtgtttggttttctgttcctgtgttagtttgctgaaaatgatggtttccagcttcatccatgtccctgcaaagaacatgaactcatccgtttttatggctgcatagtattccatggtgtatatgtgccacattttctttatccagtctatcgttgatgggcatttgggtgggttccaagtctttgctattgtgaatagtgctgcaataaacatacatgtgcatgtgtctttatagtagaatggtttataatcctttgggtatatacccagtaatgggatggctgggtcaaatggtatttctggttctagatccttgaggaatcaccaccctgtcttccacaatggttgaactaatttacacttccaccaacagtataaaagcattcctattcctccacatcctctccagcatctgttgttttctgactttttaatgatcgccattctaactggcgtgagatggtgtctcattgtggttttgatttgcatttctctaatgaccagtgatgatgagcttttttttgtatgtttgttggctacataaatgtcttcttttgataagtgtctgtttatattctttgcctactttttgatggggttgtttgattttcccttgtaaatctgtttaaattccttgttgattctggatattagccctttgtcagatggacagattgcaaaaattttctcccattctgtaggttgcctgttcactctgatgatagtttcttttgctgttcagaagctctttagtttaattagataccatttgtcatttttcacatttgttgccattgcttttagtattttagtcatgaaggctttgcccatgactatgtcctgaatggtaatgcctgggttttcctctagggtttttatgatcttaggtcttacatgtaagtctttaatccatctcgagttaatttttgtataaggtgtaaggaaggggtccagtttcagttttctgcatatggctagccagttttcacaacaccatttattaaatagggaatcctttccttattgcttgtttttgtcagatttgtcaaagatcagatggttgtagatgtgtggcattatttctgaggcttctgttctgttctatttgtctgtatacctattttggcaccagtaccatgctgttttggttactgtagacttgtagtatagtttgaagtcaggtagcatgatgcctccagctttgttctttttgtttaggaatgtcttggctatacaggctcttttttggttcccattgaaatttaaagtggttttttttctaattgtgtgaagaaatcaatggtagcttggtgggcataacactgaatctataaattactctgggtagtatggccattttcaccatattgattcatcttatccatgggcatgaaatgtttttccatttgtttgtatcctctcttatttcctttcgcagtggtttgtagttctccttgaagaggtccttcacatcccttgtaagttgtatttctaggtattttattctctttgcagcaattgtgaatgggagttcactcatgattttgctctccgtctattattggtgtataggaatgcttgtgatttttgcagattgattttgtttcctgagactttgctgaagttgcttatcagcttaaggagatttggggccaagacaatgggattttctaaatagacaatcatgtcatctgcaaacagagaccatttgacttcctctcttcctatttgaataccctttatttctttgtcttgcttgattggtgccattattataagtcagcctgagaataaaggagcagatatttcatgggaattaaggaagggtgaagaagaagaggtattaaaaatccaagcagcaatcaaacagagaaaagattaaagaatatgcattctctatgcaataacatctcagggatatcccttaccaacaacagtaactaatataattaaaaatacatttctggctgggcgtggtggctcatgcctgtaatcccagcactttgggaggctgagaagggtggatcacaaggtcaggagaccagaccatcctggctaacatggtgaaaccccgtctgtactaaaactacaaaaaaaattagccgggcatggtggcacgtgcctatagtcccagctactccagagcctgaggcaggagaatggcttgaacccgggtggcggagattgtagtgagccaagatcacgccactgcactccagcctggtgaaagagtgagactccgtctcaaaaacaaacaaaaaaacattttgactagttacaaagctaaggtcaacttatgcctaaagtgagtctcagtcatacaacaggagcaacactggccatctatctggacgactttgctgacaatactgcctcagaagatgcaaaatgagaacaataacgtggaatctggagatgtgttagttgctgaagagtatcctccacgatcccaaatgtagaatgagaaggcaaaatgtaagtactcttaacaggccatatttcaaaatcatctcagtatgaaacatataaatacaagtttaaaaagtcaccaaccatcttccattagtctttaatgtaatatggaaacattattcagtaaatatgtagcaggcttctaatcttttttttaattttattattattatattttgagttttagggtacatgtgcacaatgtgcaggttagttacatatgtatacctgtgccatgttggtgtgctgcacccattaactcgtcatttaggattaggcatatctcctaatgctatccctccccgctccccccaccccacaacagtccccggtgtgtgatgttccccttcctgtgtccatgtgttctcattgttcaattcccacctatgagtgagaacatgcggtgtttggtttttttgtccttgtgatagtttgctgagaatcatggtttccagtttcacccatgtccctacaaaggacatgaactcatcattttttaaggctgcatagtattccatggtgtatatgtgccacattttcttaatccagtctatcgttgttggacatttgggttggttccaagtctttgctattgtgaatagtgctgcaataaacataggtgtgcatgtgtctttatagcagcatgatttataatcctttgggtatatacccagtaatgggatggctgggtcaaatggtatttctagttctagatccctgcggaattgccacaccgatttccacagtggttgaaccagtttacagtcccaccaacagtgtaaaagtgttcctatttctccacatcctctccagcacctgttgtttcctgactttttaatgatcgccattctaactggtgtgagatggtatctcattgtggttttgatttcaaaattgttttacaagtactgggggatggtctgcggaaaaagcaaacatgtggtccttatcctcttggattttacactgtagtgtaggaaggagccaagagccatcatggaatttattatatgtataacatgtaaactgggaaagataggagattgtggaattcataattggtgcagataactcaatttgaggatttgggaaaagcttttttctgatgaagtcatgcttcagtggaaatttcaaagctatgctagcctgatgaaagattgtgggaagaaagttccagacagaggaaatagtatgtacaaatatcttgagtcaagagaggatagtatgaatgaagaatgaaggaagaacagtcagactagaggacaagggcaagagtggctgttgacacagttgaaaattacagaccaggataggttgaagcagaggggtgacaggatgagttttaatcacactggaggaagatgataatggctgtaggggatctgttaggaagctattgcaagaatccaggtgagaggtgatgttggtctgaactataatagtgacagtgaagatgaagagaagtgaccatagtcatgcggaggaagtggctaaactttgtgacaaatgtaatgtggagaatgaggggaaagaagaattcaagcatgactcatacatttctggcttgaggaactcagtggtggtggcagaagaaagttgatgagggtgatacatttagtttgggtcatgttgagtttggggtacctgatagccatccaaggtacactagacattttgataaatgcacctaaagctcagcaccaagggctgggctggggccagtgcaaaatctccatgctccatcttgacagtatatttccctttctttatttaaattttctctgtataattcataactgtgtaatcataaccgtattttacccattttatatccatcttccttcatggaaagaaagttttaaaaaattgtgttttttgttggcttggtcattgttgtatcccagtaactagttcccatagtaggcatctaacaggtatgttttgaatgaatgagtatatgtgtgatgatcctgaagatgtaatccacttatattatgaaagtgtatgaagaatgaacagagtgggaagactggaatgccgagaagataaacttctggtaaaggacagttgcagccaccagaagggtcaaattaacattgacacagaaggtagaaagaaaatgagtgcagtgtgatcacagccaaggaaacagaatattctgataaaggatggactagtcaactgtattaaatcatttacaaagattttgcattttagagcaggtattgcagtttatagtacacagttcaaaagtaagtcactctgtccttctgccaccatgatcctttttctaaaaactaacacagttcattttctgggaggaatagtaatgagatagttcatatcatagcatttcatctgttaacaaacaggtatgaaatatgtccacaggtgccaggtagccctctctgccttactcctgctggtgaagcagcagaatgatgattttgaagaaggttctcatggaatgtgtattacctgttttgcctaatcatttaaacttttgaattcataattctttaaataaatgaatgaaagatctcttagctctgaatattgattggggtcttttgaaatagtgtgcagaaatttcagtaatattgaagggtaggaagaaagtcagaaataacatgtagaaagaaaatatatgcctaatactgtcagcatatacaatagcacagactttccaattactaataaattctcaaatatatggctttctgagcctatgtaatatacatataagaactcttttatacaaccttttcatgtatcttatatataaatgtagttttatttattttatgtactaaattgtatgtctatagtagtttaaattttattaaatatttttcccttatgctcatcaaaaatgccctttatttatttgtctggcaagccttgccttcataggtactagaaaataaatttctcctaaattaccataaattccatattatgggtttatgacttaatgagattttactgtgcagaattagaaatgcaaatcacatgtctactgagtccactttctccttcagcaggtataactaatgctatacatgagtttctgtaaaactatcagccatattaacccttatgacatagaaatcaatttagattatttaaccaaaaatataatattaataataaaataagaccaatgtgtcactgttccaaatcctgtctctattgtaacttatttaatccttacaatatacctgtaaaaatgttcatcatttttaaccccattttgtatgtgaggaaacagcagcaaaaattaatcgctctaagatcacacagttaattttttaaaaagttaaagggctcaggcccttcctgacaactatgtgactttgtaagtgaaactcctgtagatttgtctactgtacattctcagcttgtctcattcactgagttaatataatagaaacaaaacctcagcccagtcagaggatctctgcactttaacaatcaaatgactaataggaaattttgagaattgagtttctgggcatcttttaaaggaggactacatcagattaatcgatcttcaagagcatagaaagaaaagtatgcctcggagtacaaaatgaaattagtgatgcttccaatggaggtaaaattgttatatgaggaaattacctaagctctgacaccgtggggatgctaattatattcacatactgtcttggcagaaataaagcaccacatcctttatgctagaaaaggataaaatgggaaggaaacccttttttaccaactgctattcaaagtcccaagcagggagaagaggtatgccttatcaatgagcaaaactgatgtacaaacaagaacattaaaaagtctgagcaataatttctcaaaatccctatcaggttggtttcttagggatggccattgacagatagccaaaaatagctaatccaatgtgtaaaatggggttttcccaaatgtgggtcatgcatctcaaaggcctttcccagtgctcctttaccagaactgtgtatccacttatataccatagttagggatcctaaggttaataagtcttttgcagctctaccaaaactcttgaaattctaaaaaatgtacataatgactctaaatttaaaaaataatttaatgttgaaattaatatttaattaaatgtctataacatgtaataccatgcctataattatacatgattatattcaacataggaaatataaactttaatctgctttgtattatgtgtcaagggttctccacgacttaaagaacttgggcatatgatggtttttcaaagctccaggtagctacagcctcaggcagacttaatcactttcaaattctatgcatctaaagccaattgcagtattctgttcttttttttcccttaaatcctttttcaaggcattccattgctaattctacaagaaacaagactgtattttacttttgtttttattatccaatgtattatactcagcacacttacttaacttgtattagcacttgtaagttataattacaattattatttttgttaatacttatgtagtgctgacttactagcttgtttgctctttgatgaacaacattaattcattattcatttaagtctttcaagcttatgtgtagtgcttttggggttgtaagtgacagaaaccaagcgtaaactatctcagacaagtgaattttaggtcatgtagctgaaaccgtcaaggatgagcagcattgaggacaggtggattcaggggcttaagctattttatttctcaattccattttatgaaaattggccatattcttaggtggggtctcttgtcaaaataacaaggaagcagttactccactttagcaaccctgagattaacaatttggtaacaccaaaattgcaagataaaatactgtgtgaaggcttggatcatagacctatattcaaccaatcatttgctctgatcagtggtcttgtgcccacctctggtcctgaagctggagtaaaccatatctaaaccatgtggaccatgggttgttgaggaatgagaacccaaagaaggatccttaacatattgtttctacaaagaggaggaatggatccggagcaggcaaaagtcaaagatgtctactatgggcagaataggtgtcattagtaaccacatcttttcgataaatcagttgtggcatagggacttgaatatggctaaaagagagacccaaattcaccacatccatcttacatgaatgtccttgtaactgtcctgtaaagatgaatgaatgaacaaatacataaatctaggacatctgggatctcatatttatgtcaattatggttgactgctacttacattttagaaatttgcatagtcatgtgtgaaacaatcacctcgaaattgtttgaagatagtcatggtataactggatgcatataagtaaatacatgcaggaattgatataaaaatttagtaaaattataagcaagaatggctagggatagaaggtcctaaaaattcattatttgagtaactgagaactactagtaaaaaattataatgttagtattaaataattgcattaacttcacttctacatagtaaaacttgattaatatttgttgaataaataaacatttgaatgaataaattcctcaaaaacctttttggctgcctgatatggtttggctgtggcttcacccaaaatttcatcttgaattgtaatttgcataatccccataatctccatgtgtcaagggagagaccaggtagaggtaattgaattgtggggccagtttcacccatgctgttcttgtggtagtgcatgagttctcaggagatctgattgttttataagtgtttgtgttcatttcttattcctactgtcttgtgaagtgggggccttgtttcaccctcaccttcccccatgattgtaagtttcctgaggcctccttagccatactgaactgtgagtcaattaagcttctttcttttataaattacgcagtatcaaggagttctttatagcagtgtgaaaatgaactaaaatattgcctaagcatttaaatatgcccatgctaataatcataaacagtttctaaaatttttgttgacatatgatttaccttaataataaaaatgtattattgtatatagtatttaaaatatatgtcattgtggatagaaaattaccttcctagccaggcacagtggctcacgcctgtaatcccagcattttgggaggccaaggtgggcagatcacgaggtcaggagttcgagaccagcctgaccaacatggtgaaatcccatctctactgaaaatacaaaaattagccgggcatggtggcgggtgcctgtagtcccagctactcaggaggctgaggcaggagaattgcttgaacccgggacatggaggttgcagtgagccgagatctgagatcatgccactgcactccagcctgggtgacagagcgagacactgtctcaaaaaaagaaaaaaaaaagaaagaaagaaaaagaaaaagaaaaaagaaaatgaccttccctgatacttatattctaacctctctacagttttttaattctcagaaaacactatgagttatattctaatgttatcttcatttcacaatattctgaaattgtcaaaggttttgtgattaagaaaagcgtcttttcagaaacagaagaatggagaagaactagtcaaagtctgtcagagtgaagattttctttaattggaaacctaatgagtaggtgataataaccattgttttctttcatttgttttagcatagttatctcataatagaaacggcatgaagacattttttgttcctagttcctgagaagattaatttggttctagcttcaaataagatgattaagggctgtgagtggaagtgttcctactaagggtgtggtatgtggtggtgtagagcaaagtcatagctctgtaagataaagtcttttgcaggaaagaaagtccaacaaccaattccactgatgtttattttttaaaatgtaatttcttttaatgtgagctcagaattaagtgattggcttttggaaccagtgatgcatcaacaagaaccaatgagtactttggggatttggtatgttccaaccatgcattttatccagaattgggcgtgtggattgttcaggagatgattttgtatattacatggacatgtgttgtaaatttacggaaaatagatgaagtagtaatgcagttggtacttgggtgtgacaaaaataatgcaggtggtatgccaacatttgggaattgttgactaaacaaattaggaaagaactatctgccaaatttctgtaagagaaattctcatactttaagctgaagtgaggaacttccaactcttaagtgtctgtggttattagaagtccctagtgtgggtgatcagcagccatgagatgtgaggtgaatatgaacatcatcagacaacaaggtcacctttttgacacagggatcaaaatctaattcaggaattcagtgaatatacagaccctctgtgtatgtggacatgttctgcagggaacaaacagatgaatttacaatattattcccctcaagaagcttacagggggagggggaggaagaatggcaaaatgattacaattactctaagcagcagaatagtaatgtcacaagaaacaaaggaagaagggaaactggctgggagtaaatgggaaagcctttactgaaaacatgctgcttgaagtggacctcgaaggatggccaagatattattgcagtttttagtggatgatgggaagtttgaaataaatttttgcatagatgtagcatctagctaaagtacaaaattggccaagttgtgaagatccttgatatcaggataaggattttaaatgatgtagatagatgtagggtactctgggatctagtcctccttccatccttcatcagcaatgttatagttgccacatcatttttatcagggatcagctgacttgttatgataacaagtatcaggctttgcaggatactctgatccacagtagtattatgaaagcagccatagaaaaacaataaaggtgagtcatgatttaataggagtaatagaaaaggttaaaaataaaggaaaaacacagtaaaatttttatccagaaagaaataaacaaccaaactagcagtttatcatgttacacaaataggcactagtaatctgagagggtcttttatgtcacctccatttttaaaggggcatgagagtatttgaaaagaatggcatgacatcatagatcattttaatcttagtgtgaagttgagctgactagaggaaaaaacctcagatctcagattcttttaaaaatatactggaaatgtacttaagaatttactgtaaaagatagtaaagtggatgcttatctaattgttctatttattttcttgggagctggagtacgtagtgcccatagagaagctggctgtccccttccattcttctataaggaagggaagaataaatgggacaggagaaaagagaaccattaagattttattttaactaaaagttctgggagagtaaatttttttttaaaaaaaagctaaaatttaaatattaaataaaacagatatcagagaaaacaacttctgaagatagcaaatcaaacttaaagatttggaaagaccctgaagcaatcattgatatattacagaaaataggcagttcatttgaaaattcatagataaaacaagaaacttcaaagagctatctagcttgccgtgggcatctttgatctatacctttaaacatgttatgtatttttctctattattaaaggcacgcaaaagatggttatgttggtgcagcctctcaagatgcccatcaccagtgattatgaggtgaggaatagaacaattcttgagaaacttatgctccagagcttccttataggatcaaactcagcctacccactacatggctcttccttgaaacctcccttgtcttagtttccctctttccctgtcttactttttcctgtttctcatcatctgcacagaaatccttctctcaaggtcagcttctgggaattgaacctaacacaactgggtacttttggatgcattctggaggagaactgtttctggaaaataagacatcattactggaactctgcagatgagaatggcaccatgagttgtggaagaacaataactagctgctgtgttgctgtttaacacttcttgtatgattttttgagacatggggtgactcccaagttacattctcttcctgacttttagttgtatcaaatgtaaaatgagggtgtaaaattaggtgattgccaaagttccttccagctggaaaaattctatgatgtaaatcaggggttggcaaattatggacctctggccaagtccagccatacctccttttttttgagtgaagttttactggaatgcagccctgctcattagtttaggtattgtttatacctgcttcgtgctgcagagttgggtagcctaggctactctgcaactctatgagactcataatgattattatcctcaacattttaaaaaacaggtgaggaaattgagacaaagcaaatttaagttgcccaagtttacaggatgagtaatggcagagctgatgttcgtattcagccaaactgcctccagagttggtgcttttaaccacagtgctaaactgccctgatttaagaagcccacaatgaaagtgaatgttaaaaccttttgactcatagtaattaagatgtgcttgctttgtttttagtatgagggttaacattaacaggaatacatatggaagaatggatggaggagagggaaaggggaaaattctgcaagctcaacaaagttagaaaataatatcaacaataaaatatggcctgtttatttatttttttttaccatcacgtgcaatcctacaatgtggtttcatgttcccttcatttttcctcatggtgcaaatcacagacacatttacaaacaaattcacaactaagatgcttaacttggtcctcagcatgccagcatcctgtgtctgtggagcagaactaatcattttatgtcacttctcacttctcctcccctcccacttcctttgagattgcaattctgcttaggcaatgtgatgaatgacaatgccaagggtagataattttgcttttgacaatttacactttcacagtgcatcagcacaatgttttgtaaatgtttttggtttttagatcacattgacattaatcctctcaaaatatatttgtgtatccttttccactgtggtgaaggctcatttgaatggaacaagtttaaacactaacttaaattgaagaaggaaatatcttaaagaagaaaggatggagaggtattttccaatttatctttcttaaatcacagctagaattcaagtcatagaggagtaggagtggctaatataaatttttgtttccttttctttttttcttttttttctttgagatggagtattgctcttattgcccaggctgaagtgcagtggtgtgatctcagctcactgcaacctccgcctcctgggttcaagcaattctcctgcctcagcctcccaagtagctgggattagaggcatgtgccaccatacccagctcatttttgtatttttagtagagataggtttcaccatgttggccaggctggtctcgaactcctgacctcaggtgatctacctgcctaggcttcccaaagtgctgggattacaggtgtgagccaccgtgcctggcttctatttcttttttggtaaatattttgtcatagtgttttaacaataacccacaatgtaaactcatctcagaaaatttggttttggccattatagctgtaatttaacttctttcctaatgcatgtaaagtggctgataaatttcttattctgctcaagtcagcacttcctaaccttactatttttggcagtgtttgggactataataagattaaaccagtcttgctctgttcctctctgtctttctgtgtctgtcagtctctctttctatccttctctgcctctctccttctgtttgttttatatttccattattgcctgattgcctgagtacttacttgtgctagccactgtgctatttaatatgctgtacttcatttattcttcacagtaaccactgagtttgggattgccattgacaattttcagatgaggcaactaaggatgtacaaagttaaatgttacacaactgtagtaataataatgtagtttaataataagttgttatattaatgcaataataataatgatacactcaagattccaattcagaatggtcttcctccaggtagtaaccttaaacacagtgcaagaacacaaaaggttcagaaatcctcaaatagtaatgtgaatcaagaaagatacaggcttccatgtaggaaccagatagtcatgatcctaggccagcagactgaaggtaaagaacagactggtgataatcaatcatgcaagaggttagagagataaacatttaacttgaccagaacttgagagagctcagagctttgatgacaggtatctgatgtccaaaacagcacctgggctaagaaccaggattgtaggacctgttaactccagcaccttttctttgcacagaaaagataaaagaacctgattctgtagcagaaattttctgaacttgcaaaaggggatcagcacttactaagtactgatttatgtagtttaataataagttgttatattaatgcaataataataatgatacactcaagattccaactcggattggtctgcctccgggtagtaaccttaaacactgtacaagaacataaaaggttcggaagtcctcaaatattaatgtgaatcaagaaagatacaggcttccatgtaggacaattttctctttttgagcaccgtgcatagactagtatatgtcagcttatttaatactcttcacaaacatacgggaagcagctatactgcctatagctacacaggtagtaagactgcacatagatatgggtagcattgggaagcttgctggcacttaactgaatttaaaaaaatatgtgcgtaatagagtggtgctactataagcttgtaaaagaaaaagagctctgatagcttagaaaactttgagttttgttttttcttataaattgaaagagagcagggaaacagagtatggtgatttgggggaagaaactcttccatatattatttaaataacatctacttgctttgaaagaagtgtataccattcttcatctacgtttgaatgctatgtatgttgttgaatctagatatataaaccaccaatctgtctgcaactggaaaagtatcaggaaaatcagtaaggggaagacctctaatatcttttgatgagtaatataaaaagttaaaaacaggctgtttaaaagtataaattgtgcctccctaacactttagttttaggaggattctccataaagaacataatgcatttagaatctaacttgatttgtcaagtttctcttaagatttgaccaagaagaaaactgaactgttcctcaagtgtttgctaagactaaaacagaagcaaaaacaacaaaccaacaaaaaaacaaaacggaatccaaaatggtgaaactagccctggagtatattagaattggtaattaacttctgttgacagtccacagacaccttttaagaaaaactagtgactgtggcatccaattccctttgcttgaatctaaagcactactttgagaacttatacaaataacaccttttcatttcagccaggctcatttttgcttgtctaattattttcaatgtttttttatcacccaggctggaatgcagtggcatgatcacagctcactgcagccttgacctcctcaggcccaggggctcaggtgatcctcccacctcatctacctgagtagttgggactacaagcatgcactaccattcccggctaagttttgtattttttgttgagatgaggtttcatcatgttacccaggctggtcttgaactcctgagctcaagccatcctcccacctcgacctcccaaagtgctgggattgcaggcatgagccaccgcatctgacccttgtctgatttattaggctaaggtttctttcttctacagtggtggttttagttgtgctgttttctagcacaactttagtgggtgcagcagattcagctaatcaaatcatttcactccctggccctccacatgttctatgttacttctggaatctcacctggttcactttcttcctccttcactactctccacctacgcttcccatcaataccaagcaggctcctgcccccgagctgtcagtgttgcttctctgcctggaaagctcctctcctagatcttcctctggctagctgcatattcagatctcatttcacatatgacctgctcagagtggccaaccacatgcctcctcagcaccagtcagtatcactctattatattacagcctttcaatggcttttcatctgaactgtactttttaacttgtttattgccttctcctattaaaatgcagacttcaacaaatggttctggattgaatgggatatggtttggctctgtatccccacccaaatttcatctggaattgtaatcctcacgtttcactggagggacctggtgggaggtgattggattatggaagtggtttctcccatgctgttctcatgatatagagttctcatgagaactgatgattttaacgtgtggcacttgccctttgcttgcactctcttgcctgccaccaggtaagatgttccttgcttcaccttctgccatgattgcaagtttcctcaggcctccccagccatgtggaactgtgagtcaattaaacctcctttctgtatggattgcccattctcagtagtatctttatagtagtgtgagaatggactaatacaaagggagtctactggtcaaacaaatgtggagttggagtcatcaccatatatttcttatgaggaaatacttgaagggaatagtatagttatatgtaaaatttaaccagccaactcaaaatttactcaaggaaatttctggaaattgacttgaggtaaaatattttcttatgagattaccaagtcctatcacaaaattctcctattgaaatgaactcttaacctcaggttactttctgcttctgagaattttcttgaatttacattgattctcaatgacttcctacatgtaaatcactttccaaaaaaactagcagactattgaatgggaacagtatgtattgagttggtaattaatttctaaacatcagttaagaacactaaaatgaggaaaaacaactgtatgtaagttacatcacttaataagactgttaatgaagaaaaccaattcaattttaggaaataaatcagcttatacttacaaatatttaatattcaatgcttttactgagcaactactgtgtagccaggtatttttcaggcactagaaatacagtggtaaaaaaaaaacactattcctttgttcaatgaagatatattttagtagggagtaaactgcaagtaaatataagaacaaattgtgatacaatggttttttaaataaggggaaattatgaggggaggagttagaggtcaagatatgctacatgaacaaattatgtttaattggaatctaaaggttttacccaagcttagggtggtagttataaggttctagtggaaggaggataggggagtaggggaagacgagtctagtggagggaagagcaaaggtgaaatccccctcccattctaaggcagaagaaagactgactggattgaggaactccagcatggctgcagtaaagtgagcattcgaggccccaaataaagagagcaatccacgtttggtaggcaaaccaaataaggtagagtgagtgacagtggctgttgaacatacattatgatgtgtggtttttgtttttgggttttgtttgtttgatttttggtgataggcctgatttgatcagctacctctgttttcttttacaaagtcctaatgagttcatttatttcatcatttaaaaataagttactgaataccttctatatgcaagagagtacaatatgtgatgatgacatctagaaatggccaatcacatctgaacatttacaatctgagttatagaatacagaatagttatgttcatattaagaattgctttatatttaatagccttgggttattgggttaacaggaaaaatgaaagaatctacaaattgttctcagagtttataatttggaccaaatatcaggctccaagtctcacttccttaggttgaatcctgacttcactgcttcctaattttctgtgtgtgggcaactgcattttttctttaagcttcagtttactgttttataaactgagagtaatggcaaaattcttacatggttatctacagaggaggggataagagaggtaaagtgacagaatagatattacatgaaatagaggtctaatgtatggcacataatattgacttaataaatagtaagcattatattttactccacacaaataactcaaagataattttttattgtaatcctcagtttgaggacatgtacttgatgtttctcgtacttgtctggttgttggaagtaccagacataatcatttgattggtctgtggatacggctgggcaactgtagttgttaaagcttcctaggtgattctgctgtacagtgatagttgcaaaccactgacctagaggctgctggaggatgacaacatcctgctcccctctgcgtcctgacctacctcagtaagaatttaagtaagtggcgaaatcgccaaagggcaggtaaaagaaggtacacactggggtgttacaggaacctgatagatttatatagtgtgtccttagggccctgtttgtactgtattttcagtctgtttggtgagagtttctaaccagatgtgaatattcagtttccctcatccctgggatcccattacatctttgcagaattcattgacaccaagagtggaaattactctttaaagtcattaataggcacactgttgcatcataaaatgttaatacatttaatagtctcccagcatcctgaataaagcctatgtatttctgaaaatgtctgatggacttgaaggagtatctgacatggaagattttagactaaagatccctctgctctttcacaaaggatatcctttccccaactatgctagataaatcttcctaagccatccctttgattatgtcattctccagtgcaaaaacttccaatggctccccacaactgcaggaaaacttctaaccacttgaaaatggctttcaagtttcttgactgcctggatcagtcatcatttatagacatgccaatatttttctcttgctcaaaccctgtgctttagccaaatgatctattgactgcaccctgaacatactttgtgcttttcgccctctatatcaatgtttctcaaactttcatatgtatacagatcaactgagaatcatgttaaaatacagatttgggttcattagctggagtagaagtgcaatgaatttcttcatttctaacaatccctcaggtgttgtatgtggtgctggtaccacaactccacttggggagtaaggctctacgcataggttaataaaagctgtcaggcagagcaagactccgtcttaaaaaaaaagaaagctgttaggtaaaccagaataatttattgtctccacgttgcgtatttcattcctgtttattttcaatgtttatgtgacaaagttattaactgagatattaatttttaactcctcatggtatctctccttttcaatccattttccaaaaatatcatggtcttgtgtgaccccttctctccggacaggtttgtgtttctgggccatgagaaaggtggcttgcaagatgcatcctggtctggtttggttttcctacagcctaagacattcaaaaaaatgttgctggatttcttggggaagaggaaatggtctggctctttgaggagcagacagcagtgaggagactcctctagcctagaaggggatggaggtttgaggaggctactcttctgagggatggctgtgtgttatacacacacaggttactggaaccttgagaacacagctccaaagcttgccagagaagtaagtaccccaagcttgacaagtaaactgtagaatcttgtgcattaaaggagagaagctgctttgtcccaattttagagcaaacttagaagctctgcaaaaatggggctggggtggaataaaaaatgactgataaattagatgccccacatgttggggaattgtaaaaggttttaggtagaaaagaaattgatattccttttaagcttcaatgtttgaatcaaaatccatatgtgctaaacttatttcagatccagtatcctcctgaaacctgctttggtgtacacaagggcatcatgactgagggaagcagacctgactctgggatcaaatgagcccagtttgaaattttaatttgatatatatgtgagtgtcagaatttttatttgcaaaaatgtggctaatgacatttatttcactggattgttgagagggttagaaatcataaatatacccatgttgcatgtggtgtatagtcagtaaatgctattattatagctattgcttctttactactacctgtaacacttttactatgatccaagtagcatttgaggatgtcaaatgcatccaaaaaattcctaaaattgtgttgtctacataattaatttgaatattattaataatctttgatagtaaccagacactaataacttttgatcataatgatgctcgttaatttattacctacttttaacagttatttcccaagtgtctcagtattgcacctgcaacataaactctgaagcaggagattataatttgtacttcttggtaattcattgatgtttattctagtgtctcatatatagtagatactcagcaaatccttggcacctggtattgcaaaactatgacttctcataatttagtagaatgttaggggacaaatattttcaataaaatttttgcaatgtggaattaggaaaagtactgcattttaatctacattacttccttattgcttgaacaactataatatactctcagtctgaagcaagtgagcttcatgcttcatcacatccaaatctgcttatgttttgtttcttacgaagtaggctgaattttaaggtagatgcaactatggaaactccagagtgggggcaagcagaccaatgaagagaatcattgtttctttatctgttgtataaatatttttgcagagcttttgaacccagaatatcaaggcaaaagccattatgctctttaatttaattaaataggattcaatatttttcaagtaatatcctgatatatatttcaggaaaatataacaaagaatcaattttgtagaattcagttagctaggggttaaattctaccctagcaacagaaactttacagctgctgtcagaaacagtaattactctggtcaatattctctaagaaactccagctgtcttatcaagcttgctttgtcagaaagactcctttcctgttaggggcatcagttgtagaataaccatgatggtgccaatgaaagagttgaaaaaaatgttttagaagccataatgtggcatatatatatatatatatatatatatatatatttgttttttgcttaaatttaaagttctgataatatctactgtgcttttagacaatcttccactgaattttaaagaaagtacaaaaatgagaatttttctctttgaaacaaactcctaagaaattaatactaatgatggccttcaatgcaaatttcaacccacctggcaaacaaagctgaatatagtagcaacttatatcctggaggctctaagatgttatcacctcaatgtgacatcctatgaataggagcttagctttaaacctagtcagaggtcacaaatgattcattttgttcatgtatatattcatgggaattctcatcattcttagagatatggttcttcagaggtgacttttagctcatacaattacttatcatggtatttccccttttctactggtggggaaaatttaggaaggaggaaatagggactaatgagcctatactcaggtgacaaaaagggatatatgaggaagtgaatgagcggttggtgttaatggaactgattagagtacaattagaattgaaaccctatgttatagcacttagcagtggaaagtttcagtagaaaactagagctaattattaccatcctcattttacctaaaataaaacttcaactttttaacctgagttaatttccatgatcgatgcttaaatacttttttagcatcgtcctatgccatgcttagacactgagaccttttttaattctcagacttaccaagcctgttcttaacttaggcactttgagctagatgtttctggggttttctttctcacattattgttccctctgtccatgttgccatctcctgatctttgtatagctggctcctgcttacaattacaatttcatcttaaatgcctcatctcccaaggggtctcacttgatcatcatacataaggttgtcatccactaggtttctatctgccttaattatctatatgacacttactattacttcccccttctaaatatacttgattattatcttcctccacttgaagataagctctgcagaagcaaggatctggttagttttattcactttgatatcagaaattacaatgatgccaattattagtagacacttactaaactggtctttgaaggggtgaatgaatttaagaacacaagttaccttagagatttttattcatggcatccttaaattgaaatccatagattacataaatattttcatatgaataatactttcttttctcagaagatgagccatggttttcaacagagtctcaaaggggtctcaacctattgtttcaagtctcaagctgggtttcccagaagtggtgctgagatgagaaatcatgtaaaagtggtgtgttaagaagtgtttttaggaaaaacaagttgtcaagtaggaagcaaggctgggaagggaaggaagccaagcaagggtgtggcatcaaaccaagtcccactggggagctttagagacaagcggcctcattcagagctgtatcaagggcctaatgagtttatacctccacatccttagtcattggctcatggtttccctggggaaaaggagggtgtaattccggctctttcagtttgcacataaagcggtatcaggaagcctgagggtggccctgcaaatgaagggaggtgagttctagccattagcagtaaaatttcctgagatctcatgttcatgttcctgagatctcataatcatggaatcatgatcatccatgtttcagaggctatgggtggaacactcacagtatatgctacagctccttcaaaagaaaaacaagtggtttaataattatcactcagtctattataattccctcattctataaattgggaaaataaattctactgaagtgaggtggttttcttaataatactttggtaaactttgtttggatcagatccaagattgaaagactaccggcctatttattcattactgaaaactctgtaaataattacacacatatatacaaatagatttttattaaatgtaagatttcttcccagaagttatggaaaatacaatatcaataaattactaccatcctcagtgactctgtagtgcagtcagacaaaagatatatatcaacaatgagcactataaaatatgatcacataagaaggaatacatttttaccgagatacagagcagagagtaatcacatccagcttagggactcaaggaagagttcaccgaagttaagacccttaacctcaacatatctttcttgttaaaagaaaatgtgtccatttagagatatttgaatgagtgtctactatattctagacagagtaatgagcactgagaatatggtggcaaatgaaaaaggcaaagttcctactctcctctactttatatgtatttggataaagaacaatgatgaccaggaagaatgacaaacaagagaatgtcaaatactgacaagaactataaagcaaggaaaaatgaacagaagtggagggaggaaagttgacactagtttagatgtagtgattagggaagattcctctgacactaaaaatttgaattgagacctgaagaatgaaaggagccagaagcagagaggaacacgcataggagaaaagaaatccaaatataaagggcaagttcaaaggctctgaggcatgaacaagcttggaataatcaggaaataaaaagacagttaatttgtatttcagtagtcaaagaggaacccagtaagagattattttagagagattggcagggtcttgtagcccagagtgaggagtttgccttttaagtgcagtggttaaacatgacattgctcatgttttaaaacctctgtgtaccaactattagaaactggaattaaaattaaaaaacatactgtttaattagcatcaaaaatttattagttatatacgtaacaaaatatgttcaagatctgtaggaggaaaactaaaaacaacaacaacaacaacaacaacaacaacaaaacactgatgagagaatcaaagagcttgataaatctagaggtattccattttcatagaccggaagactcagtgttgttcagatgttcttcccagcttgatctatgaattccatggtatcctaattaaaattctagcaagctattttgtagataacaacaaactgactctattatttatatacaaatataaaggaaacagaatgaccaacacgatgctgaagatgtaaaacaaaattagggaactgacactatcctactttaggatttactataaagctgcagtaatcacaataccttgttatcagtgaaggaataaacacatagatcaatgtaataaaatagagtcttcagaaatagactcatacaaatttggttaacttatttttaacaaagccaaaaggcaatttgatggaggaaggataatctttttaaccaatgttactggaacaattgaatgtcaatataaaaaatttgtacctaatcacaggtattacatgttacataaaaaacaattttaaatgacttagaaatttaaatgtaaaataaaaaatataaaccttctagaagaaaccatagggcaaaaaaatctatgtgaacttgggttcggtgatgacttctacatacaactccaaaagcataattcataaaataaaaatatgataaattgaactttattaaaattaaaaactttaactccacagaagacaaagaagatctctcggtttctaatactattttccaatgaaagaacacagatctctttgaataaaagcctcttccaaggctggggcaaggtatatacaaactgagcctaaagcacattgtagtgccagaaagtaaggaagtgctgaacacactcacacaaaaatgaaatcaaactcctacacaatgatagagtatgccaaaaggcatagaagccaactgacagagctcccaatggccaaaactggaacaatttgaggggaaaaataaataatatactgttagattataacacaaagtataaaataaatatcatttaatctgtacttatataaatggttaaataaatgaatgaatgggaaatgagagacatatttcctttgcagatgaattccaaatcctttttgtagatactccaccctcaagtcagggttgggtggagcataattctccaccttcctgttggctgttcatggtcaattcctttcaaagagtgcagtatacgaaggaggaaacagagtacaacgatagtggataaacccgacagacacgacctcagctaggtaatcacagtttagacccaaagtgatatcatcatgttggtatcatgaacccttgctatgatgtgatggcagtggaacctgacctctgtagctcttccgcaaaaccttagtttaatcataagaaaaagaagaaaaaaataactccaccaattcagggctattctacaaaatgtctctccaataccctcaaaactctcaaagtcatcaaaataaatgaacagaaaagtttgagataaacatatcaactaagtgtaatgagatatcctggaatcaaaatggaaataaagtaaactgtaaagaaatatgaataaaatgtgaacttttggtaataatgtatcaacattggtttagtagttatgacagatgtaccatactaacataagatgctaatgataggggaaactgggtgtggggtgtaggggaactctttttactatctgtataactctcctacaaacccaaacctcttctaggacaatgtttactaaaaattctgtggcattataaccaaaaataggaaataaaagtccatctgacgtaaaatggttatgcaaatttaggtccacgctcatgatggaatactacactgcattaaaaataacacacttctgatgcatgcaataacacagatacatttcaaagtattttgttgaggatagaagccagagaagccagaatcaaaagaatgcatactccatgatttcatttatataaaattcaagaataggcaaagctaattcatgtaaaagtaatcaaaatgatgattgcctctgaggggtagggattgaaagaaggcatgagagaaatttctagagtgttggaaatgtcttgtatctcaattttggtagtagttgatgaagtatatatttatcaaaactcattgaattgtaattttacaatctgttcctttcatggcatgcaaattttacttcaaaaatgcctacattaaaattctataaaaacacttgggctactgggaagagaatgagtttcagggagcaaggatactaccaaagagatcatttaggaagctacttcagaagtctaagagagaagtgatggtgacttttcatcgtgatataatagagaatgagataaatgtatgtttttagatatatttcggagctggaggcaaccaggatatactgttttagtagatagaaaaagtagaaattcttatagaaagaacactgagcttaatcgacaaatccaaatatgagcttcagctttgctatcttttcaattttgtgatcatccacaaataacttaatctatctgtgcctttaatatctcatttttaagtgagctgattagacccattctaggtagctcacaggttacagaatgtgtatgtggaaacagtttgtacattgtaatatatcacttatgttaaacttactaaatacattacataaggaatatgtagtactggaaaatatatcatggattacttaatcatcaaccacaaacagataaactattctgacttaaacagctctatttctttgcactaacactctatttatttgacttactacacagctcaatttctttttagttgggataaaaatctcaactatggacattaagaatctgagactacagatcagaaaaaaaatgttgtgtacatggtaagagatcaaagttgcagtactgaggacattttgttatacagtgtctaaaagttcaaaattccatggacagatcttactgagacatgatgacacctcaaataaactcagtttagtttacatctgtttgcaagtaagcacggaaagcattcttatatcttcagaacgatttaaccaaggttatgccactctaaatctatgctcaaaactctcatgataaatccaagagaacagccaatcaaaccttagtctactaaggtttcctaggagacttacacgcagttagagaaatggattgtacacagttgagaaaaaaaaaatgctgcagcaatttcaccttactgaaactttccctttctaaaaagatcacacacacacacacacacacacacacacacacacacacatacccctaattatttggaaaataaaaaaggaccatcacagccaagaggcaaaggacctgaacactcattagaatctatgagtaccattgtcttctatactatggttgcagatgataatactgcaaatagtgatgtgatttgaaaaaatgtgtttaacttcctaggaatgctccttgggatagcatccatgttatggtctcattctaaactgggaattgttaaattatattcgtacaaaaacctgattgggtgggtattcaaaaatgtgtatttatttctttattctcagaatgtagaaagtgctcaagacatagtagctgttaagtaaacctggttgcattatttgagaaatagcactgaagttcctgattttataatgtcctattctatcctcaactcaaggcacactcatgattagctcagtgggtgaccaataagcatcagtattcttggccatttcccctttcctaatttgactccactgactccatatctagaatacaatcaatttgcctagttaagcttaagtagatgaaatgaatcccttcctctcaccattatattcccgtatgtggatttggcactttgagaaaaggtgaaactgagtagttaattcatctaatacatatttatttagtatttagtatgagccaggtaatggaaatgttgattggtatcctaactaattttgtacaaatccttaacatctaaaatttattgtaaattgtgcctagacaaatctaatagacttttatagctagaaagaactctgctggcatgtggcaagattcaggatttctaaatccttaagtgctatctcatcagcaaccaccatgatagattagaaactgagtgatgcacacagaaaactagccagccaaatgcattttctttgttactagctaagatttaactctcagtcctacctgtgtgatctgttgccctcatatgccacacgtgtgcctctagaatttctaaagccaggttgagttatcaaatctagcctagaagatggttgaagtatcagaatataaaagttgttagatggagttcatatctgcttgtttacacctatattcagagtgcccagcactgaagctgagtttaagttttgttgggtgaagacatgaaggtaaactgcttcatgcttcttttccttagaatctcatttcagtaggccaggagaacagggacactgattagggatctgagaggaagccctgatctccatggaaggattagatgaagtcactactattcaacagccatttattgtaattccttcattgaatagatacaaacaattattccaggaagggcaatgtttgctcaaggtcattgtgttagtctgttctcacgctgccaataaagacatacccaagactgggtaatttataaaggaaagagatttaattgactcacagttcggtatggctgggagacctcaggaaacttatatatgtgatggaaatgaagccaacatgcccttcttcaaatgacggcaggaaagagaagaaagaatgcctagcgaagggaaaagctccttgtaaaatcatcagatctttgtgagaactaactcactatcatgagaacagaatagaggaaaccacctccattattcagttatctccccttggtccctctcatgacatatggggatgtgtcagttcaagatgagatttgggtggggacacagctaaaccatatcagtcatatgtctaatttgtgggatattttcaaaacatgttccattttcctattgcaccacagtgtgattgaaaggaattaacagacagattgttggatgatgaaatttggtgcagcctctctgaaaggaaatatacttgattgttcagagggcggaatctggactactgagagtaaatatctgcatattaatgataacaaaaaggtaataaaactgaaaaacattcattcttatgatttttaaatcacactacatttccaaatgttctgtggatcttatttttgaaagttttctatgtaagaatacgtaaagagaaatatctagagtgatctacaatgaaatattttcagagctccctgggaagtaaaatttttggtcatcacatacttattgaacaataatgttgattctaagaccatttttcagcaacatgtttattacctgtattaggtctaagataaatatacgaatatacaacctcatgcatatagacatatgagtttgtgtataatacagtgcctggcatatagtaggtgtttaatgtacgttagaatggtttatatgtaattatgcagatatacaaacattcatgcatatatacaaacacactatatagaattgattgtactgctttcagagttttggattttatgaaaatcttaaatcttttatttggctttatgcatacaccaaaagatatatcaaaatgaatgattttaaaaggaaaacaaggctgcaaatgaaaagtaaggcaggactgctgctcttccaagtatagctcaccaaagcaaaaatcactaaagtaattacaggcttgattatggtctttaaactgtcaaaatattcaattccatatactctctattttctcctgtttgtggattgccaaagatagagggaaaaggatagaaatatatactgctcaatatagctattcttagatgattctctcaggtggttaatcactgggattaattagcaagcagctactgtgagaacttgatctttttccttcattcttagtcttacatcaccaggtattttctaaaatcagcctgagcacatccataaattaagtatcaaagcttgtcactgagggaagaatactcacaggtatccatcctgacagtaggagtcgcgctttgtgtgctaagtgaggcggtgactcgaaaaatacatttgtttccacccacgccatctcccactgacaaatgctgttcctctcagggccaaaattctagaattatatttcaacaaatagatttactaaaaaaaaaaaaaaaaaaaaaaaaaagaaaaagaaataagagaaaattaaaagttaaaaaaaaactgccagagttatagcacctgcctaaaattggttatctagttgttcccctaccccaaaaacagtactttctaaagcaatctagtgttgctgtctcaaaccagggcacatgtctaaatgggcccatagttaaacacatctggtcatagggctggtagacttgctggaactatataaaacatctattcttttataactccaaatgctcagctggttaagaataccgcctactttctgccacctcaatctggagcaccatatcgagaagcttctctaggctttcaacacataaccaactagatacctgaattggtattaagcattatcatcatttttatctgtgttttttacagacagggtctcactatgttgccctggcttatgtggagtggctattcacaggcacctgcaactcctgcgctcaagcaatcctccttcctcagcctcctgagtagctgggactacaggcaggcccactgtgcccagttcaccatttgttttttaataaacatttttaagcctgtgatggagccgtggggaggtggtgagagaacgagggatggggacaggtactaccaaatatacatgactcatttcttcttcccgcatgtaccttatcgttgaataagtttattatttgtcaatcatattattaatttatatatccatgattttgtgtagaacacctttacattgtacataaaaatacagaagctgaatattcattagtacatgattgaaagaaggctgaataattgatatcaggtttcaaagaaaaatggataactggaagactaagaggtaatactgaaaccatctaactaaaaagaaatagtcactgagtgcatatgtatgaggaactatgcgagtcactttctgagagcttttgttttctccattatttcctcctctgacttgcttatctgtaatggttatctggattagaaggttgaatatttttgagatcacagagagtcaacctgaatcacagtcttcagaatggaagaacagtcagagggcttccgggaaagaaccacaaagtcatttacaaagcaagatctatttgcaagcctttttccttttttgaagcatcaggaatgatgctcaaataaagtagattcaataaagtagataaagtagctctcaataaagtagattatttcaataaagtagctatttcaataaagtagctctcaataaagtagattcaatatgtggtacacatgtacttagaaactcaaagtgctttgcaatatcataaaatattcccacataatcacagtatttctgtttgcaattattttttaaggaagcaaaataagtatttaagggggagagaaattatttcatgtcacagaataaactaggcactcaagtttctgtttgattgcccaggtttctgcttcactgggcaaggcatcgtaagtgtggttatgaaaacctcaaaatcatttctgtgtgtaaaacacaacttaactgaaataataataatacaacataataaaactttattgagtctttcatatatctgccaggcatttatgaaaagaatttcatctttatgtaattttacaactagtttgtgccaatgatttgggctgcccttcaaatatttccaaatctcctccaaggcatatgataggattacacatttctgcccccttcaagttgagcgaggccatatggctttcgttggcccccaaaatataagcagttaaaaccaagtcagggcacaattagctgctcacactttccctctgccctggtgatcaacaaaatcttatgtggtggctactctatcagcaaaagtttctgagtgagaaggaatggtgttaaacccacaactgacccactaaggacacgtagcataagtgaggaaggaaaacaaacaagactgtgttgtgtcagactgtaaaattttggaatttttttgtcactgcagcataacctgtactagcttatcctaattgataggttatcaaatagatattatctacatttactgatgagaatttgaaaactcaaataatacttataatatggcctaggtcaaagagtcagtaaaagagtgaactgtgatttgaactcaattctttctgactttagagtccaactcatcaccactaaacttatttcactaactttattgcttgcaataagtttacttttatgtgatcttccttagacttagtggttctaggaaagacttgtttttgacactgtttcattggaatatatttttaaagctaagctgaaataataaaacatatcttctatagcactttatgatttacaaaacattttcacatatattgttaactcattgtttcctcacaataaacctgtgacttaggcagggcaggtatattatcccactgttacagctgaagaaaatctaggtagcaaaaaatcaatagctaattgatattccaaggtcatatagctaggcaatgacaaactctggaatcagaaccccattctcaagaattctactttagtaatagcagcaggagggatgtctgtagaggctgattcctggcacaatagagagaagctggttgttaaactcagctctgcaatttgcaatttcattttgccatcagggtcattgataacattttcaaagcactcttcatcataatcagtggtaaaaatagcattgattaataatgccataaaacagtagagcaattcaagtttagatagtaaaatgataacaagaagttaacccaaaccgcgtcctaaacctatagggacatactttataaatacagcttatttctgatcctttaattatcacctgtgtccagacacactggatcgtgtctataatctcagcactttgccaggccaaggtgggaggattgcttgagcccaggagttcgagaccagcctaggcaacatagtgaaacgccatgtagaaacgaaaaaatagctgggtatggtggcatgcacttgcgatcttagctatttgggaggctgaggtgggaggatcacctgcgcccaaggaggtcaagactgcaatgagccatgatcacaccactgcactccatcctaggcaacagagcaagactgtctcaaaagcaaacaaagaaacaaacaaacatcacttgaaaatttctaaaagacatagattatcaataaggaaaaactttatattgtccagaaaatttgctggatttttgtgtaaaagcaaacattctaataatttgacaatgtgactttgctgttatttttttaacttaaaaaaaagcaatttgtcccattgataataatttcaaaggtttatttcaatgaagggttattcatcactaattaagaatatgcttgattaaatgttttataacttcattttatttttattttatgtggctaaaactattttttcagcctgtagttattaaatgtggtataataaaaaattctgaaagtgccacaagaatatatgtcaatttcagcctgatggtgcttacacttttatagaatgttgacagaatcatttttgtaaatgttgtctggaaaggaaatgagagggctttggggtttttggggtgctgtcccctttcaattttgaacaaaagatattgtttcactaggctaacttcacagcaagtagctgagtcagggctagaacccagaattcaaaaatatttgtctccctgtcattgaatcacactgtactcaaatggttagctctctcttatgttagtatagcatggcttaccagatcatctagggttgttaacatttagtcttacatcacagagaagaaggctggaatattttatgtaataaactccatttgtagcaccactggaatttcaaatatcgtctgaagccaccaacagattagcttcagacatagcaaaaacttaggactgaggcacacattttgcagttctcttgaataagaaagtttgtatccacattttaagtgtcagacacgttgctaattatgattttagcatgtctctgatgaagggagtaaaataattctggtaaatgcattgaactcgtatgttgcatgattttccttgatctctttagatttgcaaaagtattagtatacaggtcttttgaccttgttcttgatgtatttttaaatgacatttataattctcatgtattttcttaaatgcatatgtttgtatttatatcgatatagacatttaatttgtatatacatctacatctgtatctatatatatccctatatacatcttatatatacaggtatgcatagatacatacatatatagataattgtgtatgtaaatacatatatgtatacaaagatgtatatatagacacatacatatagatatctagatatagactatatctttacatatacagacatagatatacacatgtggatacttatatgcttatagagatgtagaaggatgtattatgtatatgtgaaacactgcaagcaaatatcttgaattaaataacttccatccctcaaggcctgcctcaaatgttaaattcccctaaagagcctcttctccaaatggaaattgttgctgcctcctttgagcctcttaacagtactcttctcaggaaacttttttcaatcaactttggaataatattaatgagagctcacaactgttgatgtgccaacagtacctaattcactttatctccaactgaaatctgagaagtagctatgttattctcttcatttgaaggaagagaaaatctaagacaaagaagttgagagactttcccagtatcaatataaaaaaaaatgcaaaggaggaatctgaactaaggtctgtctgactccaatgcttcatgtattgtttagtctcattaattaattaattaactaattcacattatttattgaggcttactaaaggctgtaccaagttctaggcagtgtggtaggctgaggctccagtgttaagagtacatacatgcagcagcaagcatcctaacaggaagccaaaaccagggacatctgacaggcagaaactgacagttattaattaaaggattattaactctattttaaggcaacttcggcagctacaaagtgaaacaggaaatgtttgaaagaagagttacagagtacatgtccccagttcttcatataaactccaactaactgtctggataatcatgaactatccatgtgtggaacagaatccaagattactagctaagacaaatgaactgaatagaactctcagagataggaaacagtgtacagtgtttgagttcagcagcctacttttataaattttacattcttgagaagaccagaatagaatccgcagtatccgtaacaaattattgacaatatttgggatacaatccaaagtacaatgtataaagaaactgaaaaacactttccatactcaatacaaaagacaatcaatggagactgacccaagatgagccagaatttggaattggcaaacattttaaagcaaccattataactatagatgtaaatgacagtaagatcataaacaataaaaagcctcgagaggctgaggtgggaggattgcctgagctcaggaggttgagactgcagtgaaccatgattgcaccactgtgctccagcctggccagcagaaaaataaaagctatagaaagaatcaagtggaaattagaggaccaaaaaacacaatgtctgaagtataaaattcacttgatatatttaaaagaagatttgagatgacaaaaggagatcattaagatagattcatagacatatccaatctgaaaaatggagggaaaaagattggaaatgttgagcaggaactcagagatttgtggagagatagcaaatggtctcacatgtgtagttgaaggcctagaggagatcagaaacaaaatggaggagaaaaaaatttcttaaatttgatgaaaggcaaaaattatgtgtttcagaaaactcagcaaagtctatgaagtataaatgcaaagaaaactacatttggtttatcatagttaccttactgaaaaacaaagatgagaaaaatatttaaagtagctaaagaaatatgacacgttatgtaagagagaatcaattgtctctcagtcaaaaagatatcaactattgctgaagaattatcagaaacaatggtggtaagaagacagaggaacaatatatctgaagttctgagagaaggattaaaaatctgtcaacaaaaaattacatatataggctgggtgcggtggcttacaccagtaattccagcactttgggaggccgagacaggcagatcatctgaggtcaggagttgcagaccagcctagccaacatggtgaaaccccatctctattaaaaatacaaaaattagctgggcatgttggtgggcgcctgtaatctcagctgctggggaggctgaggcaggagaatcgcttgaacccgggagccagaggttgcagtgagccgagatcgtgccactgtactccagcctgggtgacagagcaagactctgtcaaaacaaaacaaaaaaaataaaattacatatataaaaatatcactacacaatgaaaattaaatacaaacattttcatagtaataaaatctatatgtgtgacttgcaaacacgcacgtgaaagaaatgccacaggaagttctgactgaaggcaaatgatcctggatgaaatttgaatcttcagaaaagatcactagacatcataaatatgtaagtataaacacgagaaaatgcggtatttggttttctctttctgcattagtttgcttaggtaatgacctccagctgcatccatgttgctgcaaaggacaaattattcacgtgtagaaatacttttttttttgctgtgtaggtttcatggtgtatatgtatcacatttttaaaaaatcatatccactgttgatgggcacctagattgattccatgtctttgctaccatgaacagtactgcaataaatgtatacatgtgtctttttgctagaaagattattttcctttggatacatacccagtaatgagattgctgggctgaatggtagttatatttttaattctttaaaactgctttccaaaaaggctgaactaatttgcattcccaccagaattgtacaaataagtgttctcttttctccacaactttccccaaatgttttattttttgactttttaatagtggccactctgactgctgtgacataacatctcaaggtggctttgattttcatttctctgaactttagtgatgccgaacaatttttcatgtttattagctgtttgtatgtcttcttttgagaagtgtctgttcatgtcctttgcccactttttagaggggtcgtttgctttttccttagatgatttttaagttccttatacataaatcctggatattaatcttttgtcagatgcatagtttgtaaatattttctcccattctgtaggttttccatttgctctgttgagagtttttttgtttgtttctgtacagaagttctttagtttaattaagtctcaattgtctattctgattttgctgcatttgcttttgaggtcttcatcataaattctttgcctaggccagtgtctagaatactattttctgtttttctctagaatttttatactttgaggtcattcatttaagtctttaattcatctttcttttttttaattattattatactttaagttttagggtacatgtgcacaatgtgcaggttttttatatatgtatacatgtgccatgttggtgtgctgcacccattaactcgtcatttacattaggtatatctcttaatgctatccctcccccctccccccaatccacaacagtccccggtgtgtgatattccccttcctgtgtccatgtgttctcattgttcaattcccacctatgagtaagaacatgcgctgtttggttttttgtccttgtgatagtttgctgagaatgatggtatccagtttcatccatgtccctacaaaggacatgaactcatccttttttatggctgcatagtattccatggtgtatatgtgacacattttcttaatccagtctatcattgttggacatttgggttggttccaagtctttgctattgtgaatagcactgcaataaacatatgtatgcatgtgtctttatagcagcatgatttctaatcctttgggtatatacccagtaatgggatggctgggtcaaatggtatttctagttctagatccttaaggaatcaccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatccttttcctcctttttgatggggttgtttgttttttttcttgtaaatttgtttgagttcattgtagattctggatattagccctttgtcagatgagtaggttgcaaaaacctactcatctgacaaagggctaatatccagagctaatatttgtatatggtgagaagtgggctacaatttcattcttcttcacacagttggccagttttcccagcaccgtttgttgaatagggtgtcctttcctgcattgtttatttgtgttgactttgtt

SEQ ID NO: 580 - DNA, 40001 bp, Homo sapiens
ccccattggccgggggcgggtcatacaatctaaactaatgccagttggctaaacatttgatgtttttagatagggtgggcacataaaagaaagtggagggaaaggggaaggggtatctgtaatgagccagaaagttactcctctttccaaataaggaaaggaatgtgagctggtactgataacgcttggtactgtcatgtgcctgggcatttaacaaaggcaagaaggaaaaaaggagaaaaatgggggatactatgaattaaagaataaaagattgatcagattatttgaagagaaacctcatcatatcccacagtggtttcaaaaattttaaagaatatgacataaaaatactatttctattttaaattcaaggtgctcaagagttcaacacatccatttcctatgaccaactcactcagtttctcattatgttgcagttggatttctgagataccaggatgaaccaggtgagcctatgcaaagcttatttgacactgatacttccaggacccagcacctcttattagcatagttgaagcaacagagaggacttcagatgttgccgctaagtttttaaaattatctttcattgcttattgctctctaaattgtggttcctttaaaaatatagcattttcagatatagcatttcctctggaaagaattaggcatattccaccatttcattcccatgcaaaaagttaaaaccaagtataggcccagttagagaggggaggttagataaatgtgtattggatgttttgttcttctgttacttcccccttttacgtgtttaagatgaaagagcactggcttgggttctgcagacctcatttcaagccctggcttctgcgactccatatttctgtgctttgaaatgttgagtaatgaactggctttctatttccttatcaataaaatggggataaaagatctatcccactaactttatacaggtcttggaaataaaaataaaaactcttgcaaaatgatcatgtgttacatgctgccacatgctggttccatgctgcttaggagatacttggtgcctccttcaccttctacacctactccttctacacctacttccttcatacctttctcccccattcagattttcctcacttttctcacctctcaaaccactaagcacagaccagcctccatcttcaggctatgctaaaactgtccaggccaaggtcaccagtgacttctatgctgtatcaatctactggacattttcagtcattatctttttagacatctcaacataactgacctctttcattaaagtctcttcattacggtctgctcttcatgctccctgttttttttaccagcctttctggcagcttcttctcaaccctctttgctggcttctctgtctgttaatttatatgtttttaagtttcccaaatgttctgtttaaaaaagaaattagtagagatataaagttgtttttttatgtaaccttccttcatgcagaagaaggttcctttttttgtttaacagagaaaattcacaagtattttatactttttaaaaaaacaaaaatgtacatttaaatattacttccaagacaacacattattatgcaaaactaatgagatttgcagagattctagaggttaaagattattttcataggacttaacaatatgtgaagtcctagtgtgtcttacaagaagttatgatgtaaaatataatctgcttttctgtagctacaagaaaaggtgggaaattttctacttgtgtcactaacatttcttgcaccagcaattacaggcacctatgggttgaagactaatgctggaattctgtcagttagctcaataaacaaaagaagcatgactaaaaacgtggaacttaaaatgtgagggataggggagaagagaacggaataaaatttttaacaaatgaaatttttttgtttttttttttttgagacggagtcttgctttgtcacccaggctggagtgcagtggcgggatctcggcttactgcaagttccgcctcctgggttcatgctattctcctgccttagccttccaagtagctgggactacaggcgcccgccaccacgcctggctaacttttttgtatttttagtagagacggggtttcaccgtgttagccaggatggtctcgatctgctgacctcgtgatccacccgccttggcctcccaaaagtgctgggattacaggcgtgagccaccacgcccagccaacaaataaaatgttatcattcaatgcattgtatttctttgggccagatctctaaatatttcagtcactctgtgctcagtaccagaccccctactactgttctttctctgtaccccttctcagatgattccatcaattcccgtggccttaattaacttttctttgcaacttacttccagattacacctgtaacctaacttttctggacttctgacaggtattctacagctgattgcttggcatctcctattagaagactcacaagcacctcaaaattactatatccgacacagaactctttaatttttgtgccctatctcctttctctttccttgtcattgacatctaactatggcaccctcattcatctaccaagtttttcaaagcagaaatctaagagtcacctttgatttttctctttccttcatgttcctccaaatttacccacttcaagttttatcgattatccttctaacttatgtcttccttagatcatcttttcttcagctctgcagccattacccaagtccaggccatcattgtctcttgcatgggctatggcaataaccttcaaactggcctcttccttttgcccttgccctcattcaattcctttttcctatatcagtcaacatgatctcttttttttttttttttttttttttttttgagacggagtctcgctctgtcgcccaggccggactgcggactgcagtggcgcaatctcggctcactgcaagctccgcttcccgggttcacgccattctcctgtctcagcctcccgagtagctgggactaccggtgcatgctaccacactatcaggcctctgagcccaagccggcaggtatacatccagatggcctgaggcaactgaagaatcacaaaagaagtgaaaatggccggtttctgccttaactgataacattatctcgtgaaattccttctcctggacaacgagtatcagaagctccccactgagcaccttgtgacccccacccctgcctgccagagaacaacccctttgactgtaattttccactacctacacagatcctataaaactgtgccacccctatctcccttcactgactctcttttcggactcagcccgcctgcacccaggtgattaaaaagctttattgctcacacaaagcctgtttggtggtcccttcacacagacgcatgtgacatttggtgccatgacttggatcgggggacctcccttgggagatcaatcccctgtcctcctgctctttgctccatgagaaagatccacctacgacctcagatcctcagaccaaccagcccaaggaacatctcaccaattttaaatcgggtaagcggcctctttttactctcttctccaacctctctcactgtccctcaacctctttctcctgaatttcagcaccacccttcaatatctcccttcccttaatttcagttcctttccttttctggtagagacagaggagacacatttgatccatggacccaaaactccggcaccagtcatggactcgggaagacagtcttcccttggtgtttaatcactgcagggatgcctgcctgatgattcacccacatttcagaggtgtctgatcactgcagggatgcctgctgtgatccttcaccttggtggcaagcaccacctcccctgggggcaagtacccaccccctcccgtgtctccaccctctcttttctctgggcttgcctcttcactataggcagccttccaccctccattcctccttcttctcccttagcctgtgttctcaagaacttaaaacctcttcaactctcctgacccaaaatctaaatgccatattttcttctgcaataccacttgaccccaatacaaattcgaaaatggtttcaaatagccagaaaatggcactttcagtttctctatccttcaagatctagatcattctggtcgtaaaatgggcaaatgctctgaggtgcctgatgtccaggcattcttttacacatcggtccctccctagtctctgctcccaatgcaactcatcccagatctttcttctttctctcctgtctgttccttcagtctccaccccaagctctgagtcctttgaatcctccttttctacagacccatctgacctctcccatcctccccaggctccttcttgccaggccgagccaggtcctaattcttcctcagcctccactcccccaccctataatccctctatcactcccttcctcacacccagtccagcttacagtttcattccacaactagccctcccccacctgcccaacaatttcctcttaaagaggtggctggagctgaaggcttaatcaaggttaatgctcctttttctttatcctacctctcccaaatcagttagtgtttaggctctttttcatcaaatataaaaacccagtccagttcatggcccatttggcaacaacccttagatgctttactgccctagacccagagaggccagaaggccatcttattctcaatatacattttattacccaatctgctcctgacattacaaaaagctccaaaaattagattccagccctcaaaccccacaacaggacttaattaacctcaccttgaaggtgtacaataatagagaagagttgcaattacttgcctgcctccgctgtgagacaaatcccagccacatctccagcatacaagaacttcaaaacgcctaaaccacagtgtccaggcattcctccaggacctcctcccccaggatcttgcctcaagtgcgggaaatctggccactgggccaaggaatgcccgcagcctgggattcctcctaagccatgtcccatctgtgcaggaccccactggaaatcagactgtccagctcgcccagcagccactcccagagcccctggaactctggcccaaagctctctgattgactccttcccagatcttcttaacttagcagctgaaaactgacactggccaatcgccttggaagcctcctggaccatcgcagatgctttgggtaactcttacagtgaagggtaagtccgtcctcttcttaatcaatatggaggctgcccactccacattaccttcttttcaagggcctgtttcccttgcctccataactattgtgggtattgatggccaggcttctaaacctcttaatactcccccactctggggccaacttggacaacattcttttatgcagtctgttatagttatccccacctgcccagttcccttattaggccaatacattttaaccaaattatctgcttctctgaccattcctggactacagccacatctcattgccacctttcttcccaacccaaagcctccttcgcatcttcctcttgtatccccccaccttaacccacaggtatgggacacctctactccctccctggcaactgatcacacacccattactatcccattaaaacctaatcacccttacccagctcaacgccagtatcccatcccacaataggctttaaggggactgaagcttgttatcacttgcctgctacagcatggccttttaaagcctataaactctccttacaattcccccattttacctgtccaaaaaccagacaagtcttacaggttagttcaggatctgcgctttatcaaccaaattgtcttgcctatccaccccgtggtgccaaactcatatactctcctgtcctcaatccctccctccacaacccactattctgttctggatctcaaagatgctttctttactattcctttacacccttcatcccagcctttcttcgctttcacttggactggccctgacacccaccagtcttagcagcttacctcggcttactatcgcaaggcttcatggacagcccccattacctcagtcaagccctttctcatgatttactttctttccaaccatctacttctcaccttaatgaatattttgataaccttctactttatacccctcctacaaatcttcccaacaggacaccctcctgctcctccaacacctattcgcgcatccccctccaaagcccaaatttcttcctcatccattatctatctcgacataattcttcatgaaaacacatgtgctctccctgctgattgtgtctggctaatctcgcaaaccccaaccccttctacaaagcaacaactcctttccttcctaggcatggttaggtacttttgcctttggatacctggtattgccatcctaactaaaccattcattctccccatttccccatatttccctctttcctgttccccacccagaccacacttagtttattgatgacagttcttccaggcccaatcaccaatcactggcaaaggcaggctatgttatagtgtcttccacatctatcattgaggctaccactctgccccactccactgcctctcagaaagccaaactcattgccttaactcgagccctcactcttgcaaaaagactgcatgtcaatatttatgctgattctaaatatgccttccatctcctgcaccaccatgctgtttatatagactaaaagaggtttcctcactacacaaggtcctccatcattaatgcccccttaataaaaaaaactcttcttaaagcttctctactcccaaaaaagctaaggtcattcactgcaaatgccatcaaaaggcatcagaccccactgctcaaggcaacaattatgctgataagacagctaaagaagcagccaggattcctacttctgtccctcatggccagtttttctcctactcatcagtcactcctatttactctcccactgaagtttccacctatcagtccctccccactcaaggcagatgatttttagaccaaaaaaaatccccttccagcctcacaggcccatgctattctgtcgtcatttcataaccccttccatgtaagttacaagctgctagcccgcctcttaaaacctctcatttcctttccatggtaaaaatctatcctcaaaaaaatcacttctcagtgttccatctgctattctactactcctcagggatttctcaggccccctcccttccctacacattaagcttgaggagttgcccctgcccaggactggcaaattgactttactcacatgccccgagtcaggaaactaaaatacctcttggtctggaaagacacattcactggataggtagaggcctttcccacagggtctgagaaggccaccatggtcatttctttccttctgtcagacataattcatcttcttgctcagccccaacctcgtcccagacaccagccctctaagcgactctcttccagtcctccagcaggctagacaggaaattcgccaagctgctaatcttttcttgcctactccagattcccagccatatgaagacaccctagctggacaatcagttcttattaagaatctcacacctcaaactctacagcctcgatggaccagatgctacttagtcatctatagtaccccaaatgccatccacctgcaggaccctccccattaggttcacaactccagaataaagcatgtccattggacagccagcctgatctctcttcttcctcctggaagtcgcagatactctcccctacttcccctaaactcactcgcatttctgaagagcagtaataacccttatgagcctaatacatcccttcattctattaggtcttagtccttaccctactttttgcaacagggctttacgcaatcacccccactacttggactgcacaccaaaaaatttgtcatccctcctatcttctgtctagtcatactcctattcaccattctcaactagtcataaatgccctgcccctgtttacgttgctggtttacacatttcctccaaaccatcgtagaggatatctcctggtactatcctcaatccaccactcttgactccctcttggagtggatagatgatctttgctgacagggcactctccaatactttgaccctgatgaagtcctattcttttcttttatactcactcttattctccaccctttacctctccccggctatctccaccacactatcaatctcactcactctctcctagccatttctaatccttctttaacaaacagttgctggctttgcatttcgctttcctccaaaaccgctgaggcctcgacttactcaatgctgaaaaagaaagactccgtatatttttaaatgaagagtgttgtttttacctaaatcaacctggcctggtatatgacaacataaaaaaaaaaaaaaaaaaactcaaggatagagcccaaaaactcaccaaccaagcaagtaattatgctgaacccctttgggcactctctaattgaatgtcctgggtcctcccaattcttagtcctttaatacctgtttttctccttctcttattcggaccttgtgtcttctgtttagtttctcaattcatataaaaccacatccaggccatcaccaatcattctatgacaaatgctccttctaacaaccccacaatatcaccccttacccaaaaatctttcttcagtttaatctctcccactctaggttcccaggccacctctaatcccgctcaaagcagccctgagaaacatcacccattatctcttcataccacccccaaaattttttgccgccccaacacttcaccactattttgttttatttttcttattaatataagaagacagggatgtcaggcctctgagcccaaacccgcacgtacacatccagatggcctaaggcaactgaagaatcacaaaagaagtgaaaatggtcagttcctgccttaactgatgacattatcttgtgaaattccttctcctggacaatgagtctcagaagctcctctccgagcaccttgtgaactccgcccctgcccgccagagaacaacccctttgactgtaattttccactacctacacaaatcctataaaactgccccaccccatctcccttcgctgactctcttttcagactcagcccacctgcacccaggtgattaaaaagctttattgctcacacaaagcctgttgacacatggacgcgcatgacacatgcccagctgatttttgtatttttagtacagatgggatttcaccatattggtcaggctggtcttgaacttctgacctcaggtgatccacccaaagtgatggtattacaggcattagccaccatgtccagcccagagtaaacatttaatatgtcattttatcattctcccatcccccccaaaataaaagtaataaatgagaaagttatacacaagagcacaagtgacctgtttaagactacagataattaggagcagaaaggagagcaaaacccactagcagacctcccatttaatgctgcagcaaactcatggttcataaacacctggttgatctgcttttctggaaatgaatatactcacttaggtagataacagtaatcatattcccatcaaagttaacattaattattgtcaataaattggaaagacagttacaatgaatttatattaattctttgaggcatggaattatttttcctatcttcaggaaagcttatataaataatttttatataaggcagaaagacagctggcataagggaaatttggtagctgggagagatgtaatatattaatagacaggttttatataaggtactttttatatgaggtaccatactggtacatcttttaggaaaaaaagattttaaattataagtttatattttatagttatcttttatcagtaaaagtatactaatcacaaacattccagatttgaattgctttttaataattcatacaatgtacaaccctatcagacttcaatgggtgcataaaatactctaaatttgagttattttctcatattttatgtactagcttgtcttaatcaaattcatttattttctggaccatgtacacctttgggttctcctcaaacctagagttgtgtctagaaaatattaaggtattatcattaagcccacataagcagatgggaaagctttatcataggatggcatctatctatcattaattggtcttctgctatgaggctggtgctgtactgagtgctttacacttagatagtaagaatataaagcacttagtacttaggctttatagtagccctttgatgtagggactattacacccatttcacagatgaagtaacagagaaataagtaactcacctaatctattatgtgaagtcaggggtgaaaacccaggtccctttgaccccaaagaccaaattattaacaaccaaatgatatgtgctctgttgggccaagaatcaatgcatattgcatgtctctcatggccattttgatcatgataacctggacaccgattggtttttctgaagcaacttgagacttaatagaagcctcacctctcatcctagagaagccacaaactagaggcgatctaagtcaagtaaattggtgccacacttgtccatataccttgaattgaaccagatatggcatgcaggaagttgagaagggatgctgtttactcttactgtcctctctgaattcatccacatgagctagggtgagcaactatgctgttacacccaggatcatctcagttttaccactgaaagtcctgaatccaaggaaacctgtctattgatgtgttacctctctcccagctaccaaatttactttatgccagctgcctttctgcatcctaaatgtcgattttttttaaggaaacattaagactttactatatgataagcaccatactaggtacaaaggatatcaaggccaaaaacaaaaaaaaatccaaattttcccacaggtactatctgcctgcctgctataacattctttcaaacaaatatccatcctttcaaaaactagccaagattaagacctgccacctgccactatactctataaatacgaggtcccatctgcctggttcttcctctggttgccccagcaactgccttatgtccaattgccattcccacatggtctagtctagtcacccactggtcaaactcatcctacactgaccatggtttcagtacccctttttgggatatattcatcatttcttatttcagcatgaaatgttttggatgactttaggttatgtaatcattttctttataacgctgatgggtccttgatcctcattattctgagatgaattaaattttaaaatggtttcccacaaattgatataggcactgcttatgaaagagagcaagaatgtttgaaaagaaaaaatgaaaatggattcaaaaaaagaagccacatgtctaactagcccacctcactaagggagaagctggaagtggctaaaggcaaagaacatgcctcagggctgttgagttaatggtgtcagtgatttcccaaactctagactatggatcctcaagtaaaacaccagaagaatagttgtcagatctcccttctaaaagacaactgcgctttctagaaatctggttttgcagccaagtgcagtgtctcacacttgtaatcccagcaccttgggaggtgaaagcaggaggatcacttgagcccaggagttcgaaaccagcctgggcaatgtggtgaaatcctgtctctacaaaagaaagaaagcaaaaattagccaggcgtggtggcatgctcctgtaatcccagctactctagaggctggaatgggaggatggattgagcccaggaggtcaaggctacagtcagctgtgatcacaccactgcattccagcctgtgtgacagaacaagacccagtctcaaaaataaaaaagaaatatcatttatcctttctcagtatttttgtctatgcttgtgcagtttctcctacttaatgccacattcaggttgaacattgaggcccttctacgtacttcctataacttcttttcataaaaatatattgatgggtcaggcacggtggctcatgcctacaatcccagcactttgggaggccaaggcaggtggatcacctaaggtcaggagttcgagaccagcctggccaacatggtgaaacctcgtctctaccaaaaatacaaaaaaataaaaaaaattagctgggcatggtggtgcacacctgtagtcccagctactctggaggctgaggcaggagaagcgcttgaacccgggaggcagaggctgcagtgagccaagatggtgaaactgtgctctagcctgtacgatagagactccatctcaaaataataataataatatattgatgaatatattagtaccaatttggccacttattacctctgctaccttgatgaagtcacagcatcttttggaccccactttctataaaatgaatggatggataatatcctaatataatgagtaacaattattgactgatgtgtcacgaatagctaacggttttacatcctcaatatcctttcatcttctttctagtaacagaacccatcttataaataagaaaaccattacgagtcatctgcactgagtttgtgctagcacaatacctttctccccagcattttcttccctttcccccaccaaataattctgattttctttcttgagtactcatcttcccattcttagtcatgttccaaggtgaatgaatggattacatttggcttaatacagtttctgtatcccatcctccaggccccagagatgggttcaaggggagacatgtgacccaatgccagccagtcaaagagagagagagtgaatgccagaaatgatgtgggagcactaaaagagatctcctctgtaaatagagatcatatggtgtaagctgtgaaatcattttgaccctgtcaagggagaacctcagtagccagggccatgtatggaacctaacaatgaggcaatgacataggacaaagagtgaggagacaggaagaaatccgatgtcgcccaggctggagtgcagcggcgcgatctcggctcactgcaagctccgcctccctggttcgcgccattctcctgcctcagcctcccgaatagctgggactacaggcgcctgccaccacgccggctaattttgtttttgtatttttagtagagacgggatttcaccgtgttagccaggatggtctcgatctcctgacctcgtgatccgcccacctcggcctctcaaagtgctgggattacaggcatgagccaccgcgcccggccggtgctacacattttttaaatagccaggtctctggagaactcactcactatcacaaggacagcaccaagcctttcgtgaggaatccacccccatgcctctaacacctcccatcccgccctacctccagcactggggattacatttcaacatgagatttaggaggactaaatacccaaactacatcatctactaaggggtcaaaaacaaacacaacaaaataaagaactaccttcattaaagccctcaaacagtaagcccatctcattccatggtacattatgaagtcacatcttgtcccatcagctttcccctactttgtcaaaataaaaaaaaaacttcagtggattgagggtatgattgcagttttctcctgtactgcccacttattactgcctagacactagacagcatttagagctggccctagtttcttcactcctttcagatggagtcatcccctgtagctccaagaggcaagagtaagggtttagtataagcaatcggacccagtcctgctcctcaggccatgaaagtgtgtatatccaatggaactcttagagtactagtttcctattgctgttattttaaaaaaaattacaaactcagcagcttaaaataacacaaatttattctcttatactttggagaccagaggtcaacacgtgttttaaggagctaaaatcaggatgttggcaaggctatccttacaaaggctccagaggcacatctgtttcctgccttttccagcttctaacagctgcagcattcctgaactcctggcagcatcgcttcaatatccacttccatgatcacacagccttctcctgtctttgaccttcttgcctgcctcttataagggccattagggttatcttcaaggtccactgaatgatgtaggataattccaacttacgactcttaaccacattctgcaaactttctgcaacatctgcaacatttgcggtactcatgggttccagggactaggatgtagacatccttggagaaccctaattcagtctactatcatgaggacggccagattcccactggacacttggttggagatgagtatttaaaatatagatctaaaaataataagctagacagttttctaggtggaggggaacaggtatgtttgaaaaacagacatgcattgtcatttgtaggaacaagcaaatttgcaacacggtgcaattaagccaaacacaagaaaaccaggcctgaaatcaggaaaaaaaaaaaaaaataggctatagtcctcgttctgccactaaccagctctgtgagagcttatatgaattattcaacctctctaaacctgctatactgtctataaagtgagagacttgctctcctgatagtgctattttgaatacagaaataaaattcatgtaaaacaactaagcccaatgcttggaatataataacctataaatgttaaccatttatatgatagtaatgataataataataataatttctgattgttcaacttgtgaaataagtaacaatattggccagggaggtttgaaatttcttaggtttttgttgttttgtttttagttttgtttttaaagcaagactagaaaactatttttctcagagactgccataatttttggaagtaaaagagatcatttttgcctgaggtctatctctagcaaacaagaagaaattattgatccccaacttgttatgcaaccctgcactcttcatagcaggagcttaaaaggactaagatgtgttttccatcctcaggagccttgcactatggttaatattgacgaagccaacttatttaaaacacagagcaaaatgacagacaagatcgagttgagtctaaattatatagaatggtttataagtgcaataaaattccaggagaaaaactgattcacatgggctaaaggagtcaggcaagagcacaggcataaactagaacttgaagaatgaataatatttagatatacaggaagagggtagtgggagccttagaaactgggatgggcagaggcaaaggctagtggccaaagacagtaatcatattagcctggcaccacgcatgggtatgtcagagaccaaagaaagagacaagtgctagaatttaaaagaaaaaaaatagcatagcaaaggttaagcatagatagagacttttggagtcagaatatttggatctagatcaagttctcaccctttgctagctttgtgacgttggacaattcattaaacttctctgatcctcagctttgtagcctataaaatcaggttgataatgtttacctcattgtattgctgtaaaaaccgaaggacataatgaatgggaagcattcattaatatcccttgcagatattaatagtgtaataaatgtcatttacagtagcagtagtattagtaataatagtagtagaataataattccagattttggaatcatagatattcaaatataaaaagggtcatagagattcttattcattccctgtagttaataaagaagctgaagtccacgcagactttcaccgacacactcagaagccactgttgtttccaccacacctgtcagattcagcatttctactccaaaatatctagttgttggtgcacttgaatatgctgaattcgtgctgatttaggaatcctttttaaaggactgctgagttttagctgcctctagtcagagaaaggatatgagaaagccaaattctgcaaatagttttcactctgcattaaccattccaccaagagtagaagaaacaagacaaaggccagtatgggcttaaattcatgtgcctggtcttcctccagcctacattttgtccagcctttcagcttaaaaaaagaaaagaaaagaaaagaaatccactttggtcttcaggggtataaaccaagtccattaaaaaactctcatgcatgttgggtctttttttttttttttttttcagagcgctctgaaatttctcagccctggaaatatatgtaaaaataatttcacaaaacacttagtgtgattcctaatataaacactctgaaatgcagattcttaaatgagttggtgcagtaagggatgagcaaaccatgttcttatactgcccccttccggcaaacggctggaagagacagcctgcatattttgtgttgaagaaactagttcaatttcatttaaaataaaacttcttttgtaatctctttgccccagccctgctgataggcagctgtaggtaatttctcttgttgcttgaaaatgttgcacaatatgaaaaaaacaataatgttaaagacaagacatctttggtgctctagaagggcaagaagtagggaaaaattactcagctgtatttgtatcaagcaggcacatggaagctgggaaaaaaacagaactccctccttggtttttgagaattgatggtgtgaaatttcctcagatgccaaaatcagctaaagcacaggaagactataaatataaggtaaacagaaggaataccgatcctagctttctttcttagtaagacagaaataaagaaaggccaatttctacaatattgtggctagagatcaatttgtgaaatgaatcctggcctctgaaagctcttccttcctgaagcatgaaaaaacaaggcttaagagattacttaggctggcataatccctcttcatgcagatacagcctgttagctatggtaagataggctatactgtagcaacaaccagccataaaatctcagtggcttacaccaagaaaagtttatttctcacacacataaaatcacatgaccagccggcgcggtggctcatgcctgtaatcccagcacttcgggaggctaaggcgggtggatcatgaggtcaggagatcaagaccatcctggctaacacggtaaaaccccgtctctactaaaaatacaaaaaaattagctgggcgtggtggtgggcgcctgtagtcccagcttctcaggaggctgaggcaggagaatggcatgaacccagggggtggagcttacagtgagccaagattgcgccactgaactccagcctgggtgacagagcgagactccgtctcaaaaaaaaaaaaaaaaaaaatcacatgaccaaggctcatgatcctcatcacactgtattctaattgcctacctatttgtttccacagcagaccatgatattctttgggtaggaactacgtctattcgtttctctgttgtgtccccaatacttagcacaacaccaggcaaatagaagctcaaagaatatttgttcaataaatgaaagaataaaggatagataaaaaagtgaagcaaactaaatacctctgggcatcatttccaggagctctgatttctccctttctaaacttcaggtgcagtccgcctagcaaatgtccattttacactggggttcatccctctcttcccataggcttctggccatggtgtcatgtccatgtaacttgtgtgatctctttaaaggtcttcttagtgagccattgaaaaaccaatgatgtgaatcaacaatggtggtaggtaaatattcttagccaccaggctttgtggtgcttgcattagggagagggtgatagacgtagaatacagcccactggagcacttagggatggctgctcggagaaccacttcacaaaatggtaccagtgccaagcaccagaaatcaaaatggaaatgcaagacccagtgagatcacaggggagaaagaaaaagggaaaacttttccagttagggtttaaaaagaaaaagaaagtggcaccttaagatgtgctttatatatacaaacatatatatataaataccttactacttaattactacaactatggtaagcaatctgagggcaagtaaaagaagccttgccctcagacagcttaccaaagtagtagtaatatgtgtatatatataaatatatacatttccaaaagtcttactagcatagtgggaagcccaaaaagatccttttccttttcctctctctttttttgttctttctatggctctccattttccacctaccaaatgctaaccaaattacacggtgaccaactgttttgaatcctcttccctaaagagcttaccatttccacctgttttttaccaaagatccttttaaactatatgctttgatggatactaagctggaaattttggctctttgtagtcctgaatcctacatgcaattatcaaagggcttatggattactatttttcacctaaagcagatgaggagatgtgctgtggcatcgcaaatgctaggacataaatgttctgaaccctaaaccttgcagtttagcatttattgtaccaagtacaataccgagcttatctatgtatacagttttagaaaaggagcaattctatgtacttggagattaaagattggtttacaatttgtattaaaacaaagagctgctggtcccaaatcctttctccttcctggccccaataaatctgattcttgcctccaacagaggatgccttccctgcccctaccctgtggttagagagagaactgcactgtcatggggcttatatttgcctgaccttttgcatactcatattaggcaatgatgactatttcaggactgcagaatactaagtgaagaacagatagattatatagtgtgcctcctaagtggcctgttgctatggtttcccactgaaagaacagaattctcgccattaggttatctgaaatctgcaggactgcaccaaaatgtttctgcagagaagaggactgtccgttaaacacagctccatctgatcaaatccagtctcagatcagcagggagcataataatggaagcatgacttcagcagtaggatttgcaggacatttgtgggactgaaactgaggcattgccctctgttgatgagtgacctttcctatatttgttatctatgtcctctatgccaaaaagttattgaatctgaaccacctgggcatgaaaatgggaacacaatgctcctgtacttaaaaccctccaaaggctttccattgctcttaagataaaaatccagatcctcttgagtgccttgcagttctctgcatggtcagaccccaactgcttctttatcctcacctcaccccactccatttatgccttctgacaggactctccattttcgttttatagcacttatcaacattagaaattaactgtaggtttttgtgcttctttaatatatatctaccccattaaaatagaactttaaagtcatgggctatgtctttgttatctttgttatatccccaacacctactataaaacttggcacattctatcctcatttaattagcaattagaggactgaatgtctacttattcattgaacaagtaataaactgaaaaaaaaatttaaaagaagatttgccctcagattgcttatgaatacagtacaaggaaatatgtctgggtaaacaaatagctatataccaatgaaacagcaatttcttgttatctcctggagacctggtgctgaccatgatgggtaagtaatgcccatgcctttaacacaggtgtgctagacacatgtctgaaggacatgctaaaaggtaactcaaccagtctagtagtaactcttagctcatcaaaaaccttcaaccacaataaaagaagcccagagattctataagggagacagaaaatactttgaagggtatttatagggatagagtgacatttatcccctctctctcctcaagccacctgaaaggttggcaagagaattccttagggagatgggagaagagaaacccagagtgtgtggagagaagaggaggtaggtactcacatagaaatgtagctggaccagagtcctcttaaaaagactcttgctctaggatgaagggaagccagcagtgtactgccaataggcgggagctaagggaaagtcaagagcctaagagggcagaatgtgctccttattgggtactcaaagagttcctataagtgccccatgtgaggaagagccaaaagattgccttgtcatgaaagaaaccactggcaatcaaataaaccagcatcaggcaaataatacttgccctttcttggtaaatttagcacacatacttgctatacgcatatacatgctctctctcacatgctctttctcattctctctctctctttctgtctctctctctcacacacatgctcaatgttttactctaaaggagccagaacacagatgaattggggagaagaggcggagaaggcagagcagagaatgagtccatgacccttccccgctggtggacttaggaatcagtggcaggcctaggaggaaggttggccagacagaaacgttgacttgaatgagagattagagttttgatcaaggttgaactgaaattcttaacacctgatgatgagactgtactaatacctgaaggcatataagattgcctaagaaatcttttgccatagggagggagaacccagagaatgtaggtgaaggtagtgcttagaaaataatgaagctacagagacagaaactagacaagtgattgcctggagccagagtgtaggagagagggtcgggggaggacagaaatgagaaatgagtactcatggttattgagttccttttccagctaatgaaaatgttctaaaattgattgtggtgatagttgtacaattctgtgaacatactaagcaccacagaattgtacactgtaaatgggtgaattgtatgatacctgacttgtatttcaataaagctgttttaaaaaataataatgaagctgactcctgattgcaccttctcacatccagtctgtacaataaactaacttcataaaatagaaaataataagtttaatgagaagagtaaaagtaaagtacaataggatttccaagttgaggtaatcagctcaaaaccttttctgcttaggaaattatttgatttaccaaccaatgttctaggaatatttggaataatagaatcatgcttgtacttattaaatatgcaagatgcattcctatttttctcctcctttagcaaaacttattcatgaaaaagataaatttctcatcaactcccaggagaattgtgtatcctgcaaccgtagataattcaataagtcttgtgactataaaaggatgatatcttatatctgaatatattattgcatgcaaagaacttttcaaggacaaatgtttctcattcagtcataaccacactgaatgattggtagaggaattatatctgcattttacacacaaggaatgttaagactaaaacaggagtctgcaaattatggcccactggccaaatttactctgtcacctgtatttgcgtagcccatgagataagaataatttttacaagtttaagtcattgaaaaaaaatcaaaagaaacatatctcatgaatactgaaaataacatgaaattcaaatttcagtattcataaacttttatcaaaacaaagcaaatgctcatttattcacatattgtgtcacgctttcatgctgcaatgacagagatgagtctttgtatgacagagattgtatagctggcaatgcctaaaatatttagtatttgtcttttaagaaaaagtttgctgacttcttctctaaaaggttgaatgacctctcatttcacatgcttagttagctgtagaaagagacataagatcactaattaaggtcataaatcataatatcctgttccctatacaataacatttgtagtatttatatgttcatttccctcttctgttgggccaccaaactttcttttggaaatgaaatcttacaaaactattattattatcactatcattattattaatattattattaagacagagtctcactctgtcacccaggctggagtgcagtgccgcaatctcggctcactgcaacttccatctcccaggttcaagagattctcctgccgcagcctcccgagtagatgggattacaggcacctgtccccatgcccggctaatttttgtatttttagtagagatggggtttcatcatgttggccaggctggtctcaagctcctggcctcaagtgatccgactgcctcggtttcccacagtgctgggattacagacgtgagccaccgcacctggcccaaaactattattgtgcttagaaggcccttcccccatttctgacttccttaactcttaaaaatcccctatgtctcaaattataatatcacatcctcagatatccatcatgttaatctaaaataagttctgtagtcatccaacagttttttttctgcctgctgcacagacaaaaaccaattcactgagaccacaatattgcagtaaagaaaaaatataactaatgtgaggccggccacttgggagctccggatttctcatgcaaatcagtctcatggaggctcagaggttagggtttttctttttttttttgagacagagtctcgctctgttgcccaggctggagtgcaatggcacgatctcggctcactgcaacctctgcccctccaggtttaagcaattctctgcctcagcctccagagtagataggattacaggcgcatgccaccacacccggctaattttctgtatttttagtagagatgggatctcaccatcttggccaggctggtcttgaacttctgacctcgtgatccacccacctaggcctcccaaagtgctgggattacaggcatgagccaccgcacccggcctagggtttttcaagaatagtttgctgggcagtgtgctagggaatgggaaatgttgattagttggggatgaaatcgtaggggtatggaaagcagttcttgtgccctgagccagcctctgggtgggagtcacaagactggttgagtcatgagtcgtgggaccgagtagagttagttggtcatcaaaaagccaaaagtctgaaaaccatctcaaaaggccaaccttaggttctataatagtgatgttatccatatgaacaattataaattttgtgaccctggaacaaggccagttatcacttaaccatgcctacatcttagcagaattcagccccctctcatattcctaaccttgtgggctttcattagtttttacaaaggttgtttagtttggggaagggttattatcattcttgccttaagggtaaactataaagtaaattcttccctaagttaggttggcctatagccaggaatgaccaaggacagcttggaggttagaagcaagatacagtcaactatgtcagattctcttactgtcataattttgcaaaggcagtttcagttccactttatactctctgacaggatcctgcagtcaactatagagtgctatgaaccaggaagaaccttaacaaccatataattcagaagtcagcgaactttttctgtaagggccaaataatattttagctttgcaggccatactgtctctgcaataactactcaattctgccatcatagcacaaaagcaacaatagataatacctaaaggaatgtcattccaataaaccgttatttagaaaaacagacagatggctggatttggcccatgaactgtagtttgccaacccctgatacagtctatacctttatcttacatgttgtgaagctgagtatgaagagagtacaatagcatgaatgtttatgtcccctcaaattcatatgttaaaatcctaacccccaatgtaacaatattaggatgtggaaccttggaaggtaattaggtcatgtgtgtggaatcttcactattgggattagtacccttataaaagggaccatagagagatccccacatacctttccaccatgtgacctcactgtgaaaggacagctatctatgaggaaggaggtcctcaccagacactgaatctgctggctccttggtctggaacttcccaacctccagaatggtaaaaaataagtttttgttgttgacaaaccactcagtctatggtattttgttatacagaccaaatagactaagacaaggaaagtgacttgagaattagaatccatcttcctgacccaaagcctagtccaaggtgttgcaactgagaggtgacagcgtgctggcagccctcgcagccctcgctcgctctccacgcctccactgcctgggtgcccactctggctacacttgaggagcccttcagcccacggctgcactgtgggagccccttcctgggctggctgaggctggagccagctccctcagtttgcggggaggtgtggagagagaggcgcgggcgggaaccggtgcttgtgggccagtgcgagctctgggtgggcgtggactcggcaggccccgcactcggagcagccagctggccccgccggccccgggcagtgaggggcttagcacctgggccagcagctgctgtgcttgacttctccccgggccttagctgcctctccgcggggcagggcttgggacctgcagcctgccatgcctgagcctccccccaacctgtgggctcctgcgcagcccgagcctccccaacaagtgccaccccctgcttcacggcacccagtcccatcgaccacccaagggctgaggagtgtgggcgcatggcatgggactggcaggcagctccacctgcagcccccatgcaggatccactgggtgaagccagctgggctcctgagtctggtggggacttcgagaatctttatgtctagctaagggattgtaaatacaccaatcggcactctgtatctagctcaaggtttgtaaacacaccagtcagcaccccgtgtctagctcagggtttgtgaatgcaccaatcgacactctgtagctagctactctggtggggacttggagaacctttgtgtccacactctgtatctagctaatctagtggggatgtggagaacttttgtgtctagctcagggattgtaaatgcaccaatcagcaccctgtcaaaatagaccaatcagctctctgtaaaacagaccaatcggctctctgtaaaatggaccaatcagcaggatgtgggtggagccagataagggaataaaagcaggctgcccgagccaccgtggcaacccgcttgggtccccttccacagtgtggaagctttgttctttcactctttgcaataaatcttgctactgctcactgtttgggtccacactgcttttatgagctgtcacactcactgcgaaggtctgcagcttcactcctgagccagcgagaccacgaacccaccagaaggaagaaactctgaacacatccgaacatcagaaggaacaaactccggacaagccgcctttaagaactgtaacactcaccgtgagggtccgtggcttcattcttgaagtcagtaagaccaagaacccaccaattccagacacactacaacctgacattgtccttaaaaaaagcttagactgacgaatctaagatactcaaaaacccaaagaaattaatggagcctctaaatctttggaaattagagggggatataatttcatttctttttttgaaacatgcaggaataggtacgaacaaatactgcttttacaaagccaatcttccttgcaaatagcacgaatgttactatcttgagcatagctttcctatgaaactgaacacagggataaatattgaaaagagcttgccttctccaagaaatttttgtggtacacaggattttgaagacaaatgtattttaaaataccagatcaattaaaaatacaatcagttgcatttgttgagcacccaccatgtcaaagcacaatgcctaaaacttcttcatacctaaaaagactgtctgaccctcaacaagtaaaattcaccacttgttcctacaattccattcccttttcatcacattaaagataactttattgcaaggtgttataggttgaattgtgtccccctaaaattaaaatgttgaggttctaaactccagtccttgagaatgtgacctttcttggaaatagaatagttgtgtatgtaattagttaagatagtcattatggcaggtcctaatgcaatattactagtctcttttgaaaggagagcatttagacagagacaggcacacagaaagaatgccatgtgaagatgaagtttgagacacaggtgatgcttctccaaccacagaataccaaagatggccggaaaaccacaagaagctgggaaacacaaattaaatggattctatttaagagccctcagaaagaaccaaccctgacaacaccctgatctcagacttctagtttcaaaactgtgagacaacacatttctgttggttaagccacccagttttcagtaccttgttacaacagccctagaaaattgatacaaaaaggtttacacgtctttatctagcccctagaatagaggtccccaacccccaggtcatggcctgttaggaacctggccacacagcaagaggtgagcagtgggtgagcgagcaaagcttcatctgtatttatagccactgcccattgcttacattaccaccggagtgccacttcttctcagatcagcggtggcatcagagtctgataggagcgtgaaccctatggcgaactgcacatgcaagggatctattttgcatgctccttataagaatcgaatccctgatgatctgtcactgcctcctgtcacctctaaatgggactgtccagttgcaagaaaataagctcagggctcccactgattctacattatggtgagttgtgtaattatttcattatatgctacaatgtaataatagagataaagtgcacgataaacgcaatgtgcttgaattatcccgaaaatatcccccactgtcaccttgtccatggaaaaattatcttccatgaaaccagtccctggagccaaaaacgctagagaacgctgccctagaatataagtgctttagaacagatatgttctttttatgtattcatccatttgttccaaaacactttttactaaatgccttatgtcccagaacttatcataaaacctgacttactgcagacatttgataaatgtttgacggataaatgaacaaaggtagatgataaggtttggctgtgtctccacccaaatcgcatcttgaattgtagttcccacaatccccatgtgttctgggagtgacctggtggaaggtaattgaatcataggggcagttaccttcatattgttcttgtgacagtgagagagttctcacgagctctgatggttttataagtggcttcccccctcccccacttttgcttgacacttcttcttgctaccaccatatcaagaaggacatgtttgcttctccttctgccataattgtaagtttcctgaggcctccccaaccatgctgaactgtgagtcaattaaatagctttcctttataaattacctggtccctgtccttttagcagcatgagagcaaagtaatacagtataccggtaccaggagtggggcactgctgtaaagatacctgaaaatgtgtaagtgacttaagaactgggtaataggcagaggctcgaacagtttggagggctcagaagaagacaggaaaatgtgggaaagtttgcaacttcctagagatttggagggctcagaagacaggaagatgtgggaaagtttggaacttagattgggaaagtttggaacttcgtaaagacttgtttaatggctttgaccaaaatgctgatagtgataatggacaatgacatccaggctaaggtagtctcagatggagatgaggaacttgttgggaactggagtgaaggttactctttctatgcaaaaagactggtggcatattgcacctgccccagagatctgtggaactttgaacttgagagagaagatttaggttatctggtggaagaaatttctaagtggaaagcattaaagaggaagcagagcataaaaatttggaaaatttggagcctgatgatgcaaaagaaaagaaaagccaattttctggggagaaattcaggcttgctgcagaaatttccataagtaacaaggagctgaatgttaataaccaagaaaatggggaacatgtctccaggacatgtaacagaccttcatgacagctcctcccatcacagacctggaggcctaggaaggatagtggtctcctgggctggattcagagccctccttgctgtgtgcagccttgcaacttggtgccctacaccctagccactccagccatggctaaaaggagccaatgtatagctcaggtcattgcttcagagggtgcaagccccaagccttggcagcttccacatggtgttgggcctgcaggtgtgcagaagtcaagaagtgagatttgggaacctctgcctagatttcagaggatgtatggaaacacctggatgtccagtcaaaagattgctgcaggggtggagcctcatggagaacctctgctagagcagtgcagaaagaaaatgtggagttgagaccccacacagagttcctactgggacactgcctagtggagctgtgagaagaggactgccatcctctagaccccagaatggtacatccaccaaaagtttgcaccacgtgcctggaaaagccacaggcactcaacatcagcccatgaaagcagccaggatggggactgtaccctgcaaagccaaagagcagagctgcccaaggccatgggaggctagttcatgcatcagcgtgacctggatgtgagacatggagtcaaaggagatcactttggaactttaaggcataatgactgccgcagtagatttcatacttgcatggggcttgtagcacctttgttttggccaatttctcccatttggaacaggtgtatttacccagtgtctgcacccccattgtatctaggaagtaactaacttgcttttgattttacagactcataggtggaagggacttgccttgtctcagatgagactttggacttggacatttgagttaatgctggaattagttaagactatgggggactgttgggtaggcatgattgtgttttgaaatttttgaaatttcggaggggccagggggtagaatgatatggtttggctgtgtccccagccaaatctcatcttgtaattcccataatctccacatgtcataggagggacctggtgggaggcaattgaatcatggggacagttacctccatgctgctctcataagatctgatagtgagtgagttctcacaagatctgatggttttataacggattttttccccttttgctcggcacttctccttgctgctgcttggcacggaaggacatgtttgcttccctttctgcaatgattgtaagtttcctgagttctccccagccatactgaactgtgagtcaattaaacctgtttcctttataaattacccagtctcatgtatgtccttatagcagcataaaaaggaactaatacagtagacaaaaaggaagggagaaatggaagaaggaaaaaatacaagtgaatgtactcagagttcttttcttgaaagtgctcaaagtagtgttagcgagacaaaacttacacatgtgaaaatgtcttatattacaaagcagtatagaataaatggcccagatattgagtaccatctgaactcaggagacatcataggtaaagtcagatgtgaggtgtgtattagagtttttgtttgtttttgttttggggtgttttacttagcagcattaatcaaatttgaatttgatgaagagactcatcacatatgcataaaaatcactgttttttaaaaagcacattgatcttcttataaaacaagaaatgcttaagtaatgcatataaccattatctagtcattgttagttccaggattttttaatgttaggttttcttaattcatggcatatttttgtttgaagcagcaaaattccaaagtaggattttgcttaggccagtggttttcaaattttagagtgcccaagaattacatggagaaatatgaagcatgatggaagtcctgggccccacactagtccatctcaactagcatctctagggcagaaccaaagaatttgcctcttaaatattcatccctcatgtaatttctctacaagtggtgtgtggagaacatggccttaggcctttgttgtcatgaaaactgaacttctgtttaatggtaaagacattataattttatttaaaaatactttgccaggagcagtggctcacgcctgtaaacccagcactttgggatgcccaggtgggcagatggcatgagctcaggagtttgagaccacccaggacaacatggtaaaaccctgtctctacaaaaaatacaaaaactagcttggcatggtggcagtcacccgtactcccagctacttggagggatgaggtaggaggattgcttgggcctaagaggttgaggctgcagtgagtcaaagttgtaccactgcactccagcctgggcaacagagtgagaccctgtatccacaaaacaaacaaacaaacaaacaaacctctatagtagagagtaaataaatgtaaatatctcaaaaaccattgattgtggtttgggattttttgtttttgttttcattctgagtttgggttcatttttttgttttggggggttttttgctgaattttttccaagtctgtatttttccagtatcttccagatactaatcaccttccaagattgcaagttttttgtcttcaactgacaattaattcattaatttaagggagaactatggcttggttaatatcatctgccttttttttttttttagatttctcaatgcattaactatgcctctaaaaattagagagcttaaacatacaccaactattctatgaagttgcagaaaggttgaatgttgttttgttttgaagccaattttataatcttgaaaaatcaaactactacttcttaaatacacatagtatcataaattcaaaacgtctccctgatctgtatttggtaccccaagttgatgacagggtccactgaccattattatcaataagtgtgtgccagccatcaacagacagcacagtatttaaaaaccttaaaaattttcattcttcctactctctgagaaaatgtttcctatagaaggacatttacaatcatcaggctagcaagtcttgatcactggactgaactattagcatatataaagtcaaatatgcctttgcagatgctcataaacaaaatatccattcctttgccctccccgctaagaaacaccatttttatattgttacgtgaaaagatttggagccatgctgataaaagctaattaactgagcagttactatttaccaggcactatgataagcacttcaaattcaaatatcaatttatcatcatgacagcctgtgatagcggtttcattatcattctcattttacaatttagaaaactggtgattaatgattaactggctgagatctaacagttattaagtaacagagatgaggtttgaatttgtggtcatctgacttcaactcctgtgctacaagttttcctccaaattatcagattctggtgaagtacaatgagaactgggctgagatccaagagataaaaatgttcttctctcagctgtgatacaaagtaactgggtagttttgaccatgatatttaccctctttgggtttccgtttcctcttctataaagagtggtaattggactactagatgaataataaaattgcttccaacactaatataccatgatttaagagcagccactttgcacaaaaagaggaatagaaagacaatgggagccatctggatgtgaaaatgatgaatggcaaaagcttttggaggggatagtctcagattagcattcagtgccttggggcccacacaccacattgccagtctcctgcaaattgcctgcagctgcactgacctagcctcttagactgcagaacccttgacaaagtgttcaaggtatttagccttgggtttccctaagaacccatctaacccataaaaattagaggtcttgtaattttgccaattttgctgttagaagcgtaacaaagcttttttgtctgaactaaattatcccttcattccagatagcaagaatgcctttgcaaattctttctagagtagctgatagtagaggattttcacatcagtgaaaaaatgaaaaccatctaaagaaacaatcataatgatatcatgatggaagaaaagctgtgttaatctcagaagctatgtgtctgtatccacttttatagggtcatgcctcaaaaattcacctcaatccataatgcccaagatttctacagaattttagggatttatattctcattattactacttcctcttatttagaaatccttcttaagtctcagtctcactcatgctagcctcccattatgttctttctaccctgcatgaacccaaacatcttccaaattatgattcccacagggcagcgctggtgatgacaaaagaggatctcttcatagcatacagagcaaacagtcctaaatctaatattacaaatctctgttcttaaaaatttcaaagccatctttgccattgggaatttttcaatggctatattttgtcttgaagtcctggcatctctcatcaggttgcctggccctctcttcatctccctggacccttgggatactctctcaaagtcatatatcccaaatgtttttatgcagaaatgctggctacttctcttgcattatccttccagaccatgtctagtgcctatttcttcatacccaaaaagaactctactactggcatgccaatttatagtaaattactttcaactacattgtctgctacccaatctttgtacaattatgttattggaatataagtgggaactttatggcccagtctcaccacagtgtattattcaaacaaacaaaaagcaattctgattctgactcttcaagttaactgagagatttgatttaaaacaaagtaatactttactgcttcacactgatagtggcaggaggcagacaaatgcctaggcagataggggtgggtccttggtgaaaccccaccttcaaaccaaagacagtttaaagtctgaaagccaagctacaagtcttgaataaatccatggaccagattaagagcctctcttcccatctggcatgctttcctatcattgatccctaccccttcacctatttacatatacttacccttccctaattgttttttaacactgttatgtccatctttgagtggtggctttgttttagccttttttgcatactcacaaaccaatcagcacgcactcacccattctgagccaataaaagccctgggctcagccacacttagagactgctcacctttgggcacctgacttcagagaggaggctgccctcttggatcccctccccactgagagctgtcactcaataaaactcccttcatacttcagttgtcagtgtaccctaattattcttggatgtgggacaagaactcgggacctgctgaatgtgggtacaaagaaagactggaacactgtagccctctgcccttcactggcagagggcagctgccccacatgatgggaagcagcactgaggtggaagcagcagcagggccagtccccagagccacaggccggagtgggacaatgggactaaaagagcttggcatgctgtaacaacccctatagggatttggggtcactggcatccctgttcaggtgccactgtgttctcctcatccagacaccactgcccaaggcaaaaacaggtcatgtacacccagcccaactgcaggttgagtgtagatcctgcagcaagcattagatatgggcaggagcgcaagccaagtgcttcctgctgggccaagtaggtgggatacctcctgcggcaagcccgggccagagcaaggcctgggcaggggtgtcaccagccacagaggtctccagctggaaaagcagctctgagagaaatcctgtgtcaacaccttaaaattcttctcccatttctctccactgccaactttcatgttaactgcccaaaattgttctccccattcttcactcttcatttttgaaaaaaaaaaaaaattacccaatatgcttatcttcacagacactcctattttctcattcccctcttgaccccccttttgtagtggcataacactttttgttaatttttttgcatttttaaattttgcaatgcttctcagcccattttgaaataaaccactcctcgttcttagttcattcattggtctaatcaacataacaggtaaacagagagatagcatgggtaggaacaacattttcatcaagtagtggaaaagaaaagggcagtgtgagtacttatgcatttttatttttgtcccttttacaaataaattaacatttttgaatgaatggaaaaaccaaaacaaatgaattgcagtagactcatgcagtgacaattgtcatgtctggagttcttaggatttacagagataacatggcagaaataaattaaagttctttttgacataataaaaggcaccttgaaaagaggtttaacttgagaactgtacctggaaaatgacagctgtgaattaatttgaatgcagcaacatacgttaaaggaaaccaaaaacaactatttactacacatacaaaagaatcttctgtagatctaggcaacattcaggcaacagaacaaaacagaacccagtataaagaagtccagtccaactgagtattgacatcaaaatttgtatgcaagaggctgggcgcggtggctcatgcctgtaatcccagcactttgggaggctgaggcgggcagatcacgaggtcaggagatcgagatcgtcctggctaacttggtgaaaccccatctctattaaaatacaaaaaattagccgggcgttgtgcaggcacctgtagtcccagctactagggaggctgaggcaggagaatggcctgaacccaggcggtggagcttgcagtgagccgagatcgcaccactgcactccagcctaggcaacagagcaagactctgtctcaaaaaaaaaaaaaatccgtatgcaagaaagctccttaacctgttgaagtttattgattgcaaacaaaataaatgatcctgactaatttaaacagaatagaatatcattataaaaaatatgaaggaatgcaaaggatagagagaaagatttaaatctggctatctctctcccctgctgaaaatgcttaaataaatttcttctaagtataattaagatcaaaaccaaaccatcaacactgcctacaaattgtggatgacctgcctccttcttcccactccagcagtttattctacctatctctccatgttgcactcacactggccattttgtggttccttatctatcattgtcccctagccacagggcctttgcacatgtccttcctctttctagatgctcttccctcccatctcccccacttctcatctactcatcctacaggcaaaagataaagctgcacttctcaggttaatgagtttggatgttggtatctacataaaagtataaataaaacaacaaaacaaaattattaactccaacagggaacaaagagtgaaataaaagaaaaacaattattgtataccacatgagtaaggcatgaatagtgtttacagacaacagtcatattgctgaacactgaattttctgaccaaaattatgagataactctattgggtgtgaggtgttggtgcaggaaaacaggacagtaattacaagtattattggactactagatgaataataaaattgcttttattttagggggaaacaaggagggggtggtcaggaagtagagggggagaaagctaaatatcttcttccacaatggaaaggtctcaaaaatgtgccctaaactgaaaaaaatagctgtaagagttcagtctttgcagctggaggatcacagatgggggaaagtagaaaatagcatataaagatgctgctgtctttaaaataaatcttaagaaattattgattcttaaagccaggtatatacatcattttatttttaaaatgatactatttcctaaaagctaaagggaaattaaaataggaaagaaacaagaaaggtaggtgagaggctaatgcatgttgtcaaaacttgtgcatctgctagagatgggccaaaaatttggccatgtctaataatgtattttctgagaaaacttttaggcaaaacttattatcaaagaaatagaaatcttggctgtgcgtggtggctcatgcctgtaatcccagcactttgggaggccagtgagggcagatcacttgagaccaggagttcgagaccagcctggccaacatggtgagactctatcgctaataaaatacaaaaattagccaggcatggtggttcatgcctgtaatccacgccactctggagcctgaggtgggaggattgcttgagcccaggaggtggaggttgaagtgagccaagatcgcaccactctactccagtctgggtgacagagccagaccctgtctggagagaaaaaaaaaaaaaaagaaaagaaaagaaatataatctctatgattgcaattagcaccttgtgtctaataatgtgttctcatttgaaattgtttattgacaaactactggtagagtttcctgaagtggtaggtctccagggaaggtttacctagaagaatttcttcccctaaatgcatcaggaccacaagtgacatttttttcaagatgaaaaattatgtttaatggcccacatatgttgtaagacaattatttctgatatggaaaataacaagaaagtcatgtgagaagcaaagaaaccatatgctcaggaattaggagaactgaactttggatttttctatagtttggatgtttgacccctccaaacctcacattgaaacttgatctccaatgttggaggtggatcctaatgggaagtatttaggtcaacactcatgtgttgacaccctcccatgggggtgagtgagttctctctctaatagttcccccagagctggttgttaaaaaagagcctggcacctctcctctctcttgcttcttctcttgtcatgtgacctctgtgatctttgcacacacagccccctttcaccttctaccatgagtggaagcagactgaggccctcaacagaagcagatgtctgtgccatgcttcttgtatagcctgcagaactgtaagccaaataaacctcttttctttatcaattgcccagccccagatattcctttatagcaacattataaaggaatttaggacaaagtagacctgtattgtccaaaacagtagtcatttgtcacatgtggctattgagtatctgcaatgttgttagtccaaattaaaatgtgctgtaaacatgaaatatacaaagggttactagaaaatttaaaatcacatctgtggtttgtattgtatttctgttggacaatactgcttattctgagttctgtcattagtggttgcatggtagtgatatgaatgtgagtcatttaactttattgggccttgattttcttaagtagaaaattggttgggggaggtggttagatagatggcctccaaagccccttttcattcagaaatgttacaaagaatcctaagatgggacacatattaatgacttgaaaagccagcagattgttccttcaaatagctcaactccaccatggagagcttccctccctgcccctgtcaaacccagccagacatctttaccaaatgatgttctcaccagtcactactctatgtcctgtgctgaatgctttacaagtatttcattacatacttatccctgcactatgaaagcagtagtattacactgtttcacagatgaggaaactggaacctgaaactgttagctgacgttgaaaggcttcagagccaggatttggaggagtcaggatccatattcctctgaatccaaaacctgagctccttatcagtgtgctctgcttttctttacagaagccaaattggttttcctctggaacctaaactatattaccaactttttgagtcagtacaacttttttgtgttgtttttcatccctggatcctcagcacataaaaaggatgattaataagcagtacagtatgattaatacaggatgattaataaatagggccataatattctgaatttctgtgtcagttggttaaaaattaagattacatttaaagtatgcctataaaataatgtgacattgttgggtttttaagaatatatgtacatatcagccatatctagaatgcagtacataaatgaccatcatctacttcagaggagaaactttgaacagttatttcaacattgtttacttagtgttttttaatcctttttataaattatcttcagagcccagaatatattttctttgaatgtctgaagcacaaattttatctcttctttcatgtattgtttatgttaggccagagaacaagatatcaaaagtacttgagagccaacttggaaagtctcctaacggcctacaatgggacaaatttgagcatcaaaaaacaataataatagtatctgattgaaatatagcagataattttaaaaatatttttaaaaacctattggttgtcaccagaatttgctgtgtcatcaacccatcattataaaaaatgacaaatatattgaatatattgagcatttaattccacttttctgcataagttatatttcagtataaccaattgttgctgaggaaaaggtcttatgcagaacatttctagcaaataaatgcaaaaacaatgataaaataagaaaatcaccatttgcaacccctaataaaataatggttcaaggcaataatcatcatagatactaaaaccattagttaaaatttgatgagcaactttaaaaggaagaaatcatgctgactgcatttgaaagtggaacatccaaaattatgtttaccctcatgtgatgcaataaaaagtacaaagcatttgctttttaaaaaagaaagaaagctgaatctaatcaagccttcagagttctaacttcccatttacaagaagtataaaggctagaaaaaagttaaacaacacaacactagaagaaaacaatcagccatatctaggatgcagcacatcctgcaggacaataagcttggtgtattcaataaatggatgatgttctgtaacaaaaattgtaaaagggtgagagtggtatcagcaagatggcagaaaggagttctctggctccactccctcctccacagatgcccaacttgcaactatccaagggcaaaaataccttcatgaatatcccagaactccagagtgaagctgagacatccccttcaactgcacaactgagaaaacccaagataaaaggtcctccccaggccaggaggcaactataagttagcatttacctgcaaaaggagcatctggtccctctgaacccagcagctaagaggtgatccaactaagaccaggacaggaggcaactgcaggttagtgagtacccacctggccctgcccaacttcaaatgcaagtctcagtgctctgctaaagcctgtcctaggccaggaggcaagcctacatacatgtatatctgtggagcatagcctctggccctacccaactcaaatggccaagcagcaacctcagagacctcatccagcctgggaacccagcatccaaacctccccaactggattcaaaacaacaatactgtccagccagggaagaaacctgtaatcctgcctgaccagagatgattgca

SEQ ID NO: 581 - DNA, 55644 bp, Homo sapiens
ggcaagagatgggagaggagcaggaaggagtgaaggaaagagagaactctctctatagctactggcagcctgcatccacacccgatgtcctgagctgtcccagctgtcctgggtgcccaattctttgcagggagtttgccagcatcttgcctgagtcaccaacatccatgcagttccccattatcctgtcactactcgagcttctttgcagatgaccatgcccttccaagtgtgttaattctccagcttctcacaacaaccctgccaagggaggcgtgatgagtcttgtgcccactgcacagatgcagatgtgaaggctcagaggggctatgtttggaagagcagaggtgaactttagttcctagttctgtcattcaaaaatctgtcagtagccagggtagaaagagagtcacaggggagactgaggaaagacctgtagggcagtgaatggctaccacagcagtgtccacaagtgagagaggcttagaaggaggcagatcatctcaagcggccccagtgggaattaagtcaagttcagaaccttcttccttctgaaatggcctccaggaagccagccaggtgccaggaagcctccataccttactgtgaagggcctcacaaaaccaccttgcagtgaaggcattgctacactcactttgcagatatggaaactgaggctcagaaagaagtaacttggctcgtcacatgtgagtaaagagcaagctcaggggttgatctcatgattctgtctgactccaaagcctcccactgtgctctggggccaggccaccacctgaggggtaattaagggagggcatattttcctgaagatgtcacacctgtggtgggagggagtgccgccatcatatgtgtcatccctatgcagacacacacactcacatgtacacacatgcacttacactgtcacatgcatactcacacatttacacacccacacacataacgcatacatgcacagatacatacgtgcacacgtgtgcacagacacacacacacacacacacacacagcccttctttgtgttgagggtttgccagtcctcttgagggtagtgctgagacactggccacccctgaggctgatgtgctcacacacctcccttctacacctctggtcctacccgtcacctcagcaaaccctcttttccaaagatgccggccaagcgtccatcagcaagttcccccaggagggcacacagttacctgcagcctggcctaggactccctcacattgctcagccaaacccttagaaagagacagctatttgccgcacttgagttcctgccaatccccgggcctacccctgctcacaggatgtcactctgggatctgccttccgtaaccactgcactgtgccaggctcgcctcccttgggctggccccactgccctcagtccatggtctctttggcttcctccctggctcagagtccacccaaaggactcttcagtcctttaaagctttagcactcagttccatggccagcagcagtgatttttccaattctgggtgataacccatagttatagtgaaatccacttagtgaagatcagcatttaaaaatatggagtgtggattagaatagaaaatgccaaactggttgttttctaatgataggagcctgtgccatttattgagactgctgtttctcttctattaagacacgaatgggtgtgcgctggattgtgatgtacaatgtgtttctttctatgaggtgtgagctcaaaggttcaacagttggtggattaagtgaaaattcatctgagctttcaggacgctcgaggtccagcttctccaactttctccagctgcatttcttggtattacctctccctgaacatggccacataatctgccctactgttctcagaacacacagggtcctccactccttcctgcccctgtctgagacacgtcctttgctggaatgcgatcttatccgtgcgatgttatccacacgccttcccacgcttgctctgccccactgaaactccagtttctcttctcaaactctgattggggatcatttccttgctgaggttttctgctcttcttttcttcccctcaaagacagtggtccccaagctcacaacctggtcattttatgtcacagtgagtagccattgcctgcttccctgaccatttctcgaaccagaaggaatatcccatccagaaatatggaaggaggcctttctaggcattaggccatttgctgtgcactggcctagcagcagttaacaaataggagtgccccccaactttgtaaaacttactacttagtggcagaggcagaaaataagtaggtaaccgaatcaaaaacattattataaattgtgataaatgctatgaaaggaaataagggctggccactttaaacaggattgtcagaaaaatccccaggtctcagtggcttactgaatagaagtccatgtctgttatttgaatccagttggtattgggggtgggtggctctgctccatgcagtcacgcagagacccaggctgatggaggccatggcctcttcaacatatggcttccacgtcacctaaactggatgtcttaaacaacagaaatttattgtctcatggttctggaggctagagagttcaggatcagggtgttggcaagattggttcctcgtgagggtgctggggtagaatctgtcccatgcctctcccccagtgtcaggtggtttgccagtgatcttaggcgtggtttggcttggagaaacatcaccccatctctgccttcatattcacatggcattctctgggtgtataaaaagcttcccctttttataaggataccagtcatattggttcaggggcccactctcctccagtttgacctcattttagctaattacatctacaaagactctatttccacttaagtcacattctgaagtcctgagggttaagacttcaacatataaatttttgtggcccagaatgtaatcctataacacagggtcatgcctaattgtgaaggaggctggggatatgtctcagctgtgtgcctggaggaggaggacacgtttgatgagcagctagctgtctccatcacaccatggaaggttgaaagcagagtgaccaggtgtgacctgcacgagactgcgtttctcaggtgcagggactcatctggaactgtccctgagtctccctgcagcagctccaggcctgggtctggaaactcactcatttagtgaatatctgtcgaacggaactggatttgggtttccttgtgggtaagaagagggcaggtggtgcgaagttagaggatgtggaatgtataagcagagtggctgaaacgatttagaaacaaagccgggtgtgtgtgttcatgtgtgataactgccttgtgattctggctggaaacctacggcaattctgccaactctgaccaaagccaaaaataaacagctacaggatgaaaagaaaatgtgtgttttcctcagtaaggcaattcccaattgagcagagaaagtttcggtttaaggaagacgagaacagagacgcgttcagtttccttttcccacatggaacagcccagcccctcatccactccccatcactcaaacagagtcacaaggaaggaaagacttcatggctgagggacaggaagccattggtagaggatggatcggtttgatattcctctaaggttgtgaaagatggagtgagtgttagtgaaattgctggaggctgatatcctggtggggaaacctggatttatatcagatgggcaattctgacgaccctggaggccttccagtttctggctgaaaggctacagtggaagccatcacaacacaaagcaatagtgacaatgactgccactttctgagtgctccatatgtgccagaaactggactaactacatatcaactgactaagtctttaaaacagtgcacagagttgctgttcctttctgcaaggaatcggaacatcagagaagcacagtggcttgttcaaggtcccacgccagggattcagccccagatctggctgacgccagagccaacaccatccccacagtgcagtgcctcccgtgaccactcccgtcttctactgcctgggagtttgtaaaatgcagtggctgaaggcaggcactattgcatcagacctcctggctttgtatcctggccccttgactttctagtggggtggttgcttcacctctttatgccatgtcttagttggttcaggctgctataactgaataccacagactgggtggcttataccacagatatttctcacagttctggaggctgagaagtccaaggtcaaggggccagaagagtcagtgtctgttgagggcctgctttctggctcatggatggcggtcttctcattgcatcctcacgtggtggaaggggcaaaggggctctctggagcctcttttcaaaaaggcactaaccccattcatgagggctccacccttgtgacctaatcacctcccggaagtccatctctgaataccctcactttgggggttaggatttcaacatacaaatttgggagaaacacaaacattcagtctatagcaagcctcaattcccttatgtagaaaatagacataataaaagtaattacttcaaaggctgttgtaagcattagtttaacttagcacggtattcagcacacataaatggtaaaaagatagtcttctctcattgcgagttcattcacacacttatttcaattttcaactgacatgccacctcttcagagaagcctttcttgatcaccctgtctcaattggccttgccagaccttctggcaaccagactgtttatttctttcctggcactcctcctctgccgcgtgttagctgtcctagcccctcactgacttagtttactcttctgaaaaatgggagaaccgtggcaccagtttcatggacttactgtgaggataaagtgtccagtgcttagcacagccccatccctcaaaagttgtgtcaactgccaccttttctctacccaggtctgctcatcaaccagtgcttctcaaagtgagggctccaaccagccgcttggcagccctggggaacttaccagaaacaccaattcttgggacccagcccaaacttgctgaatcagaaattctgggggcggagcccagcgatctgcattctaagagccctcaaggtgattctgacacgcgttcaggtttgggaacactgcttttcctgcctgagtagaagaacaaatacatcactgattatgagacacaccattatttcatattccgctaagacaggaagaacactgtcaactaaattataatgcagtcctgtcttatcatcatgattctaaagacattcttatttcagagatgctaaaatgtgaaaagaaaattgcatcttggcatcaatgaaatttaacattaggaatagttagaggatgagaaactgaggtctcgctcatctctcctctctagtggttcgcagccctgactgcacgggagactcaccaggctgtgcattagagttaaaaaaccctcatgtgccatctgcacccagatggaccacagcaggatctctggggctggacccaggcatcagtagtgcttaaaactccctgctccaagtcaaatttctaccctttcctaccatatgcagagatgaaatcaagcttcctggcttctaaacaaataaaaccctgtcccaacaggtgccaatcaatgtttctcatgggcctttggcatctcagtgacaatggcatgcaggacgcacccaggctggtttctacttcttgactttctgccagggctgaaggtgtttccccgctccaccgcagtggcttagaggaagtcagtttcatttgcacccttctaaatcctgacctgggagcctttttgctgatataaacctccttccctgatggtgcaagctgagctccagcaagatctgagaatcaagaaggtggggttgaactattgatgaagtctggggattaaggtattctcccctgggacctgggatacgaggaaatatttattgtgcgtttactaagagctagatctacgtgtgacctcatttcatgcttgttctaggaggtagatttcattcctattttatagaaaaagaaactgagggtcagagaggtgaagggacttgtccagggccacagtgaatagtagagccagaatttggatccaggactctgattctatcctctatacaaatgcttgtctccttccttgggtcatgagccttaggtttcagaacatgggagttagatgcaggcattctgaataactcattctattttcagtaaaaatgaagagagctccttagtaaaggctgatatttgtatgctactctgagttggtactttacatacagtgccttatttagtcctcacaacaaccctgccaatgagatgacattgtccccaatgcacagatgaggaaactgaggcagataacattgtccccaatgtacagatgaggaaactgaggcagggaaacaaggatgactactctgtgttcccacctgggaccctgcctaggaggaagagagatcctgatgataccactggtgggagtggctctgcggctctcttggtgggacatgagctccctgggggcagtgatgtgtgtgatttgtctctgcacccccagccccagcactgggcttggcccagagcagacgtttagtaaaattaaaagccaaattgtcagcgagggaagtgttttgtaatctgaggattatcagactagtgctagctattcttattctttattcaaataacaatacaattgtctgagaccagtttggaaaatgggtggcctgaagatgttgttggcctgcctgaaactcagagaattttgtgtaaaattgcttatttctagtttctctagaatacttgaaagccctagcaacactagaatcacttacgcatgtcgcaggaagagcaaccagctggagccgaggagacactctccatgagaaaaggtgcaggcccagcagtttaccacaggccctaccatgccctgtcatcttgcacccagcaagcgtcactgttcacttttcccagtaggcacctgtaggaaatggagtttgcaacaattgctttagggcttaaattgcaagaacaataatagatgcattttgaaacaggcatcgtaaatgggcatagctggcaaaatacagcagctccttgggaggtcaaagccatatcgactggcaaccttttgatcaggaaaaaaccctagtgcaaattggtgacgatttccaaccagataagcagcaacccctgtggcctggaccatccatgaccttgagctcccgggaacagcactctgtgggctgtcagagcaaatatgaacaccgtacaaaaacaggggagaggactgaggtgtcaggggaagtcgcctcggtcatctgttcagttctgtttatggtccaagtgattttgtgcagagccttgcaaagaagatttaaaagaactcgatgggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggggcctgtagtcccagctactcgggaggctgaggcaggagaatggcgtgaacccgggaagcggagcttgcagtgagcggagattgcgccactgcagtccgcagtccggcctgggcaacagagcgagactccatctcaaaaaaaaaaaaaaaaaaaaaagaactcgatgaaaacgtttttgcaccataaaacacctttcctgtcggagtggcaaaaggaatgaggccataaaaatgctgttccagccaggtctgcaggtgaatttcagtccctgaataaacattctctctttcatcagggacaatggtgagaaaaatacaaaacaaaacaaaacaaaacctctttaaagagctgtgaatgtactaggtgctcatctcttccttacaaccctgcggttgtgggggatctgattcccattttgcagatgaataaactgaggctgagggaggggaagtctcttgttcaagatcacacagctgggacgtagcaaaaccaggatggaactttaccagttactgggagggatggagcctttgacttgcccactggtccccaggggagggtaccccaggttccttccccatcctgtactctgggagtctgggggtgatgtgtgacgaatgtgaaaacacactcgctttgttggcctcccagaattctccccacagccctgaccctccttcctgagttccagctgctcaccgagggatcagtggacaagcaagccccacctgacatcttcctccccaggctcaaagcactgccaggagggcgccctcgctgctgcctgattctgcctctgcctgacttcccagtgtctgaaaaatgggcctgctctttgtcctgtaaataactccaaactttgagaacttcctgattccactctccaattctatcagttgtcaggttatactgatgtatgtgtgcgcgtgtgttttgtactttcttcccctttatctctccacttgcatcctctttgccctgccctatctgggtctcatgatttctctcctgggcccaggcataagcttccacactggtcttcctgccttgctccacccagccatcctccacccagcaagctccccaaagtcagaagttacaggcagatgcttcaaggaggcactcaaggcgttgctgcctgtcttcccattctcctcttccacctcatccctacatcatctgatctggacgatgtgctgttttctaaattcatcctcagggttcccactactgcgctggctagtgttgttccctctgcttagtatgcccttcctaacccatcttggcttgttaggaatacgtttgtctttcctgcccatcctcaaaagacccttcttttacaggatctgcctctttaatcaatggaggaaaacgcatgggttttgagcctcagatttgcaacccagctctggaaatcacttcttggagcagcagtacctccatcagttatgccaagataataacctctagctcctagggttttggagtggggaggttagagatgatcctggtgaaggcttgagaaaccataacacttcagtaaatagtaatttcagtaaagagtaatttctctctagtgttcttaacctctgaacacatcacaagctgctcaatagctaagccaaagtgaggagtgggtctatcaatcagaactttttgggtggcaagtgacagcaacccaacacaaactgactcagaaataaggagatgtattgactcatgtcaatgaaaagcacaggggtagggctaacttcaggctcagctggatccaggaccacaaatgacatcactggattgttttctttctcctgcttgtcctttttctctatctctccctattgttttcttccgttttagctttttggtttctcatttagactcttcccatatggggactctgcacagtccctactcacatcctgatagcttagcaaccctgatggaaaaagagagccggcttttccaaagttccagcacacaggcccccagctgactgactgcattggctggtcacatgcatgtcagtgacccaaacctgtcaatgtccactcttgaatcagagggctgtgggcagtcccaccggaaccacatgggctgtggatggggaagggctggttcctgaggaaactcagggtgctttaactggaagagtagggaatgaatgttgagcagacagaaaaatatccacacagcggatggaagcagaacgaatgtgcagttagttatgcttgcagacaattgtacgagagtgtcctggtatgttctgcccactggctctgcaagggcagggcctaccttccaaactcacataacacgtgatcctccagacacacctatgggatagaaggtcccctctcctcttccagtctctagtgacagcctcacagctgcccattgcccgtcctatttctccctagccatccctttctgcttgctggtgccttctgagtagcagggtgattccagtgctgctggccactcattcacagcactatcttgaacagattactgggcctctctaaaatgccgcttgttttgtctacacattgagtgctccaataagaaaatggccagttacccaacactgcggaaatgataacagtggttaacatttatgaagggctcacttactgccagggctgagcctttattaagtgctttttgtgcataatctcattgaatcctctcaatgaccctactgggaaggtaccatcatatccatccctgtttaatagatgagaaagctgagctcaaagaggtcaagcaccttgattcaggccatacaactagtagatgctacagctagaatttgagcacaaactaccacctgttacccccaaaacccatagaaataaaaatttaaaaaggcataatcttgtcccctcctctcaaaatgtcccttcctctttgagaccctctctagcctctgaatggtgagctgccatgctgtgtgttcccacagcatgatataggaatgaccccgcacaccctgtattcaccagggatctttcagttgcgagtgtcagaaacccgacccttacagcaggatgatgtagttaagaacaaataatatctactcgaaaattgctaagagtgtagatcttaaatgttctcaccacaaataagcaagtatatgcggtgatagatatgttaattagcttgatttaatcatttcacaatgtatattacacatatatcatgtgtataatatacataatatatgtatacagccatatgatctatgtatacatatatcaaaacatcatgttgtttgatgtaaatatatgcaattttatttggcattaaaaaatatcaataataaaaaacccaactctggcaggtcttaaccaaaaagaaactttaaggctcacaaaactcaagtgtctaaggctcataaaactcagacacatcttgatccaggtactaataaaagatcaatgagaaactgccttatctttgtgttgggctcattttaatatagccgctggtaactttgaacttacattccaccagataagtaacaccatggaaaaagaaagcatttcccccgaaaagttcctgcaaaaaatatcaggactgatgcttgctggcctggcttgggcaggtgcctgcgttgaccccagcactgtgacgtgaagaggcccggcaagggctgtgtttccctgcaggtggatgtgcacagcccctttaatcacacggactgagcatgggatgggtgagggaggattccctgaagaaaatcaagggctgtgaccaaagaaaggagagttggatgctggacagaaaacagtaacaaccagttgggtgcggtggtgcacgcctttaatcccagcgctttgggaggccaaggcaggtggatcacctgaggtcaggagttcaagatcagcctggccgacatggcaaaaccccatctctactaaaaatacaaaaaattagccaggcatggtggcaggcacctgtaatcccagctacctgggaggctgaagcaggagaatcgcttgaaccctggaggtggaggttgtagtgagctgagatcacaccactgcactccagcctgggcaacagagtgagattccatctcaaaagaaaaagaaaaaagaaaagaaaagaaaacgataacaatcacaacaactaggtattcactggaatctgtttttctcatcaagatgtgaacttagggcagggcctgagtctaggcacccagcatgggatttgacatcactgaatgtgaaatagctgagaaaataatcaacaataaactttttgcaggaaaaaaggacagatatcaatgttcttaaagagggagacactgcacagagtatctccagacagatttccctaggagcctgggttcaccatgcctgggctgtgtgcctccaggcaagtcacacagtgtctctgtagcctctgttccctcctcggtgaaaatgatgaggacaccagctatcatgcaagtttgctgtaaaaaaaaggtaataataagataatgtatattcaaaagataaattctttttttttttctagatggagttttgctgtcacccaggccggagtgcaatgacacaatctcggctcactgcaacctcaacctcccaggttcaagtgattctcctgcctcagcctcccaagcagttgggatcacaggcacacagcaccacacctggctaattttatgtatttttttagtagagatggagtttcaccatgttggccaggctggtctggaactcctgaccttaggtgatcctctcgcctcggcctcccaaagtgctaggattacaggggtgagccaccacacccggcctcaaatgataaattctgaggagatattctaattttcattcccctccagaatgtctgggtgtgctatcaccagctgtgcaacattcttgaagagagaaacgaatgtggcctggtagataaaagtgttcaaacattaataaattttggtttgtacaaaaaggtggcaaagcattggagggatccttttcattcactcttttacacgttcacttgggaatttcttcatccaaatatgagttgggcgtcttccctgtgttcagacagcattgtaggtattgggaatgtggcagtggggaaaatggcatggtactgccctcacgaagctgatcacccagccaggagacgggcaagtaaataacagaagagaatcagttcagatgatgagcagcaccacgtgaggaaaggaaaaatgagccgtagcccgggacagatgggccaggtgtatgtgggggtggtgggtgggggccactttggctggacggtcaaagaaagcctctgcagaggagacactcgagctgaggatcaagacagaaccagccaaggagggtttgggagcagagcctcacatggtgggtacagcagggtctgagccgtggcagctcaggtttggggtgttcaaggaacagagagaaggccagggtgtggggtgtgtggggggttggagtgcacaatgagtgagagagaggagatggggggaatcaggtgcatccagggggtgggcaggagctggggcttatcagagcagacacaccatacatgaaggaagcttggccaactaggaggatcttgcaaaccccaccctcttgccactgtcctgggcttggggcccagctaagaagggcccgaacagtgagaatgggtcaagggatgcacacagccactgtccacaccctggcctcctaggggtgatcctttcttgtttaggtgacaaggatgtgtgagggctgctgtgatttttgagagacctacaagccctggagaggaggaagggatcagagagccagacctgctcccttcagcggacacatgcctggaaggttagaaggttagtttgctggtaagcgggtgagatcaagctggggttgtgtgtatttgcagagagaaccactaggagtttggagttttaaaaccatgatatgagggctggcagggagcctgcaggagggtctgctgagacgacactgtggctggggcacaatccaggatcattattgaagaaagaggctgccccgaggaccccccggctcctcctgctccctctggtttcctggttaaatttgcagctgccctgcacttgagccaagcccatgcactttaaaggaagcatgaagagcccccagctctgcagggctgctgtcatggaggagctcctgctggtggatggcctttcagtgcgaagggtgagaagacagcttcctgtggtgcccagaaggaaatgtcaccagtggtttccacagtggaagccatggaaagccaaatccaggcaaataaatcccgcttgggcattaatagcatggggacaacagacgccccttttgtacctgggacagtgatcactataagggaacactgcggttgtcaggcccgcctgggatctagatgggcatgctattgattggtttccccactccccggccacacacacagaaccaaagctgctttttaaatcaggagcattctatgaagcggggggctttttgttctgctgagactatgatgggtttgaagtttggggaacaggactgtgggtaaattactctaacagagggagggagaaatgctagaaatccctgagaatttgggcagggaggggataataaacaggtagtgggaaatgggaggagagaaagaagacatgaaaacagcaagaggttgttcgggggtgtgatgtgactcctctttatccctcacaagtggtcagtaaaagccaccaaatgcataaaataggagcggactttccagctgggacaggtgaatcccagcgggattgcatgaggctgttttcctcacatcgtgggagactggaggaggcagttgctggtgtcggcttggaggttccaggatggcagggggtctgtgcagcttaaaggctactgggaactgcggtgttctagctggtgctttgcgggatgccataggcagggctctagtcctggaaggaagcggagcatggaggtgggaggaacacagcagtctctgtggtgtggggcagtttcaggtctggggacatgcagcagcatgtgggcatgccatgggggaagctagagcccaggaagggcaagaggccagacaaggggggctcccagagaatttgcagaaatctaggggaagactttggacttggattcaagtcagttttagccagaatttgagccgcatgaagaccaccatgacattataaccaagatgtggctttgcgcaaatcacttttcctctctctaaacctcagtttttccatctctaaagtgagggtgatagtccttacccaacaagattgttgcgaggctgcaatggggacatgaatgccagtcttggcccagtgcctggcgactagtaaacagttgtttcccatccctagacttggctttccaggctgggcgtatatccattgttgcctctacttatcctaaacaagagaaaggcctgtcacagtgtgggcttcctgagggctccagctccagctgctcaacgggtagaaagatctgatctcctgtgctaactgaggttgtggttgctgtgaaatgccttcaagaggagcttgctgctgcctttggttgctgcactacgggaccttcatgggtgctgcgcctcaggcctagacacctttccaaagcggtctgagaaacactcaacttttcagatgccaataacacttcacctcctctgggaagccctccttgaccacactctctttcctcacagaactgattggatgcatctcctctgccctctgtctgaccctgcattagtgaccttcagattttgctgtaattatctgctaagttggaaacttagaacactcctcctccctctgacctcccctctcccttctccccctcccccattttttagaaagacaaacttcaacagttatagcagatatagtgcaggtgtctgtgtccaaatcccaccatctgcctcttgcttctcccccattccttcactcactcactgtctttctcccaaaaagtagcaccagcgagatttcctggaaaatatggccacaaaaactgatcttgaagccttgtaaacaaatcccaaactcagcaagtccttggcaacaggcctgaactcatttgaaaaaaccagtggtcatcatctttaaagtcaatttcatcacaccaagaagacttaagttaccatttacagatgagggcagctgttcctgggacctggccacactctgtgtcatagtccctgagacacgcccagggctctgttcctacatctgaatgaatcaacataagcaagacttgctagctctatagcaaatcacacccattctcacaggcctttcaggagggatgtcctctccctcactccactatggaatagggtggtcctgcctcattccagacccagggtcctcccagtccctctagagccatcctgatcctccctcaccctgagatctcacactctaaagcctaaagacagtggagcagcctcaataccctccagtttactcccatgaggcactgggcgcaccatggtcaattatgtaaatgaacttccccaaggggtagattttaggccttactgtgtgccaggcaattatgttgatgactgccatttattgagagttaattatactttctgaaaaacttactttatttttgatatgaaaaacggacaatgaaggatctctccaaggtcctccgtccagaaatgttacagagactcgagcccaagtgactgggctccagaatgtgggaactaacaattgtgctatgacaccgtctcaactttggttcctttaatattcataagagttgtaggaggtgagacatggtcagagaggttcatagcttccaagaggggtcagagctaggaagtggcagaacgaggcgttgagctcagggctggctgagtccaggtccacagctccctcctggcccatgtgccttggtcccagcctctgtcatctgcctgccagtggtgacgggcttacccatgaatgcatctgctcttccgtctgtgaacagcacaaacagttaatttcccccagactgatcacttttgtctaacatctggtgcttggcgagcaacacttgtgtctccttcaagggcaacctactctggtaaaggttttcagctcttcctcaaagctggttgaaggatcttcatatgagagaggggagctgggactgggctagaaagggacttggccaagaggaaaccccaaatctccaacttccatccaggactctttgcttgaaccatcaaatgtctttgtttgcttacttgttcattggccaccaaatcagacaaaccctgagtctagagcagagcacagtgcactgtagttgtagaatatttatcaaatgaaagaatgaaaccagcatccatccatcaaacatttgaggcacacctattctgcatttgaccttgtgcaaggcatggagaggaataccgcgtggtctctgccctccagaaacactcaggagctcacattccaggaaaggaaggtaagtagacacttgtcgcccagtgcaataaattagtaggcgtgagggaagtcagtgcgggtcacagtgagttaacaaatggtccagagtacaggctacatgcctggcctgctgaatggaagggagattaattaattactcagactctgcctgccaagttgtatggaactctgcttgatctctgaccctctcgctttaaatactgcccttaagtcatatattctgagaaagaaagagtcatctccccaacttcagacgaggaaatagaacagagccccaagatctgtcttggttctttccttgctaacaggccctctgagtaaatccgagtaaaaaattaatcagacctcactaataggggctgtgtttttggctgggtaatagaatgtgctgagtgctgcggccgccgccgcgccccctccgcagctgcatccccagtaggtctgtaatggggcttgaaggagaaagtctcagacatctgccgtcaggctgcaaatttgttttctttggtaaccttgactccagactgatgggttgatttggcagttcctgcctctgggggacagaggctgctctcaggaagctggtggggggctctaggatgtgggactgagacagggctgagctgttagggaccaagacacacccagcttagcacacggcgtgcctggctcctccaaactcatcacagcccccttgttgccatgcaacggaggcttcttccactccaggccactgtgcacccacaacccgtcttgagggctggcagacctgggttcagagcctgtctctaccactccaccagtcaggtgatcttgaccggtcccttcccttctaagttgaggtgaaatcatttacagaatgggcatgacaataacatattttttataaagcaaaatatcagaagctatccaaatttgatttaagaatttcatactccaaaaccacatatacacgtgcacacacacacacacacacacacacacacaaacacacacacacacgcacacacacaaacacacacacgcacacacacacacacacaggaccatgcaaagatattcaccgaatctttgtcttataatggcaaggaatggaaaaaaatgtaatgttcaccaatagacggtgactaaaaattttggggtgtccaagttatggattattttgctgctgttcaaaagtacaaggtagtcctatgtgttctgacaaggaaatatttctacagtgtatcatgaacttgggaaaagcacgtctcagatcgatatctgtactttgactttcttatgaaaacaaaacaaaatctcccaaacccaacatatcagaaaactggatgtaaaatgaccagtgaaggggagacctcgggctggttctgctcagtcccacctgcctgttgatggagggccttttggtctctcccacagcctccctgccgtctttcagttcctgcaagaagtgggagaggtgctcatgagggtccaaggaggttgagggggtggtggtctgcccaggtaagtcagatgggagctaagcagtgctggggctggtgcgatgttgatggatgccatgtgagctggcagggatgggtgctcctgtttcacccacagcaagcacagctggcccccccccactccttggcactgctgataaacagcaccccctgttatagaaactggactgtccagggggccacaccaggtccaggtgaaggcaccactcatgcgggtggaagagggtggcctccaaggccagtgcccctgggtctggcttcttgtcctgggctctctctgagcctccgctttgctatccttcttgtcacctcttttgtcctttctcctttccctccttccctgtatcctccttgatacagcaacttcaggaaggggaaaattggctgtgacaatgcatctttatcttttgtacctttgcaatcggatctaggatttggaaatttgaaagctaagatctgaatacatttattccctgttcttttgtgaggatctaccctgcagttaagggatgtttcaaattaaatcgtgtgaaaggaggatggccactcaataacataaagggaagggggatacattctgattagaaaaccagaatgttataactactgctactgctgcttattgagatttaccacacacagactaaggtgcacacctcttttgccccttcttggtgaccccaacaaagcgattcccttgcctgcttcctgcatctttcatctcgtagacacttgagtttcataatccattcatggtcattatcacgtattgtcagctctcagcgttcaaacaaaaccctcagctctactttctctaattaagataaattgctggatatttggacgctatcagaaaatgtggctccccactgcctgcttatgagaaagaggggcagggtgaaccctggagcttacagctgtgatttcttcctccctagctcctggatcccttcatgtcatcctcctagtatcctattcctgcacccacactctgcatctccctcctccacaaccctcacctggcaattcttcccagagcagccggagacttcttttccaggcagacaccagatcatgtgacttccatgaaaacccttccatctccctagcagcttaggataaaggtcagaatcctcagctgtcttctcccacccgcgacccgtgccacaagcaccccctgccccataaccccctaccaaatgacttcctctctgtctgcaatcgccaggctgtctcccactcagggtttcttggtaagggatccaagggacatcatcccactttgggacccaatgctcccactccccagccaagtgccaccttacagtgacactttctgcaattgccaggctatccctaatgcagttgaagccctgagacctcaaggggtggaggcagctggaattggtagcacagcagtttggatgcaggcacctgaactagcttttgagtgtgtgttgttgtgatagtggaagcttatttgtgctccagcaaccacctaacctctctaaataagagaaaatattctctgggtggcccccaagagggaggcctgatggcacctctcactcacagcccaaggaagctggacacacaccttctgctggttggacctccaaatcagcaaggaagggcccgatcccctaagggtcctaaggctgctgtggagaccgcgcactgtctgcagagtgagagatgcacctctttggctggggagcctcttctttgttccccagaatatgtggcaagctgggaggctgcacggaagcttgtttatgcttcctccgtactccatctgtctatggacaaaggccacactgtccatcttggaaaccagaatatttgtcctggagcagacaggactctcgtgcctgccaaagtccccttgaccttgaaaatttctccccaccagagcccttgccccggcttcgtggacttttctttcaccgtgcttatcgtggattgcagccacgcacgtgtctgtgtgatgattcgatacccgtctgtctctctcactaggccatagtgtcgtaagagcacttggtacacttgtctttagcttggagccttgcacataggaggtctcattaagcatttgttaattaaatgagtgagtgagttactgaccaaagaggctgctgatggctgagtgactccacctcttgaagtttcagccccttcatctgtcaaatggacaaggtaatggttcctgcctcactggttattgtgagcaccaaatcctaaacttccagacagattggccaaattaagcattaaacaagtcatgttgagcctgtgctatgcccccttgtgctgggcataattttatttcttccccttcctgctctccttcagccctaggctgcacttcttaccccatgggagtttgtaaccaagaatctacatttctgctcccatgcaacagatgaagctctctaaaacgtgacattgttaggctgacttcgccaggacagcacatctttttaataacgacaagatgggccaccatttattaagcactgactgtattctggggctctatgtacaccatctcatttaatcctcacgtcaacccaagaggataaggaaatcattatttctagtgtcagtagggaaacatggactggaagggataaaggaatcttcccagggttgcatggctggcaagtgcccaaggtgggagtcagctccaggtctgcccaccagtcatcggagggccaaggctgtgtcttattcttctctgtactctatcttcctagactaacaggcaaagagaatttctgggcacaactggatgccagaatgtggtttgcttaggaaggatggggcagctctcacttcgaggcaagctctgcagcatggtctgaatacacagtagggacagggctcctcatgtccctcctgggggacaagcctgaccttcagcagctcatgtggcccctctaccgagcctccacttcctccctggggactatggtaattaataatatactctgtgtccctgagctctggtattctcgcgtctaaaatgcgagtaacattactttgggttaatcaagggaagcttttaaggcactgaataaatcacaggacttgaaaatgctgactccttttcttgatcttcaacctggccgcttttctttttctcacacataaatgaaaagctacattaatattaaagctcacattactttgtccaacatctgtgaatatggaccagccagctgtgctgctagcaccccgtcacccccacatggaggatttcggaggcgggcacacaggtttgctctgcggcaaacctcacccgcttgccttgggagcccactgagcccccaggtgacctcagcatctcagttctggcttggaggcattttagggtatgggagggaactcttaattatagaattatagacatctgagatttcctaaaatggccaagaacccccaaatgaccaagcagagcatccctgtgtccccatcgacccagccagctcttttccttttggcctcagggatgtggtgtcccagcagtcccaccagagcaggtgccctgatgctctctgagaggagccacctacattacagccccaactgtggatgacatagggccttccagagtgctccgaacccggggctcctcaggcttctcaggtgggatggggataggctgccaatctttttgcaagaagctgccacaacaggcccatgaccttgaggcctcctgttcccactgccctactgggggtgtgaaggggagctagctggggtctcatctacattgtcattttccagccccgagaggaggtgtcccacatgctcatcactgccgtgctgagcaggcctttctgagtgggatcctgtgctggtctagagcaggtgctagaaacctgaaccagagttgcatgcactgccagaccagggcctcgtcctttgtccagccctttctatgtgttagaggctatgatgcacatctgaaagcatgatggcaatcagaaccaccatgagactggaacgcgtgctccctgagcgctgggactcgccttattccctggtgtctcccaggatcctcctcagtgctttgcacactgtaggcgctcatgaatgtggagcccttgagcagaaatggtgctgatgaagtgctgggatggtgaaggcattgtgctgcgctcctcactgccccagttcatcgaacccacccgacaacaaccacaccaggcaagcaatatttcccaccatgttacagaggggaaacagagccatagagaggttggtccagctgccaggggcacacagcatgtgcatggccagaccaggattcaaagctgcctctgtcaacaccaaagcctgactgctgagccacactccctcccaggctcatccctcctcccagaatggatgcctggcactcactacggcttgagttacaacaggcccaagttgtggtgggaatgcaggagaggaaagggttaattctgcctagtgcagggagaagtcagagacctggaaagccaggaagtgacatttgatctgtgtggcttctctgtcattagcttccttccatgctggcattggtttaattcgaattcattaaatgagaataaaagttaattgaaatcatttgagcaagtgttaaaaggctcaagtcttgcctggagtaataaagtacaaaatgcatctatagcctgctggcaagaattttctttgtaattgtatatactttaaataggcaatttctgcatatagaacagactttaaaatatgcctttcttgccccattccctgcgctcacctgctccctagccatccagttttcttctcagaaggtaaggactattaccagtttatttgtgggaccatccttaggtactccatgtttgtaagcatataaatatttatcatgtttatacacaaatgacagcatgttttgtactctgttccacattgtggttttcttttccacttctttgttcatatcggtttataaataattattttattctttttaagaattgtattccattgtatggctcttaacacaatttatttaagcagtctcctattaatgggcacttaggtttttaatcttttgatatcattatactgtaatacaaaactctgaaaaaaaaaaaaaaaaaggcagggcatggtggctcacgcctataattccagcactttgggaggccgaggcaggcagatcacttgaggccaggagtttgagaccaccctggccaacacggtgaagccccgtctttactaaaaatccaaaaattagccaggcatggtggtgcgtgcctgtagtcccagctgaggcaggagaaccgcttgaacctgggaagtggaggttacagtgagctgagattgcaccactgcaccccagcctgggcgacacagtgagaccctgtctcaaaaataaataaataaataagaataaaataaagataaaataaaataaactagaactccatacccacatcaatttgcatgagcctgacagtagagctgtgagataaatactcagaagtgtaatttctggacacatccgggctgtgcgtttgtgactgcgggaggtataaccgcaagggttccctagagtgcgttgcatcttacacccccaccagcaatagatgagtgtgactgtttccctgtagtcttatcaacacagggcactatctaactttttgatttttgtcaatttggtagttgaacaatagctttcccaaccagctttaattttcctgtctgttactgtaagttctaaggtttaggacgtcttcacctgtctcagagttattgaagcttcttattctgtgaatttctctattatttgatggtgatactctggagaagctgcagctagagatggagtacctctgccatctggatggttctggggaaagccactgggttctgttcacaactcatcagtggattccctgaaaaccagcaactggcctagactttgccaggcaggtagaggctgtggaggggagagcccagacattcacagttcacacacctgccctccaatctcagctcctccactgttatgggctgaatcatgttccccaaaactcatatgttggggtcctaacccccacacctcagaatggaactatatttggagatagggtcttaaagaaggtaactgagctaaagaaagtgggcccttgtccaataggactgagtccttatatagaaggaaaatctggacacagagacagacagaggaaagaccatgagaagacccagaaaagatagccagccacaagccaaggcgagacgccaggaacacatttttcttcacgaccttgaaaaggaaccaacccaatgacatcttgatcatggacatctggcctcagaacagcgagacagtaaatttctgttgttctttgtctgacagccctaggaaaccaataccgccactgagtggacagcgccctgggcaaggtgcttcacctgtggaggctgttttctcatctgcagaagggggatattgaccccttcctcacagaagactgcaagagcctggctcatgcccgcagtttaaggctttaagcatgagaggtagcccccacccactccatggtggacccaaaggatctcagttcagatcctgagaaggaatttgcttcaatcacctgagagatttgctcagtgtctcacacatccacagccaaggccacgcagcagagtgaacgctggatgcctgggctcccacttacttctgccatcaaatgaaggcttattagcctttctgagctttagttttctcatctgtgcaatgaggaagagagtggatgcaatgatctctaaggatgctctgactaatattctatcatttgctttgaggaaggtaatcagatgaatatattcattctctgcaaatgagggcaatgcccatacatgagatcacagtttttttcctaatgctgctgcttccttggaaagtggttcctagaagaacagcttggaaggggaaaccataaactgatctatgaagatagtaaaccagtctttctaaagaaatcagtgatttacctgtagctagctgccgtacttactacaattgtccctgaattctattatctggaggtgggctaagaaatggcaatatttctctcaagcctatcatggacaaaaaatatcgagttcactactacaaacatataccaggcacctactgagtgtcaggggtggcactgggcccaggaccattctgccccagcacaacgtcccagccctgccctatgccaaccatcaggctttggctgagttgctccacgtttctaagtgtcagtttctttgtttgctaaataccttttataataacatctacttcacaggactggagagacccaagggggtagggtttgtaaaggctctagcctggatccaagctccagagagggtcgctctgttattggcatgacgtcatgtcttcgccagtgaccatcctaaggaccaggctcgagcacatccttttgggagtgctaggatctaattagtgtctggggcctgctgctgccatttctggcttggtctgagtcatcatcaattatccggcagccgggggccagagcagagcctggcaaggaaggacggagcatctaaggatggggaccgcctgactgccacctgggcaccttgtcacagtgcaagggcaggagtgaaaatggcccaggtctgaacaaagtatctgtccccttggacaggccaggtttcccttctggaaatgggaatggggtgatctcttcagcccctgcctgggctatcatgctgggactctagctagcttgtctccatgaaaggtttagaaattaggtgtaaaaaatattttcatcgtgataaaatacacgttaacgtaaaattttccttttaaatcattttagttgttgttggaaaaaatactgtattttcttgaagacacaatatacatatttcataagttaatgtttgaacaggtaggactgctctttcaaagaatgtctccattttaatgtgatattgtttcttgttatctttatttaggttttattttcttttttcaaccttcattttagatagagggggtgcatatgcaagtttgttacgtggatatattgcaccagcttgtgaacacaggactcaataggtactgttgacccatgctcccttcctccctcccgcctctagagtcctcagtgtctactgttcctgtgttatgtccatgggtgctgaatgtttagctcccacttataagtgagaacaggcagtatttggttttctgttcctgcattaatttgcttataattatagcctccagctgcatccatgttgctgcaaaggacatgatttccttcttttttaaggctgcgtagtattccatggtatatatggaccacattttatttatccggtccaccattgatgggcacgtagtttgattccatgtctttgctattgtgaatagtgcagcaatgagcatgagtgcatgaacaggagtcttttgatagaatgatttattttcctttgggtatatacccagtaatgggattgctgggttgaatggtagctatgttttaacctctctgagaaatctccaaactgctttccacagtggttgaactaatttaccttccaacccacagtgtataagcattccctttcctctgcagtctcaccagcatcttttggttttttgtctgtgtgtgtgtgtgtgtgtgtgtgtgtgtgtgtgtgtgtgttgagacagagtctcgctctgtcaccaggctggagtgcagtggcgcgatctcggctcagtgcaagctctgccccctggcttcacaccattctcctgcctcagcctcctgagtagctgggactacaggtgcccgccaccatgcccggctaattttttgtatatttagtagagacggggtttcaccatgttagccaggacggtctcgatctcctgacctcgtgatccacccgcctcggccccccaaagtgctgggattacaggcgtgagccaccgcgcccagcgtgtgtgtgctttttttgtttggtttttactatttatttatttaaatttttattttcggttcagaggtacatgtgcaggtttgttatacaggtaaatgcatgtcacagaggtttgaggtacagattattttgccacctaggtactaagcctagtacccaatagtttttttctctgctcctctccctcctccaggtcccagtgtgtgttgttcccctctttgtatccatgtgttcccatcatttagctaccacttgtaagtgagaacatgtgatacttggttttctgttcctgcattagtatgctaagagctctagctccacccatgttcctgcaaaagacataatcttgttcttttttacggctgcatggtattccatggtgtatatgtaccatattttctttatccagtcttgcattgatgggcatttaggttaatttcatgtctttgctattgtgaatagtgctgcaatgaacatatgtgtgcatgtgtctttatgatagaataatttattttgggtgtatccccagcaatattactaggtcaaatggtagttctgtttttgcctctttgaggaatcaccatagtgctttccacaacggttgaattaatttacactcccaccaatagtgtataagtgctcccttttctccacaaccttgccaacatctgttattttttgactttttaataatagccattctgagtggtgtgggatggtatctcattgtggttttgatttgcatttctctaatgagcagtaatattgagcttttttttccatacgcttgttggctgcatggatgtcttcttttgaaaagtgtctattcatgtcctttgcccactttttaatggggctttttttttgtaaatatgtttaaattccttatagatgccagatattagacctttgtcagatgcatagtttgcaaatattttctcccattctataggttgtctgtttactctgttgatagtttcttttgctgtgccagagctctttggtttaatatgatcccatttgtcaatctttgctttcattgcaattgcttttagcatcttaatcatgaaatctttgccatttcttatgtccagaggagtattgcctaggttgtcttccagggtttttacagttttgggttttacatttaagtctttaatctatcttgagttgatttttatatatgatgtaaggaagagctccagtttcaagcttctgcttatcactacccagttatcccagcaccatttattgaatatagagtccttttcttattgtttgttttgacaagtttgttgaagatcatttgcaggtgtgcagccttatttctgaggtctctattctgttccattggtctatgtgtttgtttctgtaccagtaccatgctgttttggttactgtagccctgtagtatagtttgaagtcgggtagtgtgatgcctcctaccttgttctttttgcttaggattgcattggcgattcgggttcttttttggttccatatgaattttaaaatagttttttctagttttatgaagaatgtcattggtgctttgataggaataacattgaatctgtaaattgctttgggcagtgtggccattttagtaatactgattctttctgtccatgagcatggagtgtgattccatttgtttgtgtcatctcttatttctttgagcaatgttttataattcttattacagaaatctttcgcctccctggttagctgtattcttaggtattttattctttttgtgacaattttgaatgggattgtgttcctaatttggctctcagcttggctgttgttggtgtataggaatgctagtgattttctatcctaaaaccttgctgaagttgtttatcagcttaaggaacttttgggccaagactatggggttatctagatatagaatcatgtaatctaaagacagggatagtttgaatcactctcttcctatctggatgtcccttatttttttgtcttgcctgtttgctctggcaagatttccaagactatgttgaatagcagtggtgagagagggcatccttgacttattccagttctaaaggggaatggttccagcttttgtctgttcagtttggtgttggctgtgggtttgtcatagatggctcttattattttgaggtattttcctttatgcctagtttgttgaggacttcgaaaccatttttaagtttgtagttcagtgatgttaagtatattcacatggactccctacctccagaactttttatcttcacaaactgatagtctgtgcccaggaaacaataacttccctttccccctttccctcagacactggtaaccaccattctattttctgtctctgatttgactgttctgggtacctcacacaagtggaatcgtgtattatttacattcccatcaacagtgaacaagggttccaatttctccacatctttgctgccacttgttttctcttttttgacagaagtcaccttaacggtgtgagtaaaagatttataaaacttttgctttgcgtattctttgtgaacacaagcatgtcttttgcgtataaacctcaggtcattaaattaagcattaagtgtgactttctttaatattatatcattatctaatgcctactttaacttaccactctgctaagtggtggaaaggtaatcacagtgattattcagtgtcccttccttgcatcgaagttgtatgtaacttccagagagttcatagtgccaatgtgccggatgaggtggatgatgagatgggcatctgttcctcactgttgtcctataggggcacttgctgagatctcctcctttccaccgttgggcacatgtgttactgctaagtcactgtgtcagccagcatgattagttgcagatgacagaatctactccagtagtttaagcagaagaagatttattagaaggctggaagttgcacagaatatctgggaaggcctgaggacagaatttaaatgtctcactccaagaacaacacagccaggagagacgccacccactgcaggactcacacagtggacacgcagcatggccgatgatgcctgcagcctggcatgacaattcaggactggatactattaccttcatcgcagctgctttaaaaggagtggacctctccccagcccttctgaagacaggatatatcctccccacaaggccttctttgggccctgccacgaatctggggaaagtagggtgtgctttgcaacctaatttatggtaaaagtagggaaactatcagggagtttgaataggcagcagagagcagactacagacgacataatttaaggttcctgattaaaggccgtttatgcatctttgagctactcccaggcagacccctggggccttcttgggctgtctgttgtgtcatactgcatggatcccctcttctggatgttgttacctcccaaggctctacccggaaaaacagttatggtgccctctgcttttaggcctggggtttccatcgtcttccccaccctgggattagagagcctcccaagaaggacagggcacaagagcctcctgagggaccctctgccatgaaactctcctctctcctgccccaactttcatacgcaggggtctcttgatcttgttttggtggtggggatctggttcttttttatttttttttttttgacagggtcttgctctgtcactcaggctagatggagtacagtggcacaatcatagctcactgcagtctcgaactcctgggctcaagtaatcctcctgcctcagcctctcgagtagctggaactacaggagggccaccatgaccagctaattctttatttttatttttttgtagtgatgggatcttgctatgttgctcaggctggtcttgaactcaagcgatccttccacttcggcctctcaaatgctgagattatgggcatgagccatgccaggcctagttcctctgtatctattcattctcctaaatttattgtattgtgtagaattttgcaagctcccctgggggcctcagcttttaaaactgaaagggcttgcttagctttccttcttggaggtactaagtacaacctactcaccctggctgtttgggtgagtgaggggacaagggctatgaggaaatgcaaggacaaaaaccatctaagcacttcagcctattgtcccgctatgtctaatgtgtcctctctgtgtctagttggtcatcaacacaatctcataggtttatactcttagaacaggaaggaggggacagtgacactccctagggagtgcagaacgggggccagagcaggggccaggcaggtgcacatgtcatctccaatcctcacaaaaccctgcagggcaggtgttgctgcctaatatcacagatgggaaagacaagactctgggaggtaaactcatctcatagagactatgctgtgacggggggggagctggcactctctcatatctttctaattccaaacccggagcttttgccaacagctcttttgtgaattcactcattttgaactttccatcataaagcaagaattcatcttttttaaccatatctgccctgttgaagtgggaagccaggaatgttacacatttagtctgaaggctaaatttctttttgcattctttagataattctgattttctgctcatgcccttggcaggggaagacaggagcataattagaactgtgacatctgaagataaaggaaagctgttttttttcccccacctgggtctgagcttggtattcttcgatgtggaagcaatggggctgatgggggaggagcggagaacagtgagatgcacctgctcattgagagctctgctggcagccggcattcctttctgcgttccagctgatctgcattcctgagcgtgtggtggccattgctcatgttcaccaatgactggctctcctccccttccaggtgcacagaacatggcatttctcaacctcctgcagaggggcagggatgctggaccagttccagtcaatgaaatgtggatggaagtgatcgtaaattgaaaacactgtaagtcagaaatgcatttaatctacctaatcctagcctaccttaaactgctcagaacacttacattaggctccagttgggcaaaatcatcccgcataaaacctatcttataataacatgttggatatctcgtgtaatttattgaatactctactaaatataaaaaacaaaattgttgtaggggcactcgaagtatggtttttattgaatgcgtatcacctttgcaccattgtaaagccaaaaaatcataagtggaaccattataagccggggactgcctgtagatggggccacgttgggagggggtattggtgctgtgtcccagtgacatgaaaggaaagcaagggtattgctggggaggaggatacacagtcatgaggaacctagagaatgcctatctgcctctaggcacagcggtgtgtggggtgtgagagagaacagcctccactggcaagggccacagaagtcctaacattatcaaggcttaaggccgtaataacattagtccctgatggccccaaggtatattatatggtggctatcagcaccggtagggtttagggaatcttgccaggtgcagggagatttctgaaactcccactcagtatcatttctggatgtggatcctgcagagaagaggagacccctagggaatggacaccccccatcaatgctgatggtttcctacagaggaagtcttgcagaaagcacgctggctccttcttcaaaccaaattctggcagatgccaaagcccatgccttcctccacattgtgtcagctccttggtgaataaactctggtggtttatcctgggttgtaaattatcttgccaggcactcttatctaagagttgagtcctgtgatttctttcaaaggatctattgttgagatttctaattttcaaacattctttcagaaagttgatggggtatgattgccaaacaaaagctaacaagaacttatggcgccatcagttcaggaaagaaaatgtcaacggctgaacttagccaatgacatcaaccctacattttcacttaactaaagaaagaatatttttagtctttctgctgcctcttgaaattctctactgatttgacttggtgaaggacatcttgaaaatagcaagaactgtttattgaaaacctataccgaggacctatattagtatccaccaaaatttattctcttcttccagagtagtggggttgaaactgggtccacagctgcccaacggcccaacaaatctctgttcccagcatccgctgatgcttctctttggggccttaggatcttgggatgcttgctccatgcctcagctccagccactcagccaaccaccccagaatgccagcaacctggcccctggattaccatgtagaccagagctgctctgtcatttcagcactcttctggggcaagaatagacttctgtgttccttcagactgtgaatgattttccctctttcttacagtagctcactgctcttcccagtaccacccctgtgagctgggccatgtgctgggcattttgcagatattatctcgtggaacactcaccaactctgtgaggtaggattagtattctcttttacagatgagaaaatgggttagggcccaagtgtccgttgacccatagcgtggaaaatgtggtatacatacaaggtggaatactactcagccattaaaaagaatgaaataatgtcttgcagcaacttggatagagctggaggccattattctaagtgaagtaactcaggaatagaaaactaaataccatatgttctcacttataaatgggagctaagctatgaggacacaaatgcacacagagtgtataatggactttggaaactcaaaagggggagggcgagaggggcgtgaggagtaagaacctacatattgggtacaacgtacactgctcaggtgacaggtgcactaaaatttcagaaatcgctagaatataattcattcatgtaaccaaaagacttttgtaccccaaaagcgattgaaataaaaaaattaaattaataaaaaaagaaaatgggttgggggaggaaatgttactagtccaaggccttagagataataagtggtggaggctgcccctgaggcccggtccttggtccttccacacatcacactgggataaacaaagaaaaacaaacgcacacacaaactgggaggaaacaaaatacacagcatcctccaagcctatcaaggaaggtcggttgctccaggagatcagcatgctgggacctatgtatgtcagatagcataatgggctgttaagaatgattaggcagttgctgctttcccccctctgtgtctttggctacatacttccctccacttggaattcattcccaaacctcttcaccctcccaatcctccatttcttgccccctgaaatcctacgtacctttcaacatccactttctgatgtggctttcccatgagatgacctcagaatttgctactggaagagaccttcagtagatatctgtaaattgaatgtttcttcagttcccccttaccaggtgcacctgaatttcctgactgttgaaatttaagggggattgactccacaattgagtccttattggttttagcctggccacagtgatggattcaaaatgagcacacaacccaactcaggccaatcagagccaataggactcaacttttttggttcacattgactaataaggcagattttctttttacgtactagatttgaataaggaagcatgtgacccaggatatcactggtgggcatcttgccaccatgagcctatggggactgcaaccattctgaggaagcagaaatgtcagattccatttacattgttagagcagctggatcacacctctcctgaagccactgaaccattcagttatggaagccactcagttgtatttattgtgaatggctatagtcttccttcccaacattttccctaacctaatggcccaaaacttttagaaaggaggaacctctttccttggataattaccctggtctgttggttttgggttcccaggatgtacacagatgtcactgagaaatttctccttcctatagtatttctcttgggaaacaaaacccataaaggggatgttaaaatgaagttctgagactacaaataattctgtaacaaaatatttttctataattacaacttctctcaaaggaacatgaaaagcaaacaaaaaaaggaaaagaatgaatggatcctgttaaatgaagcaagaggtggagtgaagtgaaatggattctgttagatgaagcaggagctagagagaagtgaattactctgcttaatggagggagaaaatttttgaattctcagagcagttcaggaagacaatatgaagatgcaggtgatatgggaaagaaggtgtcagcagaaattctctgtgggtggtaagatgaggtcggtgggagaagagaaagggacatttgtaagcacctccctctgttccagtcagcactcttcatcttcttatcttggataaagcctactgcatccatggaataggtgctaataaatattaattaaataaatgaatggatcaacaaaccagccaaagttacaaggactttacaaatgcacatcaggaaaaataactctgaggttaggcaaatttccaagtgataaaccttaatgatgtcattttcaataagtgagctagggtgaaacctgtgccaatgctattcccaaatatagataaatctgcctaaacttactcccttatccctcatgcctcagtgatatgaagatagaatgagagaaagataattgaaactgacacagagtctctttgcatagagagtcctgtgcggctgactttacctaacaggtcagttcttatctagggactagaggagaaactgtgatccccccaggccagaggctgagggaagtcttgaagcttgaagaatacaaagctgcagaagaaggaacatagtttccaaaacgaaagttaattaaactaatgcatttattcattcattcgattgttcatccattcttcgccagtgtaccaggtgttcgtgaaacatacattcatggagtgtgtagtctggcgggagataacaagtaattataaaaatcaaaggaaattcctttcttccttttataaagtaaaggaaattaattttataaaaacaaataataaatgtccaaagaaggatgtagaagtcctctgaagtctggggcatcaggaaaggcctccccaagggacatgggcaggaccacgtcgcgattttaatgagtggtaagcacttttgcttccatgggcctcttcctttcttaaacaaattaacaagttattttatggctatattggtatgttggtgataaagacgagtatatttctggctgtattctttattatatattcattatggtcctatcgacatttttctttttaagataaactgaaattgaaacactttataggcccatgatatttttagggcatggtgcctctggcgcttaatgaatatgccggccctggaaatgggtttgggctcaggtcctaaggagccagacgagggtcactcaagagcagagaacagcctgtacaatggctttcatggacacatcctggcaaggctggggtctcatgggctgggggtgaagaggggtgagctgggggtgaagaggggtgagctgggggtgaagaggggtgagctggggttgaagaggggtgagctgaggcaggaaagcacaaagggtccacattacgggaaccaggcttactttttaagattcctctggctttgcacctggcatgatccttctcccttcaagatccacctggatgctgcctcctccacgggccattccccagtcttcccatcctggatgactctcctcttcctcccccagctcccacatcctccatctgtcctgcctagggctgacatctgtgccctaatccctcttgccaggactctgggtttcacaggataggcactcactgccccagcatacgtggagagggagcttcctggttcctcctacaagggacatctccaggtgtcagagaatgcctgcagcatgcagcctctattcctggtgctgccttcctctatggcgacgccaatctcagttggagtttccttgtgttgtgctgagaaggctctcacagccttgtctcagaaaagattacaaaattgcatttctctcactctgggggggtcatatgcccatcctgagccaatcatggggctaggtgatagggtgctttgtatggctaaatctggtcgtatatgcacctcttatgctcggagtggagtcaagttcactcaaagaccaggggctgagtaagggaaaggatttttccaaaagaagagggaggtgctgttcccagcataggattcatgagtgagtgggcatagcaaaagatgaagcctactctgtactcccgccgtcagtgagtgccaggagtgggggaccatgttactcctctcggatgcttggagtagtcatggcaatgccttgtccaaagcccagacaatattcccagtagagaaggaaccacctgccaggaaacctcaccagaactaaatccgactccaactacacctttcaccagtgtggtgaccaaagataaatcttttacaatctcttggggctttatttcccccagagatgctgatagagagctggttataagatagccttcagggacacgctgggtgaatgtcctccccctccatcctcagggggtactggtgtgttcaccttcactactaatgtttggattccctggagtcaagaatcatgtcgtatttatctctaaacctcagttttcttacctgtgaagtggggataatttcaaccttgaaagacaattgggaaaggaaaataaaatcacgaatgcaaggtgcttattgaaaaaaaaaaatgaatgaacccaaagctgaaacacaggtaaattatgctgtcagtgtcaaggaaggatgagggaagaaaagaggagagtggaggaaagagacataattcttcccctttttgttcttcacaacagcaagcaaaggcagccccgcagagctgcaggctcaggagggcgggagagctgctggcaaagctgttattcccaaggctgttaattgtgggagcgtttgcttctctctccatggcatttttggctctcaatttaatatccccccttcctttttgagtagtttcaaatgtgtaaatatctcagagaacgttaaatcctgaaaagggggagaaagtggaaggagaggaaggaaaggctgtgtgtaggggaggagagggtgttgatacaacattatagagcttcagttggaaaggaaaagaaggaaagaagtgggacatggccatgagaagagaaggcaggccagcgagagtggcctttgtggccagcacctatccacccagcccccacatccctctgggccagccctgcaggtgagagctctcgatttgccaggcaccctgcaaagctctttcaaccaatcttgaatgaaatgtaaggagatgctcacattgtgcatgcagtgaggggagtttctccttatattttgcatcctcagccctcactctcaccccagtctgggccccattcataaaaaccttggaggaagacaggattcccatctcctctttacagatgggaaggctgaggcacagagagcctgagtaagtgaaccaagctcacacaggagacggatacccaagattcaaaatcagaccatcgggattcagagcccacagttgcaaatctttactctcatgccttgatatgcccagagcaccccgccccaaaacacccaaaacagagcttctggaccagaaaggcctcaaacccatttcttccccctctgtaacattctgctactggccctctgttgcagcccactccctctcccctaatggagagggagatacggagtggggaggatgggagggatcatcgggagacatggggcggcctttctgggagccttctcctgtcacctggccagtgctccacactgaggtcttcagttccagccctgggctccgggctccctctcctatgctccagctccgtggagcagacacagacctcaaattttacaggacttatttgccagctggggagaaagggaagcactctaaaacagtggcttctaaaacaaagcagtttattgagatataattcacacaccgtaccatggattcatttaaagtataaaattcgacagcttttagtgcattcacggaattaacaattctcaccacaatcaattttagaacatcctcataccctaaaaaataccctgccacttagccatctcctctccacctcccagcccctgtcaactactgatctactaatgtactttctgtctccatagatttgctttttatagacatttcatagaaatggaatcatataacatgtggtcctttgtgactggcctctttcacttggcatgttttcaaagttcatcctgctgtagcatgaatcagtactttgctcctttttatggctgaatactactccatcgcatggatacacgctttaaaaaaaagatgtatcagttgatggatttggggtgctaggtggctttttaagggatcagacaatgcatacagctggtaggggaagaaagacagtaaaatggtttaatcctaaaacagcttcaactccaaatcttctgagcttagttagggagcccaggacagctcctttgagcaaatgctactgcaccagtgactagccctacattagagacaaggacacggagtcccaggaaggaacttgtgctcaaagtcacctaagtgccacaaagcaggagagagctgagttctaggcttccacacctctcaaagccaactcagcaagatcatctcatacaatctaagttgccatcaattgtgaaaacatgtttttgacacaccactaggaaggagaaaatgctgccaactaaactatgatacatggctttctggaaacatcagttgcaagatgcattacaatttcagatatgttaaaatctgagtgaaaatgtgtgctaaattgatgatatacagtctctttctgcaggtgttggatggttctaaacacgcttccccatgttctcttcctctgcccagttctgcttccttccttctgattcttgtcttaatgagctctcatccaaggaccccaagctataatccccagcttccttctttcttcccctctttctatttgccatctaattggtaacctcacctggccagtcctctaaaggactcttcactgtggccaaccatttctatcctgactgccacggccctagctctggcctcttccttgtcccctcgcacacctgcagcctctcccatcctctgcactgcccgatcacccatgagacaatgtggccttgctccctgtaagcctatgctccccttcagccacctatggaatagagtggaaactccttgctgcaacacccaggtcccagcttgtctcctgggtctccctgcaggcttgggtcccagacactacactagagacaaggacactgagggcttccgcacctggtagacgtgctgtgggaggagcatgctccacatgccctgcctttatcctggggtcctcctccagaaatgcttttcctgcattctcatttcggggaccccttcatggggctccacctgtctcccatttctagctgaaccaacagctcctttgttttactccaaggctccttgcacagcccgctgttgtagcccttggctgtgctgtggtgcacacagaatgggggcctcccaccacaaggcagtagctgtgtgataccggctaagtcacaggatctcctagaaagctgcagaggaggagccctttcatttgctctctccaggcatcactgcttctcccccagccccttttcagctccgccacaaaagaggaaggggtgctgagtcttgacagccaggaccttccatggagctgaggggaaactgtgcctcagtgattagcaccaagggcactgtgctctctggcactctggtctcagacaggtggaccctgttccccagggcacacacctctctccctcccagggagctgtgtgggtgaatgtgttcagccccagctcgtgctagccagagatttcgatttggaaggggagtgctcagttgcagaaaaggcttatcaagacctccaacctaagtttcttatttcagtccaggtattaccagagagctctgctctcagggaggtggtggggctgttggtttcagacagttgcccagttaattaagcacttccttgtgaacactcggctcttgctccttgcagatagttctcctgcattgagcagggaagaaggtgagcagcagggcttgactgagggtttcctggacctgcatcccaatgccacctggatacaaacaaaacatctcctttcacttcaaacagtaagcgcatcattgttgccattgtcttcattttcatccttctcacgtgtgtttccctttgtagcctgtgcatccgtttagggcagatgcatgtcttattcatcaatgttcaaacaaggtccagagcagagtcggtgctcttcatgctgggttatttgaagcacaggatttgggtctaattattctagtgagtaacagggggcaacgatgactgtgttctagaatgtgaccccattggactattagggagggggaggatttctgtacacatcattaagaaagaaagactgtgacatctttttggtatctgtgtctgggatcgggccaaaccgagaggccttgtggtctcctctgagcagtgcggacctgtccctcacaaccgattgccaggagccctggcctcccttcatcttccaagctgaaattgaacactcttgcttctttataaaactgcagcccttggcatctcttctattcattgtgagtctgatgaactgcaggaaccagagtggtccaatgagccccagtgacttgcacgtattgcagctccatgaaggaggaaaatgagagaatgcacagaagcgggaatggtggagatggcttttttccacttcaggccctcactgttctctccctttgagaattctgagataaacaaaaattgcaccccatgctggccaaaatttcacagtgggcgttcattagtgacgcgtctgtttggctgggacaacaattgtgaggagtttggggacaatgggaccaggtctgaggtgctccattttggcacggtggacaccctggggttgatgtcttttaaggctgagagcagagacccggaagacttgagcttctctcggaagcacaggacgtctcctgtttgattctggttgaccccaagctgaggacatatatatccagtccttatcaaagctcctactggctctgtaaatttaccatgtatatatctgattgtcctccttctccctcgtcacctcatctctctctctctgtttttcttttaatagactttactatttagagcaattttagattaacagcaatattgagctgtaggtacagggatttcccacctaccctctgccccagcatgtgcagcgcctcccctgttaatgtcacccaccagcgtggtatattgatgaacgacgttgacacagcatgatctctcaaagtcttgactcttggtgttgtacgtttgatggatttggacaaatgtgtatggttgtgtatccatcattatagtatcatacagaggagtttccctgccctaaaaatccactgtgctctgcctgccatccctccctttcccgaatcctggtagccactgacattgtactgcctctgtagatttgccttttccagaatgtcagatatctggaatcatacagtaggtagtcttttcagattggttcctgtcacttagtaatatctgtttaaggctcttctatgtctttttatagcttgaaagctcatttcttttttaaaactcattttttaaaaaaacaaagctcattgttttaatgattcagttttttagtggaataataataataataataacaatagcagcagctagcatttacttagctcttactaggtgcctataaataccataattgtttaattccccacagtaactgtcccttattttacttaactattctatctcaaattactcccagattgtcactgtgtttgtgtatatgaactttcatttaggttgaattatctccaaaaattacatttcagagttaagattattgtgagtaccagggcataaatagtcctattgcccctggtataaattgccaaactttatccccaaaggcttatgtaaaatttaaatgtcattaattatacaagaaagtgtccatttcattgcacctttgccagcacaaggtgtgatattttaatgtcattttgttgtttgactattttttaataaaagaactcatcattcctttgtttttattatttgtcaaaatttaacaactttccttattttagcttattagctctatttttcttttctttctgtgtccccccatttatttataaaattaatgtctcttttgccaatttgttgacctatttatttaacctcttactaaattataagaatcgttaatgcttacttttaaataaagaagtacaacttcccttcactcgttaagcccgtaattttatttcaagaaataattactgttaagaaaatggggcatttccacccaaatacacacttacaaattggaacttacttcatattttcacacttgtatatatcactcacatctgtgccaaacctacagagccatcttaatctttttcataattacatggtgtttcattatatggatgtatcacaatttacttaccagtccctgtaggcatttaggctccttctaatatttggaaaactcatttattttaacaaggaataatattccatcgtctagatgaaccattgtttatttatccactgacctactgaaggacatcttaattgcttccaagttttggcaattatgaataaaactgccataaacatctatgtgcaggctttgtgtagacataacttttcagctcctctgggtaaacgctaaggagagcgatggctagatcatatggtaaggttatgtttagcttgtaggaaactgccaaactgtctaccaaagtggctatgccattttgcatttccaccaccaatgaatgagagttcatattgctccacatcctcactagcatttcatgttgttagtgtcctaatggattttaattattctggtaggtatacagtggatcatcttctctagggttaatggaatcaccatttatgtgcttgcccaatttagaaactggagagttatcagagactctttcttctgaggcagtggcaatgttctgggttcccttttctcccaagcacgtgaccaaacacatttctccagcttccttgcaattaggcatggtcatatgactgagttctggccaatgagtgtagccagaagtgatgtcaccacttctaggtctggcctatgaaactcctctcaggggaaccctttctcactttcccctttcagagctggactagaaggactctgagggtgttgggatgggaaagcctcaaaaaggaaagcctggatccctgaatgactacatggagtatagtcaccaactagattttgtataaataagagataaattttagccactgagattttggtgtttatcagttaccacagctagtggtacagtatctaacactctccaaacatagtctgattctgaaattgtttctataaactttataaaattaatcagagaagaagagagagggagaaatgaaaatataccaggcttgcagcacattcagcattaatcactagttcagcctgctctctgacctgctgcctcatagttttttgctattgctctagaattatgtaaaccctgttacaagactatatggctccccttaactgttccatagagcagctatacaacattaatattatgaaacattaaattttctctttgagatatgctttcagatcctacaagccaataaaactgctgacatcagctggtctgaaggagcccataagatggtgactcaccaaaaagcgcagtctccacatactgctggtttcatcccgcttaccctggccaatcaatgaccccaactttccagctccccatcctccataatccccttaaaatccccagcccaggactcctcagggaaatggttttggggtctcctttcatctcctcactcagcaacctgctatcattaaactctttctctgtggcaaactgctgtgtcaggataattggtctgttactgagcaacatgcatacaaacctgttggtcctataacaatctcaaggcttgaattaggatagaccattatttcctcatctgtaaaatgggaataatgataatattttccttgtgaaattattgggagggtcaaatgaggtcttccacataaagcagttagcaccaggcatttagtaggtactcagcaagtgttagattattaaaatcctttcaactctttcacaagtggcaggggaatgtttggctgagtagagtagatgctgagattcagggttacagacaaccaggcctcatttcttaccttctgttgcatacgtttttctctcacaagtgtagggaggtaaacccgggctccctgatatccatggaacatactctttttataaccaagagcagtggttccttgatatggcaaaccttgctcctatggttattttgaggttatttcaaggtctttgtccaggggcttaggaacctcttggagataatagatcagagtgagggcacatcgcaccagcagaactcaccgacatggctgacaccccagcaatggagaagaatgctgagtctcaggacagcagcacagcccaattcctggccacactctccatgacttcaaacagataagaactgaaagcaccgcttcctgtgaactcccacaacagtggagcccaagcaacacttctttggggtccccattgtcaggtgctactcacaggggtgaaagccattctccattcctccccttcacttttcaagagaaccagtcagaggcagtggattagtttcctgttgcttctataacaaatgattacaaatgtagtggcttaaaacaacacacatttactctcttacagatttggaggtcaattccaaaatctgtctcatgggctaaaatcgagatgtctgcagggctggttcctctagaggcctctggacaattcttctgctccccagtccttgcttctagaggttgcccatgttccttggggtatagccacatcacttcaatctccgtttttttaattaaattttgttatttttaatctttatggtgtacaagagatattttgatacaggtatgcaaacacataatcacttcagggaaatggggtatccatcacttgtgtttgtgttacaaacattccaattacacttttttagttattttaaaatgtacaataaatgtttgttgactgtagtcaccatgttgtgctatcaaatactggatctttttcattctatctaactatatttttgggaccattctgcttccgtttcacatagccttctccttgttctcatcttctgcctctctaaggacattgatgattatatcaggccatccaggccctccgggctaatccaggtgatctctccaactcaagagctttaagttaatcacacctgcaaaatctcatatcaggtaacattcacgggtttctgggattgagatatggacattgttggggatcatcattcagccaggaaccaccaggatggaggaatcaccatggctaccgcctgtgccaagtaggtcagcagcactggccagggtccgggagctgtggcaccccaaaatcagagccagctgctgcacccagtctgggcaacttgcagagcacaagcaaggttctctctggggaactctggagaaactaggagtggggttggaagcagataggaaagaggggacttgcaggagctgaagggacaaatgaataagtgcacacaagagccagcctccacacaccaccctgtcatccagagtggaggcatttttccagatcatagaataaagtaggagaaaagaggaagacaggaccccttgcccacaagtgctggcaacacatgttttagtgcagagagcaagagactgtctcggcaaagctgacccgagattgctgcttcgctgtgctcagctaatggaaggccttgagcagccaagctttcacatccctgatcagccttccagacagagctctcatctcaggccccctgaaaggcccagcacaagcaatagaaccaattaattagagaaagtggtctccacatgcacactttctgaagagaagataattggatttctgtggttaagcagacaaacgctcccaagaatggggccattttcgtgatggatgaatgcagattttttttgtgtttcatgagatgctattccatggcctgatggggatgcttggtatagatttgggggtgaagtctgtcaggggatagagatacagggaaaagaccacctgcacccccagaatgaaatcaagcctccacctaggggaacaaaggacatattttggggcaacaaggcaacataaggacctggctctgaaagtctaatcttgttagaaccacaaaatacatttagtcaatgctaatcagtgtgaaataatggtcattgtatgcctgcccagcatccatttaccctacttccagtcatggctgctgattctaatgtggggacccattccagcctcgttctcagggcatgggatttgcagggacctcaccatcagtctccagatttagaacccatctaggcccattggcacgttctatcccccactccctatttggctcagtgaccagctcactcactgattggtgcaaactttgggccaagacatcaaattggatcagagcaaacccaggggctgtgttcacaaccccttaaggaagcatttacacccttcctgctgggcttggaagtgggagctgctgtggatgtcttgctgccgtgatgggggaaactgtggggtatggagccaagagagagacacagaggaacacactctggggactcaagcacttaagtcaagtagtgtctggaattattagctccagacatttaaattgtgagtccaataaattccctccctgccccactttattttttcgttgttgttaagtcaatttgggacagggttttctatcccttttaatagaatccatctggtaaaaaacaactcactgcttacttaggccttaccagatgtcagtcactgtgctaagagtctggaatgcattccagactttaattgacactgtaagcctatcaatatcattgaggctctggggtgcatagcccctgagacagtttgcctggcttgaacaccaccgttctcttaaacactctgctctatagacaaaatctgccacaggcctctcctcccaaccacagctttcaaatcctcttcccactggactgtctgcctggccaggacactcaagtccttccaaacctggttagaaagctgaggtctatagcgattgatgaatgggtgcaaaccctctttcatcttagggtctggagcccattcaggggtgctccctctcctccccgactcccactcttgaggagagatgaaaggacacaggacagagctctcccaggctgacccttcccttggggagtaactgagacgatcccactatttgtcagggtttgtacagctggtgggggctccacgagctaggagtcccagagaggccatatgctgccatgggaagaacagggctccatttaattctcatgccttgttaagcagcatcttcatttttcagatgagcaaacagaggctcgggggagagagggattgtagaaggccctgaaaccagtaaggggtggcagagtcagggtttgtcccagactcatgtcactcccaagcccaaattcttctccctctggcctggtgcctcattcatggtgatggtagcaggatctaggagtggtgggtcaggcccagcctctcccacacttccttagctgcatacggtctttggcgtcactgtctctaatatgacaggcatgagggcctcctggagcccagcctcaccacgcaatggctaggctgctttccggctagacagctggagacccatgtatggggtgagggtggggttctgtgtacacagaatactttgctgctcatctccccccatcccaccgtcctggggaacctagtgtcttagtccattttctgttgttataattaatacctgagactgggtcatttataaagaaaaggaatttatttcttacaggtctggaggttgagaagtccaaggtgaaggggccacatctggtgaggccttcttgctggtggggtatctttgcagagtttggaggtggtgcggggcatcgcagggtgagtgggccatgagggggcactgaaagccaaaccggcttttatacagacccactctcgtgataactcattaatcgattagtccattaatctattaatccatgagccaatcaatttactccctcttaaaggcccctctcttaaagccttcacctcttaatgctattacattgaaggttaagtttcaacatgagttttggaggggacaaaacattcaaaccttagcacctggttcccctggtgccagggcctgccttagagcaggatcaggtgctgggctctgacatcattgctaactccaggcagcttcccctccccagggcggggcacagagcttcctgtccgtcattggctggggtcctgtccaatggcagaaagcccacctggaccctcagtgacaacagcaataactaaggtgcttatcacctgtgccagctgctcacctgcatctcctcctgcaaccctgcgaggcaaggtggcaccgcccttgctccagacaggtgatgtgacttcctctcgccacactccaggttggaggtgggaggtcagaatccacacccagaccttctgagtatagacctctggccctctcctcattagtttctgagaagcagatggctggttggggctgcgtgttcaccaccccacatgggtgcaggaagagtggatgccgcccctccttttcaggtcgagctgaacagctgagagttaccgtggttcggttgcacgacctggcggcgccagagataagaatagaaaccagcccccttgattcaggagatgccccggcagcaatttctagttatctctgcctcatgggggaagcagagccttcctgagatagcaggcagccagggagcatgagtgctggcagaccactaataacctccgggcctcctcctctgaacagtgtatggagaactctggagaggcagggggcttttatcgagtttcccactaagaacgtgcaacctagtcaacccagtcttctgcaaccacacttaatggcaaaataaataggcttgagcccccatcacctactttggggggggggggtcttgagaactcccgaggggcatgttatattctcccaatgtcccttacgccaattccttgtcccttacaccagttctccacctggagctggattagtgacctccactagcttttctgccctaggctgtagccctctctctgccgcctcctcttccttcccagcttctctcctgaggaccatggcgtgtaacagatttgtcctcaaggtttgggctgggggacaggggggctgtcttaaagggaggcccttagaactcagagcaggaaactctttaaaatccaatcactttgctgtttaaaggggacaaactttcagtaataggatgaatatgatgtggggatctaatgtagagcatgggggctgtagtttaaaatgccctattgtatacttgaaatttactaaggcagcagatcttgtgttcttaccacacacacacaatggtaactagaggaggtaacggagttgttaattggcttgattgtggtaatcgcttcatcatgtatacgtaatatcaaatcaccacattgtatacgttagatacacacagcacatcctggaaaaacatggttttcagtgtttaaaactagcagagttttggtctttatttagaagtttgatgaggtttttgtaaccagaaatataccatagaaacttaactcttgtttacatcgattagcctatggaaaaatgagtttcatttacattgtttcacttgaagtctcagtttccaagaacatacctatgacattaagtgagactttactgtatgatttttttttttttttgagatggagttttgttctcgttgcccaggctgaagtgcaatggcatgatcttggctcagtgcaacctctgcctcccgagttcaagtgattctcctgcctcagccttccgagtagctgggattacaggtgtgcaccaccaagcctggctaatttttgtattattagtagagacagggtttcgccatgttggccaggctggtctcgaactcctgacctcaggtgatccacccgcctccatctcccaaagtgctgggattacaggtgtgagccaccgcacccagcattacggtatgatttttatttgttaagcatgccccaataaagccacgggaaaaccccccaaaaagcaaaatccagtccctgctcctgctctaccccacaaccactcagagtttctccctgggctacttctctccctaaagcccagcctgctcccatgtggtcagaaccttctctcttctctgcttttctcaatacccagactcctcctcctggctcgtggctgccgagagaaagtgccttattcctgttacttcattatgcagagaaacgtggagctcctctcctgctcagactaggctctgggcttcccttgcgttaaactccaaggggcccaggaatgacttttcctaaataaaatagtcatcctcctcagcctttgtcaggtgaaatatgtggaattggaagtcccttggaaagcaccgtgcttcttttacttgtacaggtcaaatccctaggcaggtccccctcctccaccaaccagagaaaaccccccaagggatgctgatctcccaccctccccacccccactccagagaagcagggtctgggtgtggacgtagggacttggggcaggcctccctacagaggcaggcagggtctccaggcagaagtgggatctgagttaagaccccagggcagcagtggagaagagaaaagaagattcaaggtcaaggatggcagggcctggagaaaatcccagaagaggaggatgtagctatctgggttttgctgcagagaatagagtggatcagaacacaagattagacaggcgtgtgtagagggtgcgaagttggaaggtctggttcttaaacacagaaggagctcaccatgtggacagggtacgggagaacaaaggacaaaagacaggggaagtgcatggtctggaaagatatgcttcaagagacagactatgcgtggctccacactgactcagctgtttgctgtcctggaaaaatgaaaaaacaaaacaaacaaacaaacaaaaaaaaacaaactccacagccaggtttaaaaagccgtatcaaactgaaatcctttgaaagcaggggacttcaggagccagccatgtggggacttgacaactcctgggaaggcccagggaacagtttggcacacaggtcttctctaaagacattcaaaaaaatttttaaatgttttaaaacactgatccatgctaataaacacagggagggtgcatgtgagtgacaaccccccaggacaagtttaaaggcacatttagcacatgctaaagatggaagtgatggaggtgctggcttcacaggaaataatcttctctgaaactactgagctgcagagaggccagctgcaatgtgattttgctccaggagagccctgagcgctgtattaaacaggtgaatccattctgatacgcaatctctgatttaagaattaattgcttgggagaatctattagtgtgtgccctcatttatattcaaaccacaactaccaccacctagtcttctaatccctccaccccaagcctaccattagcagtcatcaacagacaggtatgaagcccccctccaggctggatgctggggtgtggttctaattcctcccatttctcagaaggtgctgctgcagtaatgaggaatcaggatgagtggaatgaagaggctgagatcagtgtggatcccagatctggggcttaccctctatgtgaggggcacaaattgctccacttctttgaatttggttttctcacctgtatgatgttgaagaagtaatacccacagtaacagaatcctgattttcagctgcatggaaaacaagatggcatttttccagcctttcttccattggagctagttatgcccatgagacttggtggttgtgaactcagctgggaggggtcccatttgtctcccattctccccatatatctgtttcctcccactcccaacccgggataacaggctattcctccagtactcatctaagattatgatggaactttgagagtggctatatgcaagtgcttaatgataccgtgggaccatcacaccagctttgcaatacccaatcccatatgtattttgtgtgagaagggactatccttctatctttttaaggccttttttgctcttcttttataagcagctgcacatgatactaaccgataggctgaatgagcatggtttctgcccccaacatccattcattcttactgttgccacctcccaacttccctctgtgaggccacctcctattccacgttcagcccatgtttctggcagagttgactgactttgggcagagcaatcaaaggccatatccccggtaacagggattgattctggggcgggcatgtgccctacaatttccaatcagaacagatcgcaggattttgcaggggctgccggcttagggagccttgtctatttctgctgcatgtaagcctagacacatgagccctgggagctcaggttagtcatttatgaccatgatgggaaagtctgcagagaaggaagccacagtgaagagaacaaggcaaataaatggagagaaaaagtcatcctggtcacgtgattttagccctggctcaaaccttgcctgaagccagtggtctattcagttttgtgagctgataaattatcattatttcagtgtgcacaggaagggtttttctgtcatttgcatccaaaagagctctcgctgagtacacattagtccaaaacaaagtagtgttatagtaggctttcaacagaaacacacacacacacacacacacacacacacacacacacacacactgtggttcaactgaaaaaccactggggaaaaatagagtagtttggcttccttcagggaagcaatgcacctcccctgatgggttggacaagggttgtgtctcctaccgtttcagtgtaagcacacatcagcctaccaggaagcaaggacttttaagatggtgaggagactgttcagcacagagacaacaaagagaccctgccggaggaaggagtgggaagagagggccgggaggacaactgccaaacttcacaaagatctacacgtttgtgtcccagaggagatctcgtcttctacagacaacatcacagttttccccaaagcttggcttgtataataccttgctaattaacaggatgatttttagtggtacataacattttcaaaaaatattttaatagctattttagtagttttgggttatgtaattttagaaaatatttctttctacttaaagaatatagcctctccttataaaatatattgattgaaagaaaatattaagtaattaatagcataattaagcaattatgctatttttatgagattgggatagttgtgtgctggagtttgggaaaatcacgttaccttttttaaccttgatg

SEQ ID NO: 582 - DNA, 20001 bp, Homo sapiens
ttgctctggaccctgcaaattatgtagctggccctggttagcgccagactaaatcaagcagcatacacctacaggaaacccaaagaaactaaaataccactgttgaactccagtactgcctggcattcacaatgataacttttagtagcaaaggaatttctattccaaaaactgttctcttaggatcatggcctttccttcttatttctgcagagcagggaagggcaattccacaaaatcctctcctaaaaacagataaccaaccatgtagaaaccaaatatatggaaatttcgggcacagacagaatacataaagataattataagtggtcttgctatgcagtatagcttggaacagtacttgggtttctacagacattttccattccattttctggaagaggggtaatgttttgggaagaatatgaatttgggacttaagcagagctcaacatgaatattcttttttcatttagttgtataaacttgggagagctatttaagttcttggaaccttaagttttatctttaaagtaagaataatcataagattgttaggagaaataaattgagattagaataaaagggaaggaaggaaggaaagaaagaaggaaggaaggaaggaaggaaagaaagaaggaaggaaggaaggaaggaaggaaggaaggaaggaagggagggagggagggagggagaggggagggagggaggggagagacaggagaggaggggagaaaaaggagagggtggggtaggagggagaggggaggagaggggagaaggaaaggaaaggagagggcaggaaggaagaaggaggaagggagatgtcagcacctgctatggtctctgaaatgtcctcagtgttcagcaaatgggaacttccttccttattccttcttactctcatttcaaaaaatggctggtttggggtgctctggatttagcaccgtttttctctagtccccacaagccttaaatccattctcagacaaacactaaaactaggagcacgcaggacattctgagattaaatctccctctcttggcccatattcgaatcccacacagtgtttagcagttctctgacttatttaattactctttgtgcttcctgaatttctttttctaaaagttctcaatctatacacatctcctaactccccgcctcagtcatccccatcctaccagcccacaaccctcccaatccatatctccacacaccccttcctaatatttctccagcgctcctgggtagcaagaagagtcattctcattgcctggggacaaacaccagcatagaaaagcccaggtacattttgataagtgcagcctcggtctggtagccactctctgggcacttaagtaggtagggggcaaaaaatgctgctctcaacagaatccacatgacttggttttgaattcctacttggtgctgacctggatcttaccaccttgtcataacctttgctacagagaggagtcacacgattcacccacctcctgcagggctcggaggacaatcagtaaattgttattagtgaatggtgcttttcttattatttactagccatgccaggaaaaaccagttattctatcacagactgcctcttacaagcaattaaaaaaaggagagagtccagggaaagacagataaggaagaatttctaagccagaaaaaaataaaataaaatgattaaatttgtacccagtttaagatttcatttatcctccagcaaagtgaaattcagccccttccaaaagatatgagaatccctgaaacaatgtggtctataagaaagagacaaccatgatttctcagttaataaaatttcaaagcctgctttcggtaagtatgaatctgactctggaatattatcttggaatctccagatgttggtaacaggtgaactcaagaaacctgcatctgaatggggatatggctttatctggaaatagatgctgttattatgagtaaggtgtacagtttatctttatagagatagttcacataccacgcagcttctttatttccccagctaaattccagcagccatttgtcatttttgctaaggatgccttcaaccagaaaagttaggctgggtctaaaagaaatcaaacaccataatttgtttgtttgtttgtttgtttaacatcctaatctctcttttctgtccctggtggttttactttgtgggcatcagtgagtgtgggagaaacctgagtgtgcataccaaggcagtcaggtggtatcttgtacggcagagatgcagtattgaggttggaaaatggagtatggggctcaggaaaggcaagcgtgctagtaattcatatttgctttgcactttacaattgacaaaatgcgtaagtgatttcagtctaatcgattctttattctacagttttcatccttttttgacctttagacataatgatccagtgtgtcacacgcagagacattcaaacatagagcatcaaaaataaactctcacacaatgacacttacctttactctatgtgaaacactgtgttattttctattttattccatttgatttgttaaagatgctggccacacccttctaaattgattttgcaacctgctaatagaatgcaactctcagctttctttcttttttcttttcctttttcttttttcttttgttttttttttttgtttttgtttttgtttttgtttttgtttttgagacagaatctctctctgttgcccaggctggagtgcagtggcgccatctcggctcactgcaacctggcctcccaggttcaagcgattctcctgcctcagcctccctagtagctgggattaaagactcttgccaccacactcggctgatttttgtatttttagtagagagggggtttcactggtcaggcaggtcttgaactcctgacctcaggcaatcccccctcctcgggctcccaaagtgctggacttacaggcacgagcctccacgcccagctgcaaccctcggccttttagtcagtgggctgaacactgtgggctgttaccctcatctccacctgcttctaagctctttcttgactcctcggggctagaagcaaccatcttaccagcaaggatccactatcatttgtgccagtacaatgcccttgtgtgagatttggaaggcagaagtcaaatgaagtcttccttcctccagcaggagcagtagccaatgacaggccactcaggtaaacgtgagccttttctggggccaggagtctgggccttgccctgccagccactcgccccaggatgctgtttcttgatctctgggtggaagtagcaatttcctgatgctcacagctttgcagctacacaggcgaactggaaagcagtggtacttctctcgccttctgttctcccaatctctcctgtggtttttaagtacctaactcccagtattaagtgcccatttgctttaaatattggtttctgttttctgactgaggcctggttgaaacagatagatgctagaaatctttattttatttttgcagaaaccaagactcaaagtggtcaacagtagtgggaaatctacaactcaatccaagcttcctgattacaaatttactttttttaaaaaaaactataccatagctgtatgtacattaaatagttgctcggtattttgtttctacaaagttatacttgtatacctgcattatgataaaactcctcaaagtgttcgcaattctttttttctcctctttgtcaaattaaattctattcttatgtgccttcatgaacatactggctggagtgcagtggcgcagtcttggctcactgcaacctccacctcctgggttcgtgcaattctcctacctcagcttcccaagtagctgggattacaggcatgcaccaccacacccagcttatttttgtatttttagtagagatggggtttcaccgtcttggccaggctgatctcaaactcctgacctcaagggatcaacccgctttggcctcccaaagtgttgggattacaggagtgagccaccgcacctgacacaaattctttaggtaagaagacattttctgcgaggcagtttgggtaaaggagaattttattcaagggataaaatgtaagagccctcttcctaaaatgaaaacaggacccagtcaatgaggaaatggaagtccacacaattctgccaacaaagagggagaatgatccttattggattccaacaatttatactaactgtttttcctcattttcccttcacttgatttcctcaactgtttgtcatttttctaatgatgcatagttttacaaggcagtctcaagtcctttgtgaaatgagacagggtttaacaaagtgtttccatagacacccactctgcacacatactgaggtctagaaaatgttccctgccacctgaggttgagatctgacctgacacctaactctacggtcaatgccaggccaacagcatcagcctcacccaggattttgtcagaaacacacgctctcaggcccctccccagacctgtgttggaaactttggggactctgttgcatgcttaagttggagaaccatcactgtagacatttgactcaaatcagaaacacttcccctcctacttccccattcacggcctctatacccaccatcctaaagctgtataaaagcaagggaaacatcagaattagacaggactgtgttcagctccaccttctagcattcagggtgaccttgtgcaatactgagtctggcttctgaggctgggcttcccaatctgtacaacagaaacctcatgctacctagtgaggctgctgtaagaattagcagtagttctcaatcaacggcagcagcgatcccttctgtgtcgtaacacccttgcctctctgcagtaatatgaaggcacatattgcttttcaattacacagcctgcatctttccctccatgggaattgcaatccatttcagctgatagatgagtcaagaaaaaaatggcaataaacatgaagatacagaaggagcatagtgaagaaagcaagcaaaagagaaaaagaagggatgagaagaaagcaaaacataggtgagaaaaaaaaggaacaggagaagtttaggaagaatgaagaaggaaaaaagtgaccaggaagcaggtggggaaaaagagaaaagaaaaagtggggaaagagaaaaaatgatgagaagagagaaagcatcagtggaagggagggaaatgaatgagtccaagttctgctgggagccgagctttctgtccctcctagcatgagactctacctaattaccctgcccctccaagccgcttctcaggctggaaagtggtcttctgtctggaaaaagccataagcatcttatgtacatatgttccacctaatccctggcagtgcagcctgggtgcctgcagatggggtcatgggtttgtgccagctgccacgtggtgtgggcagctcaggcaactccagtcctggatacccacaagccagaagctcaagtggcacccttcatctccccagaccctggccaggagcaggaaggacttcttcctttcccaatttaagggctggaaaccaaagagagtccagattctatttccagtctcctcacattgcttcctccctaagcttttcctcccaaagccagcttggtctggatgggcaagcatccagttctttcaaatgaaaagatgagaatgagagaaagaaagggggagagaacagaggcacagggaggaaaggaaggaagaatggagaagaggaagaagggagaagaggagaggagaggagaggaggcgaggggagaagaagggaaccagaaggggaacctgtccttgctcactctctttcacttaaaatgtaactctacctggagacaaagaatttgcccaaaagagcatcgcccccgacacggatttttttttcacaagtttcggttttcctctttcttttctttcttttttaaaagcaggaatgaattcaatcctagagtctcatgagaggagatcactcagcctgctagaaggaccatcctgtctggaatcacaggaattaagagaaaccacaacttttctcaactctcagcgcaacataaaacatgtcagcacttgggaaaaggcaggtgagtgacaaagaaaagcccttgcaatgaactcattccttcctggttgtctgtccgggtctgcttgctatccactcgccaatctagagacctctctctccacaccctcctctccagaacccaccccacatcctgaccgctctgcaaaatgataggtgtgattaacctgccacacacttgaacttagagagaaagtgtgttaaggaaacaggaaagggaggggaaataatgtgaatatcaaatgtatggtatataccaagtaggttagcagggcaagccttaagtgaagggtgagaaagcagcattcggccgcacaggtgcacttggggagttgagagttaagcttcattcactcacatttcattctgcagcgacaaaggctgcgaagaaccaccttgagcttaaaaaatgcccaagcatgatgggacagaataggatgggttaccagggaatcttaagatggggtcggcgatgctccacagagcagttggtcttgcacctaagaacaccttatgtgtaattcgccaaggttaagcagggcccctctcagaatttcaccttggcccctccttcatggccatggttttagggcagcacctccaatgagaatggaaaagggcacaccttttgcttttccccagacacagaattcaaccactagtgcaatgcgtggagaacacagactttccaggcttcctgtttaaatctctccaaggaaaggtatttacaacacaccaggctgggatgagtcattcaaaatactcaagaattttcagctccattttaaaggcaaacaagccggatctcttcaaaaactgcctttgggaagggccgaagagtagtcaggagattctatcctgacttcatctggccatctatgtaacgaatgattgctctggtatctctttactcagggccagctctgccacacaccccaccctccacctctccatccagctaatcctcaccatggcgccctccagagcattcccaggccagcttctgacacctctactacctctgactgaggggagcagtaattttttaaaaaagaaaagaaatccccacttttttttctccttccttagggcagaaaatccagaattattaaataatgataacctaaagctgtacaacataaattactgacagtttccccttggaagactgaaaataaaattaccttaagccagcataattccttagcacacaaaggcaagctctaaaatagcaaacatggactgaagctttgcacatttccaggtaactttctgtacacaaatatggagcagcccattccttactagtaaatatccacttccagatggaagcttgggtgagccttgtcaggaaattctctgtttcttggaagcaaagaagtccattatggaagattggaggtctatttttttttttattttcttcagagacaggatctcgctatgttgcccaggctggttgcaaactcctaggctcaagagatcctcctgccttggcctcccaaagtgctggggttacaagcatgagccatcatgcccagccaaggctgcaggtctaaagagaggtccccagaagttatctttgaggtcactcatgttccaggaactccatctttgtgtatggcttctggaagccacagaaggactgtctgcccaaaggacttgggaagggccccagactccagtgccccggtactaacaacgtctttctggtgtgcattcacacaaaagcgcataactacttttctcttgaacaaaaccagggataacaaatcgtgattgtaattttacaggtgtctttttaagaaataatatactttatgtttcagaacagtcttagatctacagaaaaattcacaaaatagtacatagagttcccatgtaccctgatacccattttcttctattattaacatctcacattatgatgttgcacttgttaacaattaatgaaccagtattgataatgaagtccatacttttttcagatttcctaaatttgtaccttagctttctgttacattttgtttttcctttctgggcactgcattacatttagagatcatatctccttcagctcctcttgtctgtgatagtttctcagactctccttgtgccttgtgtttgatgactttggcagttttgaggaatactgctcaggaattttgtagagcattctttgactgggtttgtctaatgcttttcttatgattagactaggttatgggcttttgggagaaagagcataaaagtgaagcaccgttctgctcatatcatgccaagcttacacgccatcaacgtgacctatgactatttgtgctgaccttgatcacctcgctgaggtactgctggtcagatttctccactgtgaagttactctttttcccctttctccataaggaagtcactatgtgcagtgaacacttaaggagtgaagagctatgccccacctgcttgagggtgaagttatctacataaattcatatctggaattcttgtatatgagagatttgttgacctgtcccatttatttaattatatcagtatagactcatggacattgattttatactttgcattataattcaatgctactttattctattgctcaaataaattttgagcaataaatttgctctttggccattgggagttctttccagtggctcttgtgcccttttgacatatccccatcaatttggcagaaggaagagaacacttccttactttctggcactacagtatgcctcaggctcattttgtatttttttgccccagtcctatttctccaaggagctctgggtccttttatgtgagaatgatgctagaaaccaagatctgggtgctaggtgtactccttgctactagggtgtctttttattgtttgtttgtttggttggttttttagaccctgtcagctgacagagaaaagaagtatttgtttgtatactactgtatatacatacataccacacatacacacacacacacacgtacatacatacatttatatacatacaaacatgcatacacagttttttatatatataatatttctatatgtaaccatcttatattaagttaaacatgagtttttactgatgtttccaactgtaagctgttaccacatggaccattctagcttctttctcttgattttctgtaaataccgactccaacagtgtgaaatctctctcctaccatccactattcatttatttcatgttcattacagtatagctatagcaataataagaattgttaacctgtaacactgtgagaaagaacgttatcagctagagtacagtgcttgtgtgcagtcattttgcctttagtcttacatagtctactcatttccagtagtatttaggtcagtaccgtttctcccaccctcttcagtgaggttgttccatacatttttaatacagttagcctctcttattacagtctgcatttcttcctgagatcccacaaccttctaaatgaccttttctttttatacactgtatatattaaaattttatgggttttgacaaatgcataatgtcatgtatctgccattatagtaccatccagactaatgtcaccaccctaaaaacccctgtgcgtcatctctttgtccctcccaactaacccctgccaaccactcatctttttactgtctctgtggtttcgtcttctctggattgttgtatagttggaatcattcagtatgtaggcttttcagatttgtttcttttacttagtaatatgcatttaaggttcttccatgtcttattgtatctggtttgttttttaattgactccaggaaagaaaaaataagcagcccaaatctgtcacttcacctaattttgtttcccaacccaagccaagccatttcctacacatctggattcagatatcatacgagaaaacacgttcctcgacacccatataaaactgcagtccccggccctcattctttcctggctttatttttagcactttctcatacacctttacttttatttattcatattgtttaatgtctgtctccatgagcacaggggttattgctattttattttttgttgtttttccagctcttgaaatagtgtctgccatgtagggcccttggtaaacatcgaatgaatacatcaaattgacaccccccaaaaatatttatgtgcactcgtgtgcttgactccatggctggcatgccccttggcttgagaggaaatcaagaaattaggatgggaagatggagtgaggaggtgtaaggaagtggtggctgctctcagttccttatcctacctacatgcttgccatggtggctgacatttctctcttagagattaatttagttggggttctttttctctactagaattttgatttgtgtttttaaacatttaatagaatggttttggctggatgcggtggctcatgcctgtaactccagcaccttggaaggccaaggtgggcagatcatttgaggtcaggtgtttgagaccagcctggccaacatggtgaaacctcacctctactaaaaaatacagaaaatttgtggtggctcatgcctgtaatcccagctactcgggaggctggggcaggagaatcgcttgaacctgggaggcagaggttgcagtgagctgagatcgtgccactgcactccagcctaagcgacacagcaagactccccccaccaaaaaaaggccaggcgcagtggttcacgcctgtaatcccagcacactggtgggccaaggcgggtggattatctgaggtcaagagttcgagaccagcctggctgacatggtgaaaccccgtctctactaaaaaaaaaaaaaaaaaaaaaaatacaaaaattagccaagcatggtggcaggcacctataatctcagctactggggaggctgaggcacagaagaatcacttgaacccaggagggggaggttgcagtgagccgagatctcaccactgcactccagcctgggagacagagtgagactacgtctcaaaaaataaaataaaataaaataaaataagataaaataaaataaaatggctttaagtgactttttaaatttctgaatgtttattgtaatgagtcaaataatttagagaaacccaaagagtattaaagaagaatcttaactctcttccccactcccctgaactgcacttagagctgggcagctggggcccctgccctgagccctctgcattagaaggccaagccttacctatggaacaggagtcttcagggccaagaagatatgcccatctgcagtcagtgactctcctgctagaccacattccaggtgaccaggatgctagaagtccctgtccgcctggcctccagccctcttccaagaccaaagtgggcctcctcctgggcctgtcctcccaatggcagactggcccaggatgagcacacccctagacccaaggagcgtttgtatggagtgaatgaactggggtaagcagcgtggggtgccaacaattgtgtgcacaaggtctcctcaggtgcacaagggactagagtaaaaagcaggggagacaaggcccgagtttccattgtttccatttgatttcttgccttgggcgcgccacctgcctcacaatgctgagaccaggccaggctcccccactataattccatcctcctgaggtgacaatggtaatggttttggtatgtaaccttcacacccttctatatgggttcacaaacatgtagaaacataaacacatatggaaggggttttctctctttctcgatcacttgtttatgaaaacggtatcctaatacacaatataacatatatcatgattctctccactgtacatgtagatccacggccttctttttataatgtgccacagaatgaatgcatgtttccttatgatggatattcagtgttctcctcccacccagcttcccaccttaaacaacactgaaataatctttatacctacagtcttacgtcctggtgcttttattttcttagccataacttggattcctagaaataggattagtggttcagttaaagaatataaacatttattttatagatgcatccaaactactttggtaaatacaccaatctgtaccagtactggcaatggataacatgcccatttcaccaaacctccccactctggatgctataaattgttttaaattttgaacattggataggtagaaactgatgtctggttaatttcacttctatttccctgactgcagtgaggttcaccatcttttcatatactctagccattcgtatttcctcttccataaattgcctattgttagcctttgagcatttttctgttgagatgttagctttctcatatcaaattgtaaacatttaattaataaacttcagtagttataagattatcaacttttttcctgacgtttatcaaatttaaggtatattctcatgtagatagttctcagttttgggggtagtcaaatctgcaatcttttttctttttaaatgtttcctgggtctcctagcttatttaaacagaatctctacctatcctcctaaatgttatcctaccctttttattgtcatgtgcttctgtgctcacttcataatagagcccattcagaaaacaaaggagtccatagaaagaagagagtccctgaattctgtaattctgtgttcttaggtcttttcttctgttcttccatcattaagactaaaatttctttcttttttctttttttttttttttgttgttgttgttgttgagataggatcttgctatgtcacccagactggaatgcaatgttgggatctcagctcactgcaacctccgcctcccaggttcaggtaattcttatgcctcagcctcccaaataactgggattgcaggcgtgtgccaccgtgcccggctaaattttgtatttttagtagagatggtgttttgtcatgttggacaggctggtctcaaactcttggcttcatgtgatctgcccgctttggcctcccaaaatgctggaattacaggcgtgagccacggcgcccagccataagactaaaatttattgtctcccaacaatctcttcttaaattgtaagcaatcctgcaaaagtaacacctcaaatcctcatcagcaaattaggctgaaatttatgagagctttccaaggcagacatgttgggaaaaataaaaggcaaaaaacagaaagaagggggaagaaaacaaaggtgtgagggttctctgcactcatgtgttcctccacacagcaggaataaactgagtgtcttctccacataagcggggcctatggagaaacaagactcaagggacaacatggtccctgtcacccaggggtttagccttagaggggaaatgaacactacagtccaaggtagactatacaaggtatggccaagggcagagaagatcacttctggctgggtgatcagggaagacttcaaagaagtgagcatgcggctgtgtggaaggatcgtttgagcccaagagttagaggccactgtgtgctatgatcttgccactgcactccaccctgagcaacatagtgagacttgtctcaaaaaaaaaagagggagtgaatatttacttatttatttatttttgagacagggtctcgctctgtcaccaggctggagtgcagtggctcaatctcggctcactgcaacctccgcctcctgggtttaagcaactctcctgcctcagcctccccagtagctgggattacaggtgcgtgacatcacacccagctaatttttgtatttttagtaaacatggggtttcaccatgttggccaggctagggagtgaattttagatgaggtttcaagaatagctaagatttcaacaggcagaagaggaggactttcagaagaaaatagcatgaacaaggacacaaaagtgggagggggtagagcattctggggtaagcagcttatccagacaaacaagaggtgcacatagaggagccatgagagatctgccggaaaagtccgtgagtccagacctcaggaggcagagcaatggggaacatagtggcctgcttggcccctgtgctggagctggccctgaaaacagcgggggtacatcccgggatccccacttccatccgatcttcagaatcacctgaagcatgttaaaaatacagattaatggccgggcgcagtggctcaggcctgtaatcccagcactttgggaggccgaggcaggcggatcacgaggacgagagatcgagaccatcctggccaacatgctgaaaccctgtctccactaaaaatacaaatattagttgggtgtggtggcaggtgcctgtagtcccagctacttgggaggctgaggcaggagaatcgcttgaacctttggaggcggagcttgcagtgagtggagatcgcaccattgcactccagcctggtgacagagcgagattccatctcaaaaaaaaaaaacaaaaaaaacccagattcattacactcagtgtgtcccgcctcaaaccaactaaatctaaatgcctcagtaattttgatgatatgccagctaggaacttctacttctggctaaatctgcccccaaggaagtgtgatcatatttgtaggattccttagaaattatgtgttcctccacttcctctagtctggcttccccatgaaaacgcagccgcgttggtagcaaagaccagctgctttggctgtccagcttcattatcttggctttttccctggtaactgtcccagattctccgtaggtgtttactttgtgtgagtcagctggctctagtgtaaagcatgtgacctgggtctaagccaatcagcatctcataagcctcctgccatgactggttcagggataggcccttagtccaatcagagaccatgaaatgcaatgaggctttgcctagaaatgctgagctaaagatcttcactttctatgcaggttttgaagccaggagcccctcttcttgagatctattggcaaccatcttgtgaaggaagagcccattgtgtaggaggcagatgctggagaaaaagagacaacagggccgggttttatcatttgagacttgagtaaagtcataccggaagtcacacccagtctaccctgggaagcttggttacaagggccagtaaattcccttttcttttcttttcttttcttttttttcttttttttttttaagagatgggggtcttactctgtttcccaggttactctcgaactcctggcctgaagccccctgtctctgcctcccaaagttctgggattacaggcttgagctactgtgcctgactaaattccctttttgattaagcctgtttagattaggtttcttgtcaacctgcaactgaaagaattatcgccaatacaaggtacaaagtcctgaaaggtaagctctttgaagcacaagaaaagcaggaaccctcagtcttctttataaaggagatgtcctcatgagagagacacgggccactggcaacttgaattcatctggaatattcataagcttctagaaatggcaaagaaaatggtttatttgattggccaaagaaggactctcctgatgatgtaataatttcatctccttgcttccttggctgtattgcagatttgacaaagtattaaaatggcacattgtaaaaaatctttatattacgtaagcataaagtgttctgcaaaaatcagaaagaattgtgctggtttggtgattgctgagtcataaaagtaaaacataaaaagtaaggtttgccgtaaacagcactataaaggatttagtgaacctaacatgagtataaattaccaaaagtatggatagtgcacagggaaaaagtaaggttatcgttgtattttagtaaaagagtcagtaaattcttataagatacaagctggaatggcccataaaataacttcagggaagaaagtttaaaaataatgagaaaaaaattaaaataacgattgattgcatttgggggagaagagggaagtctttaaaaaaaaatgtaacttgcagccctttcttgctgtttttcatttatgcatctgtaccaggcagctgatcagaaggacccattttatctgccaccacgtgtttttggacagtgtgctcagtttgggatgtaactttggtaggtcatgttcatttgcccttactttaccatgaaattattaaagggacaattgtctgatttctatcctagctggtggagggattgctttcttgttttacccacattgtatatatattttatttcagagtagatagatgggagggagcatttacaattcatgtaagtactcattttagagataagaaaacagatctaaagaatgataatcaatgtgttgcaccttcttcagtatagtagtcccttagtatacatggggaattggttccaggacccccacatgtaccccaaatctgcagacactcaagtcccacagtcagccctgcagaacctgagtacgtgaaaagtcaaccctccttatacatgagtttaccatcccaccaatactgtattttccatccatctttggttgaaaaaagtccacataagtagacccctgcagttccaactcccgttgtgcaagaatcaactgtaaaatgttattggagaacaacatgcccatttctttatgtattgtctgtaactgcttacatgctacaaaggcagaattgtagtagtttcaacatagactgtatagcctgcaaagccaaaaatatttactgtgtggcccattcagaaaaagcttttaaatccctgctctagaactcaagtctcccaattctatgatgaatttacttcatttcacccagtacttacagcacctgctgtgagctgggccttccaaatgggtaagacagccccagtacctacactcctccaggagtagctccagctccactggtattctttctactatgccactatccttctcagttaacagcgggaagtggaaaactcgaagttcatttatttagcaaatagtattaagcactgctatatcccaggcactgttccaggctttgggaatccatcagtaagccataaacatataaatccctgtcttggctaggcacggtgcctcatgcctgtaatcccagcactttgggaggtcgaggtgggtggatcacctgaggtaaggagttcgagaccagcctgatcaatatagtgaaaccctgtctctactaaaaatacaaaaactagccagatgtggtgcgtggtgcacacctgtaatcccagctacctaggaggctgaggcaggagaattgcttgaacctgggcggcagaggttgtagtgagctgagatagcaccattgcactccagccaaggcaacaagagcaaaacttcgtctcaaaaaaaaaaagaagaagaaaaaaataaaataaatccctgtcttcatggactatccattccagtgagaagaggtggacatagacagtatttttaatttctatcccttagataaagaactgcccaaggtgaaagctaatgaggacagagctggaattagagcccagggctaactgactaacatagaggtgtttccaaaagatgattttgcctctgtacagaagagcatgttgttttcttggatctttctccttcaattcaaaatcttgatctgtcaggagagctgggccaacccatcaggttgcaggcaggtgtccatggtgatgaagggatggaaaaactcactcctgacctccctctcaggttttggcctctcaggcaccaaattcctaagcacagaactgggaagtaagatcctcggcggcccttcctacgggacagtcctgcaggtccatcagagtatttgattgtttaaacgaacatctgtctggggcagaaactgcaaataggataggagaagtttgtttgaatttccctttgggacctcaaagcagcaggtggagagaaggaacttttaaaatttccatgtcagcagtgaggaaaagtggaaggaaggaagagaaaaacaaaaggaggtctcacaaaagcatgtcagagtcaaaatcagaaatagatgtgagagtctctggaatcatgtccttagttctggcttcaaacagagacccttcctctctctgcagaccactctccaggaaagtcagcataatagggtaggtacatataaacattttactccataagaattcttctgtcaaaaagactttcatctttgcattttgattttagggttaagaagtctgatgctttattaaactggaaaactcacctgcccaaaaccattgctttcttcaatggttctgcactactgaaatcactcagtactttctgacaaacaacttaaaatgaacccatcctatactactgtctgacctttaaagaatgtgtagaaaccttttaaagtagtatctgagctgggcgcggtggctcatgcctgtaatcccaacactttggaaggctgaggggggctgatcacctgaggtcaggagttcgagaccagcctggccaacaaggcgaaacctgtctctactaaaaatacaaaaaattaaccaggcttggtagcacagacctgtaatcccagctactggggaggctgaggcacaggagaatcacttgaacccagcaagcggaggttgcagtgagccgcgatcatgccactgcactccagcctgatcaagagtgagactctgtctcaaaaaaaaaaaatagtatctgtactgtaagaaaattaccaatgaatgtttattactcccaggctaatattcaatagcaacttttccctaaatctattttctgacgtcctgaaggacttctactagagccaggaagtatcattagatttccatcattgacaccctaacaaatcttagagactaaggagtcacatttgcagcctgctggccatctcaaaagcctgtgcctctactgagggagtgggagaaaaaagacctcaggaccagaatttagtgagatattctataaactccaaatccaaccattttccatccattcattcaacatatatttattgagctcctcatgagtgccagccaccatctaggcattggagatagagtggtgaacaagccaactaagtctctgcttccatggaacttgtacgttctagggaaggagagaaatcagtaaacaaatgcatgtgtaagacaatagtcatcgaagagaattttaggcagggataaatactactaagaaaactaaggcaggccagtcatggtggttcacacatgtaatcccagcactttggcagatcacttggcccagaagttcaagaccagcctgggcaacatagtgaaactccgtctctacaaaaaaaatacaaaaattagcaagtctggctgggtgcagtggctcatgcctgtaatcctagcactttgggaggctgaggtgggtggatcacctgaggtcaggagttcaagaccagcctggccaacatggcaaaaccccatctctactaaaaatacaaaaattagccgggcatagtggcatgcgcctgtaatcccagctacttgggagactgaggcaggagaatcgcttgaacccaggaggtggaggttgcggtgagtggagattgcaccactacactccagcctgggcaacagagtgagactcagtctcaaacaaaaacaaaagcaaaaacaaaaacaaaaattagccgggcgtagtggcacgtgcctatagtcccagatactcgggaggctcagatgggagaatcacttgaacccagggagcaacagagtgagaccctttctcaaaaacgcaaacaacaacaacaaaaattagccaggtttggtggcttacacctgtggtcccagctacctgggaggctgagatgggaggatcaaggatcaaggaggttgaggctgcagtgagccatgattgcactattgaactccagcctgggcaacagagcaagacc

SEQ ID NO: 583 - DNA, 84414 bp, Homo sapiens
aaatgatgaggaagtacaggtatattaggccaatttgcttcttccaaacagatcagggcatgcttcccattctctaactcagagaaaatgttttctatctctggcttggcatcagagacagcctttctccttccccgaggcagcctctgccatctgccaaatggtgttgttctgtgaccccagtgtccttgaagccatccggaagtcttagagggaggtccctagtggtcccagcatgctctaactcctcaggggacaggactggaactgaaaagcagcctgtttcccactctccctagagctgaaggctctgtgaggatgggctctgtgagcccaaccatcccacagcagaactaggagcccatggaagggttggcttgtcccaccatactcagccccttccaattccccttccaaccttattcatgcttctgtgttatttgggtacctgcttatctcctctactaactaataaaattttgagaacaacgacctgtcatttttctgtatattaaacagtatttagcaccacgttttgcatataattctcaaaatggttggtaattttaaaacatcaaagctgagttgcagaaagttagaacaggtctccaacggctctgatggcagctttggtcacaaggatgctggttatttatgtggttagaaccaggccctcaagagctcactgtgctaggagggtcttatctggggaaagccagagtaggccaaaaataagaaggggatttgagagggggaatttgaggagagaaacttagagctagcctgggttctaatcccagctctaccaccaacaatctgtgggacaggacaccagtcaaggcatgtctgtatggcatagtagagttggaatgtgaagcttggctctcccatgtattagctgtgagagaggcagcagcttcatgtcctagctccctcctcttcttattatctgtgtgaccttgggcattaataagtctccaaagcctcagctacctctctcctaaaatacctgttctagtgatcctgctgctctgggttgaaactcaggtgatcccaagatgctggcttaccaatcttctctcatggaccctgacaccaaactcactggaaacatggcactgttacccatcagaagccaattcaaaggacctgcccccagagagacaaaagatacagatattgtggatgaagccatctgttacttcaaggccaatgtcttcttcaaaaactatgaaattaagaatgaagctgataggaccttgatatatataactctctacatttctgagtgttcgaagaaactccaaaagtacaattccaaaatccaaggtgagaaagaaatgtatacattgggaatcacgaattttcctattcctggagagcctcattttccacttaacgcaattatgccaaacctgcgaacaaacaggaagatgaagtgatgagagcctatttacaacagctaaggagaaagactggactgagactttgtgagaaagtttttgaccctcagaatgataaacccagcaagtggtgggcttgctttgtgaagagacagttcatgaacaagagtctttcaggacctggacagtgaagggagcctgggcagccaccatctccagagccctgggcagcattttccattaagatgtacacaatcttttgcctttatctcataaagttttatacagaagagagaagagcatgtcttcacttgaaaaactattgatcaagaattcgggtgggggaaaagaaagtgaggtatcaaaggtgatctgaaattttctacagcattaagctggtgcttaataagaataagtaataataaagagatttctaacattaaaaaaatacctattccagagattactagtgtctgccaagtgccctccatgggataggtactgttgtaagtgctttatatgtactcactcttttggtctttttaacaatcctgcaaactaggtagtattattatcccatttccaataactcaactgaagcacatgggggtaactctcctacagttaccccactgtcaagggggtatagctgggatttgaaccaggcagtctagctccctgagtctgcttccttaaccaccacattaccacacagtgacctgacacaatgcactgaaattgcttagcatgcagtaagagctcaacaaatgtcagttgctcgtgatggtcattctgaatctcccagcctcattttcaaggtggagatgatactacccaattcatgggtagagataacacagataaagcactgaacagtacacataagactggatgcctgggtttggttttttttttttttggttttggccacatggcaagcagatcggctatttatttgcacctatgacaccgacttaggggttcaacatgctcttgtttgttgccgagtctgtattgcttggtgttttctagcttgcctagtgctttgctcatagcagatgctaaaaaatatggttcatttattttcctcaaatctatagaattcccaccattcttgtgtaggctactttggaaggcggtgtgggagaaagggtacttaggtgctgagacagaactaataattgatcccactcctgatttcagtcagtccctatgccaggaaaaactcactcctctccttgtgcaatgtataagcctcccagaaactcacttaaaggcaatttctacttaatttgtgctttgggtgttacaaacacaagcttgtaacaggtctccccttgttaatacatgacagctattgccctgttcttaccatgcctatgcagatcaatcctgtctgtcttggacttctgattgctacaggctggggaccatgtctgtttgacttactatcaatggcacaatgccaagtaccaagtaccaggttcaaaaaatgtttatttgctgattcagcagttgtatatcctgttggaggtagattctagccttggtcatgcactaccttgatttctgactctgtggcaagattcgtgtatcatgctctactaggtcttctcaccttcatttttgttatttggtgggcagagcctgtgtgctgaaaaggggaagtggttgtgagtgtgctggagaaagaggacctggttcagcagatttttagtaatgggcttaatcagggagggcacctattatttactaagtacttactatgtcaggcatcaggttaggagttctccaaatggatataaataaacagaaaacttttggtgcaccagtggtttgtgggagacatttgggggagcattcactgcctgctcctcatattcccaggactacgactagatcagcaagttattacagccctcacttcttgtctctctccttatccatttctccccaggaggagaaatgagttaacggcttgtgtccatgattttcagtgtatgttgaataacagcaactcaaacatattaagtcctaatcgttggcatttataaatgttaccttatttgggaaagagctctttgcagtgtgattaaggattccgagataaagaggtattatttgtctgttaggacttctgtaacaaaataccacagactgtgggacttaaacaacagaaatttattttctcatagttctagaggctggatgtccaagatcaaggggctgacaaggctggtttctctgaagacctctctttgacttgcagatagctgcattcttgctgtgtcctcacatgaccattcctctgtgtatgggcacccctactgtctcttcttcttataaggataccagtcctgttgaagtagggccccacccacataacctcatttaaccttagttaccttttaaaatgccttatctccaaatatagtcagacggtgggtcgggggtggtcagggctttcacatgaattttgggggacagaattcactccgtaacaggttactttggatcatccaggtgggccctaaacctcattgcaagcacccttataaaagagaggcagagggagatttgagacacacacagagagaagacacacagaaggcagtgtggctacacaggcagggactggggtgatgtaaccgtaagccaaagaatgctggcagccactagatgctgaacaaggaagtgtggtcctgctaacatcttgattttggacttctggctatcagagctatgagggaataagttcctctttctatcaggcacccagttttgttacagcagccccccaaaatgaacacaattgaatggtgctgttcaaagactgaaacctaacacctggagcgttgactttttcctgtctctctctgtccaggatgaagcagtaatgctgggtaaaagtgtcagctctgcagaccagagttttctttcatgtggagtgtcccagagtctagactggggagcagagtcaggaagcagtatggctgaagtattcacaggcctgcttggtcacttataccacagccatatcctctaacctggaattcattaggatgaagctcaaattttgatctccacctatcggatcctctctatctctctatcagttcttgctacggtctgaatgtttgtgtccctcccctccaagttcataggtcaaatcataatccccagtgtcatgctttaggaggtggggctcttgggaagtgattaggtcagggaggaagattactcatgaatgggacttgtgcccttataaaaaaggtgccagagacatcccttgccctttctaccatgttagttcatagtgagaaaatggccatcaatgaaccgagaagtggcccttaccatgtaacacatctgccttgctcttggacttcccagcctccaaaactgtaagaaatcaatttctgttgtttgcaagctacttggtgtatggtattttgttagagcagcacaagcagactaagacagttctgaattgggattctgaagagaggggtgttatttattaatccccttaaaaccccaagagaatgcatgggaaatatatctgtggactggttggagagaaaaaaaaatttgtaaacaggatgtgatctgtcaggatcctcctgaaagaaaagtcaggggtggaaattagtaaggcaaaccagggtcagagcttcccaagaccatgggaacctacctcttgcatcagcgtgacctggatgcgaaacatggaatcaaagaagatcattttggagctttaagatttgaccaccctgctggattcggacttgcatggtgcctataggccctttgttttggccaatttctcccatatggaatggctgtatttacccaatgcctttacccccattgtgtctaggaagtaactaacttgcttttgagttaatgctgaaatgagttaagactttgggggactgttgggaaggcaggactggtttttaaaatgtgaggacatgaggttggtggaatgatatggtttggctatgtccccacccagatctcacctggaattcccacgtgttgtggaagggacctggtgggaggtaattgaatgatgggggcaggtctttcccgtgctgttctcgtgatagtaagtatcacgagatccagtggtgattataagggtgagttttcctgcacaagctttcttctattgtctgctgccatgtgagatgtgcctttccccttccaccatgactgtgaggcctccccagccacatggaagtataagtccaataaacctccttcttttgtttaaaaagaaaaaagaaaagaaaagaaattagtaaggcaagttctgacacaagactgcctggattcagatctgagctcagaccttcccagctgcatgactgtgagcaaatcagttttttctcccctactcagttttcccatctgtaaaatagggccaaataggagcccctctctcctagattaaataaatgtatggattaaataaatatatgcatataaagcacttaggacagcttacacagaggcacataataagcccccaatagatgtgagctattattctctagaaaaatagttgagagaaagggagaaaaagaagttgcctatagatgcagacataaactctctttctctagatgactgtgggtaaaattcagcagcatttaaatgtctggtctgacccactgttgagataaccagtaaaaactcaaggcctcaggagggtgggggaaaagggagttgcaggtgtttgcaggaggaagccatcatttcagccaataacggacttggtgcatcatgggcatctggcagcacagcaaaggcgctttggcagcttcatgtacggtacaagtgagtgaattactgttatgctaattaaactttttaatacagcatcaggaaagagtctgatcccttcatttctaatatcttggaaatgcagggaaggaggagagggtcattgattcattaattcaacacatgttcattgagttcctgctgtgtgccaggcactattccagcccctggagacatgagagtaaatgaagaaaagtcctggattcatggcttctattatagtgataggagagagacaataaacaaataaacatgtgaaacataaatataacagtcagggctgggcgcagtggctcacgcctgtaatcccagcactttgggaggctgaggcaggcgaatcacaaggtcaggagagcaagaccatcctggccaacatggtgaaatcccgtctctactaaaaatacaaaaattagccaggtgtggtggtgcacacctgtaatcccagctactcgggaggctgagccaggagaatcacttaaacccaggaggcagaggttgtagtgagccaagatcacgccactgcactccagcctggtgacagagcaagattccatctcaaaaaaaaaaaaaaaaaaaattacagtcagataatgacatgggctatggagaaaaatgaaatagataaatgaggaatgaggagagggtaagaatgagatggttttaaatagagtggtaagttccccagtgctgctaaaacaaatgaccataaacatagtccttaaacaacaaaaatttatttttatctttctgttctagaggtcagaagtcctaaaataaaggtatcggcaggactgtgttccttttggaaggtttaggggagaatccacttccttgactttttcagctcgtgaggccgcccccatcccttggctcatagccccttcctgtatcttccaagccagcagtgtggcagattcatatttctctctgatgctctttccaccatcatatctccttctctgactctgtctcctgcctccctcctataaagactcatgagtacaatgggcacacctggattatccaggatcatctctcatctcaagatcctcagcttaattatgactgtaaagtgtctctgccatgtaaggtagcaggttctgggaattaggacatggatatcattggaaggccattattctacctaccatgatagtcagaaaagaccccagtgagaaggtgacattgagagaagcaaggatgtatgccatgcagttagctagggaagagcacaccaggccacaaatgagaggcaggtctggagtgtttgaggaacagaaagggcctgatgagctgcagaggagggaggaggggagagtagcaggtgctgaggtcagaggtaaagggggaccaaattccacaggcccttataggtcactttgagatcttctctgccaaccccaccctgtttgtgaaagactgaaacagactatggtctcatttggttttcacagtggtgtgacatcctcagtttatgcttgctgagtaaggcctgaggccttgcctcacctacccaggcattaagggatagagctgggtgtttttggccgttcttgtgtcactataaagaaacacctgaggccaggcacggtggtttatgcctataatcccagcactttgcaaggccgaggcgggcagattgcctgagctcaggagttcaagaccagccggacaacacggtgaaacctcgtctctactaaaatacaaaaagttagctgggtgtggcggcatgaacctgtaatcccagctactcaggaggtcaaagcaggagaattgcttgaacccgggaagcggaggttgcagtgagccaagatcaagccactgcactccagcctgggcgacagagcgagactttgtctccaaaaaaagaaagaaatacctgagactgggtaatttgtaaagaaaagaggtttacactgggaagacaatgtagtgattccttaaggatctagatccagaaataccatttgacccagcaaccctattatttggtgtatacccaaaggattataaatcagtctactataaagacacgtgcacacatatgtttattgcagcactatttacaatagcaaagacttggaaccaacccaaatgcccatcaatgatagactggataaagaaaatgtggcacatatacaccatggaatactatgcagccataaaaaaagatgagttcatgttctttgcagggacatggatgaagctggaagccatcatcctcagcaaactaacacaggaacagaaaccaaacaccgcatgttctcactcataagtgggagttgaacaatgagaacacatggacacagggaggggaacatcacataccagggcctgtcgtggggttgggggcaagggaagggagagcattagggcaaatacctaacggatgtgaggcttaaaacctatgacgggttgataggtgcagtaaaccaccatggcacatgtatacctatgtaacaaacatgcacattcagcacatgtatcccagaacttattgtaaaattttaaaagaaaggataaagtttaaaaagaaaaagaaagaaaagaggtttaacgggcttacagttctgcaggctgtaccaacatggctccagcatctgcttctggtgagagcctcggggggctcacaatcatggcagaaggtgaagcaggagcaggcgcaagagcatgagggaggagctgccacacacttttaaacaacctggtcttgtgagaactttctcaatatcatgagaacagcgagggacaaatccgcccccatgatccaatcacttcccaccagggccctcttgcaacactggaaatcacatttcaacccgagatttggaggggacaagcatccaaaccatataattgcatttcaaacccacagcccatctgactccaaacctgccctggacttctgagtagggtctctctgatcaagtgctttagctcctggtttcaaggatacatcctctctgaaggcttcccttcccttcccaacactaggttaggtgtcctgcccatgtgcacttacactgatcaccttccatactcattccaaggagaccccttttcatactgtattataattcctggatttagggtctgtgtctcacctttaagcctagatcatgttctatttatcaatggatacttacagtagagtttagagtaaataatcagtaactgtttgtaaatgaattgatgaaattaagagtaaatgcatgagtaaatgaccttaccttagcaaattaataggtgagtcccagaaaactaaaggctcataaaatagcacctaaccttaaaaggacacaccttttaactcaaggtgtttagaagaaatgcatgacagttctgcttatggcacaaagttccctgctataagaagtggagcagggaagtcattaaggatcaagaagtcccttcctagctgcaggaagcagccctcttagccatgaggagcatccatcatagatcatattaataagcataaaagcaggagaggagaattgctcctttggaatcctttagctcctgtgcttgctttcacctcctggagcaacatccagcccaaaagattggattaagaagagattaacaagcaataggcagtgattccacgcaggaggctgatgaacaccatgaggacatctcaggatccctccctccaggcatcccgtggcccacacgtctgtctgtgtgtgtctggtgctgatgaggtactgttttgatcatgacgtaaaagtaagaatgtttggaataaagttgtcattttcttctgaagcctgttcacagcctgtttattcctccagggacattctgagtctgattccaacaatatgctttgagattattaaaagacttcccaaaaaacactgtcagagagaaactgccaccatagtacatagctgtctggggctggaggaatcctggctctaagcaaaatcttgggatatggagcacaagtttcagatgaaaacagcttctgggaggaaggagagcattttatagcagaagcattaaattaatcctcactcatacagtgcaaattttgacacaaaaatccctggtttccaggggagcagggccaacaggagggcgctgtaggtttccactaggctgcaaggaaatggatattaaataagaaggagtgggagttggggagagaaaagaggccaagtagagtggaaaaggaaagagcataagggccgggtttggtggctcccgcttataatcccagcactttgggaggccaagttgggcggatcacttgagctcaggagtttgagaacagcctgggcaacacgccgaaacccgttctctacaaaatttatccaagcatagtggcatatgcctgtggtcccagctactcgggaggctgagatgggaggattgcttgagcccaggaggttgaggctgcaatgagctgtgatcatgccaccgtactgcagcctgggtgacggagtgagaccaaagaaaggaaggaaaggaaggaaggaaggaagaaagaaagaaaatatgtgcatttctaagaggcaactttatcttgggaaattaacttcacatagcaaggatgcagtctgactcacagtgtgaaatgctgcacttctcttgctaagctactgcttacaaccacacggaaagaaaccttgcagattagcagatgtagatggagttgtttggctagaaaagggcgaaatcttttgccacaataaccataatatttactctgtgccaggtaccccgttaggctctggggttgcacgtggctatcagtgagacttagtctctgtctgcacggagggcacatgttaaacgagtccttgaggttcaaaacctcagagaagtgttatactcatatttatttttccgaagatttctctggctatgttgtggagaatgcattagaaaaggacaaagatggatacagaaagactgcttaagaggctgttattgtcattcaggtgagagatgatggaggtgtggaagagataaatgataaagaatcaaaagatatttaggtatggaactggcgtgacctgggtatgcatctgagaatagagcaggggcatcacttccagtttcagacttgaccaactggtggaggggtgcactctacagaaatagaggatgttaggagagaaggtatctgttggggaaaccaagagttcttagatgttgtgagggacactgcagattggctcacttgacctctattctatgctccttctcatggtccatctcatattatagagtctagaaagccaaaacaacattccccacactctcttataattcaggattcaaatgtggttcaggtcatcaatcagctacacttgcatgagtcttgaatccagaagtgagtcaggtggagaaagaggcagcagagcctggagcatccattctgctgatgcaaatctagtgagttaaatgactctgggtccaacacttcaggctatagccgcctgacatctgcatcagagctaggcccacatttggaacagcaggtttctaattccttagcttcctgcctgtggcaaagctagaacttcccctagagggttaattctgcagtggtatcctgggtgccattcctggaagcctagggccttctttagtccttcctacaacttctaagcacacaatttcctgtagaagcccctttctgcttacaatgtctagaatgcattatgctctcagcaacagaaaattaaccaatatgaaagtagtgagtttgtagagcctgcaagaaatgcaggtgcaaatacacgcatggcactcagatgatataggtctggggttaaggagagaggactgggctggcaatttatgagtaatgttagcatgcggatataggatgagatcatcctgggagatattgccaagaaagaatttgaaggttgagaggaaaggaggccctgggacaaaagctttggaaacaccagtttttgagagctggctagaaatgcaagctggccaccataggaagagggacagaaggtaggaagaaaccaggaggtgctggtgttatagaaaccagaggtagaaagtggtcctttaagaatggattaacctggcaagtgctgctaggaggtcaggcaaactgaggactgaatgtgcctgtggagtctggtctttggtaaccttggaaagagcaggtttggttgcagtgatgacaacagggtcagattatggagatccaggggtgagggagagataagaaaatagataccatgagaggaggcagtcttaaaagaggcttaaccatctctggaagtgacgaaggattaaggaggagagtttataaagaatctttagtcaagctaagccactcctcatcatgaaacgttagtgaggtgttatgtgaggtagtattgcatattttacctaaatgatgaatttttgcatttttttttttttttagacagattctcgctctgtcatccaggacatccaggctggagtgcagtggtgctatcatgattcactggcacctctgcctctgggctcaagtgatcctagcacctcagccccccaagtagttgggaccacaggtgcgtgccaccgtacccagctaacttttgtgttttttgtagagatggggtttcactatgttgcccagccttgtttcaaactcttggactcaagtggttcacctgcctcagcctcccaaagtgctgggatgataggggtgaggcaccacgcttggttaatttttttttttatatgggagaaagaagcacatgtttgaatggttaggaggtgaaattggaagacttagggaagagggaatgcttacacacctcaatggttgtgcaaatgtaggaggtagtgggctccagatgggggagatggttctagagagaagagagaacaactcttccactgcgccgggagggaaggatgaggcagagagagcagatgcattagggattagctgttgtgggcaggaatgggaggacagatggactgtggtatttagtctgtgcagtaacagacacaattctctttctaggtttgtagggggtgagagttggagattttgggagagtggagaaggtcttaatggtcatcctggagaatgaaagggcaagctcactagattgccatcagcactggggccctgcttgggcttagtgaccaggaactgacagtgggatcaatctgtacaactgcaagattgtgcttggcagtacttgggcacttgctcacagccagggaacaggtggtcagctctagtcatgcaggcttggggtgttttcaggtcgctatgatggaaggacaataggcaatggaaacggacaagagaataaatcagaggttctcagtgacagaagggatggtagcaccctgctgtggtgtctggaagtaggcaaggctgttttgggttctcacaatgaaggggagcatattggaatttagtgggcaggacccagggatgctaaatgccctcaatgtggaagagggtacctaacaacaaataatcatcccctgcaaattgccaatcatacccaatgataaatgatgaaactaagggactgtgggcttagctaactaagccagacaaatagggaggtaaagaaaggtggaggtaggttaagagtaggaagacctgagcaggtgaagatcagaccaaatcaggaaaggctgagcatgcaagctggcaggattagtgtctgtggtcagacggtgggtgtctgaatccctgatttcagaagcaggcagtttccagtgatgcagcatgaaagaggactccagtttgagtcttttgaaaagcaaatgtcaagatagagtttgatgtgcaagagatttattggggtaacattgtagagggtaaaggggagagtagcaggagtgggtggggaaagtcttcagaccaggatgcagggctgacacctgtgacaggagaggcacaggaaggagggttgggtgggagaagcttcagagagcagccccagactgatgggggagctccagaggaaagacggcccactgggggtcccaaggagggcaggaatggttggcctctggtaccctgtagtgttcatcatggccttgcacaaaactgcagccaatctgaagatgcagctgatggaggctgtccaccagccccctccaccaagcagattgttctgaagtgagactgagcaatgcaccaccagggccaccacatgggggtagcagatgtagtgtgtgggtaacggaagctccaaaagagcaggactagcttttttttcttttcttttcttttctttttttttttttttttgagacagagtctcaatctgtcacccagactgaagtgcagcagcatgatctcggctcactgaaacctccacctcccaggctcaagcgattctcctgcctcagcctcccgagtagctaggattacaggtaggcactactaccactcggctaatttttatatttttggtagaaacagggtttcaccatgttggccaggctggtgttgaactcttgacttcagatgatccacccacgttggcctcccaaagtactgggattacaggtgtgtgccaccacggcccgtgtatttttaaaattttgccttttctcatattttagccctaatgctttgacacattcaaatttcattcaaaagtttgtcaaatgaactaatgaatatatgtcaagaaactgagagagtagagcatagagataaagtcttcccattagggttacagtccagctccaccacttactaactcatcttaggaaaactatcactgaatgggaatggtgataaatagctcctactctgtgggtctttgtgaggatttaaagagactttaggaagaagacccagcacagtatctggaaaatggtatgcaatcaatgataactactagtagtatgattatttctgcccctttccattatcttttgcaagaaaaccttttaagaacaaatagaaacatgttcaggcagttggactacgttacttcttcctatattagactttttttcactttctatattagaccccgtgctcctggaaagtgatgaatccatgttttcttgctttgtaaatcatcatagtgccccgaacaatgttctaaacacagttattatttacatcatataggtagaataaagatgaaacaaggggagagtcaccccgcagacattatcagagacttaatgagttcttgggtgagagagtaagaatgtgagtactctgtgagtgtgtcagagctggaggagggtgggtttcaccaatcctagataaatatcaccctggatccgtgtcttctcagccagggaaaggaagcaacttgcttttccttttgaacaaagcctgtgcctgaatgaacatctctggagagaaatgtgtttgtacattaaactggtaattaaaggtccccaaaaaaccaagtctcattactcagcttaaggagctgcctagatagcgtctggcatagtgtcaagtgtctgcttggtgcaaagctgagcctggagtcgtcccataggctgggggaccttggagacctgcctcctggggctctcctgcaccagactcatgtttacattgggctgatcataaaccaagcaggtcctcacacttctcaggtttcattgttctcctttctaaatatttaaacaggctgttaagaagagggccgtgtcaactgcctgattcagtgaacattacaatggttaattgtcgggatcacaacagacgtcacaaactccaggcaggttaaaatctctcagccttgaggaaagctgctgccagtcattcttctctagactgaaagagtctgttagaatcaagttcagataaggtaacactgatcacgtcaatttcttctgcacaaaatagagcatgtggtttgtactttacaaatatttgtctaattaatcactttcactgaggcagggagataataataccttatctttgtaaaatgcttcctatttgcaaagcactttcacccatatcatctaatttgctctttattgttgggtgttatttcttagccagactagggatgatcctagttattaatattaatattaaaagcaaccaccaccccaaccatagcagctgatttactgacagctttctatgttccatgcactgttttaagtacattacaagtaggatgatcagtgggaacagacaccaaaagaataaaaaagatcatgcatttgctttgcacatattgaattttatgcacttgctgggaggatgctatacttggaatatttttcccctccaaacctcatgttgaaatttgatccccattgttggaggtggggcctaacaggaggtgtttgggtcaaggtgtggatcccttatgaatgacttggtgctgttctcaaggtagtgagttcttgctctgttagttccctcggcagctggttattaaaaaaaaaaaaaaaaaaaaaagcctaccccagcccctggctctcccttgcttcctctctcaccatatgatctctgcacaagccagctctggctcctgttcaccttccacgatgagtgaaagcagcctggggccttcaccaggagcagatgctggcacctgtttcttgtacagcccgcagaactgtaaaccaagtcaatctctttttcacaaattccccagtctcaggtattccttcacagcaatataaaactgattaagacagaggtactcagggtggcacatttttggacagtttctcctaggaaaaaccttgctccctacaactaacttcgattctctccatcatcctttccatggcttccaagacgttccaggatctagctccttttctgtagtattctgaataagccaaataactataattgataataacacaacactaatggggcatgcctatatgttaggctttgttgtaagcagtttcaaggcattctctcatttaatcctcacaacagcaccatgaggtgggtagagttattgtctctattttcagatcaggaaactgaggcataaagaggttaagcaatgtgcctgcggtcacacagctattaagtggtgtgctgggactctagctcacatggtctggctctagtgtctgtgttcttaatcaccacactgtgtttcatggctggtagattgtggcatccctttctgccaagattggacctaacttgacaaacatggggtcagtgagccccgttgacacctctttgctctagatgaaacaatgaaggctcaaagaggtcacgtgaccttctgaggaagtcccttctcaatcttcaatgtccaagttcattgctaattttactatgccatgctgtcctcctgatatggtttggatttgtgtcactgcccaaatctcatgttgaattagaggaagggcctactaggaggtgattggatcatgaggatggatttccccctttctgttctcctgacagtgagtgaattctcatgagatatgatggtttaaaagtgtgtggcacttccccctttgctctgtctcctgccaccacgtgaaaaaggtgcttgcttccttttcaccttctgccatgattgcaagttacctgaggccttcctgtcatgcttcctgttaagcctgtggaactgtgagtcaattaaatattttttcttcataaattaccaagtctcaggtagttcctgatagcagtgtgagaacaggctaatacacctgccaagttttagcatctcaaactgagataccaaagcataagaggcaggtgtcaactatttttttaaattaagctcttgggagttgcatagcgccccccacccccgccaattaaaattcatttttcactttcctccataaaaatgcttacttttgtaattaatcagagaggaagaaaccaccagaagccttcatttgcttggcctttctggttggccagctgttctttggacatttgtgtgttaaactcctggaggcagagtcttcttttccaagctctcctgtctaggtgctgactgcctgcacttttgctgccccatggtcgtgttgacttgagtttccagaggggagctgatgtggggtatgtccagcctattctggacaagaggatgcaacacactattacacaagttgcccacacaccaattaggcaaatagtctacttttgcaggaattagacatttcttacattgaggaaaagttgtcctggctgaggcctcctggtttgctccagtgggaatcaaattattggtttgtaagagaacatttctgcaattatccctgaaagagcaccatctaccatcttgtgggctacatttttttttcccacttgactgtctctgtagttttatttgtttttagtttagatttttttttaaacacagcttattaccactttttaaatctgcatgaaagtggaaaatggtttttccttataaaagactgtgagtatcagggtaacctctactctgccttcaaacaggactgagattactggccactcccactgctgaccacttttgaagtgcttagtgagttacgcctgtgaacctgttagcaccacgctccacgagggtcaaacattttcaaatgatcataatgtggttgctaaagacacagcctctgtgagacttgaaatgtcacaattgtttaaacagtcctgagaaaatgaccctgaaatcacatccacctgggcgaagcccatttcccctccacttgaaagcaccacggtacacacacacacacacctccaacatatacagatgttatcagaactccagaaagcaccaaaacactgcactgcacaccacttcatttaattaaaaaaccactagttctcaacctcggctgcacattacaatcccctggggagcatggctaccttttgaacattctgatgtccaggactgacaacccagaggttgtgatttaattgttttggatagggcatggtgaccaactgtccctatatgcccaggactgagaagtttccaggatgtaggactttcggtgctaaaacacagaagattccaggaatctgggactagctagtcaccctggtggagacaggctgtttttgtaaatgtccctggcgattctattctgcagtgagggttgagaaccattgggctaaactttctcaactttaacccacatgctgaggacaagtaacttaaaacttgagaaaatattgttcttttgtagaggatttcttttttcatactactactaataaagagaccctctgtaaatgagtcctggccaactggtgccttgccttcccttcaagggccccaaaagagtcactgttcctgggagcagcttgctatttcctcccctcactgggcagaaatccacacaatgagcccctctgttaaagtaaggagggaatatggagttgattattttataattaaagaagactctgggggagatgttttgctcaggagcccagcattccaaactgggtcactgtgagctggagctgtcatcagccctaaccagcaggaaataccaagcagagcagatattctttctttacttttcagttgactttcacgtgacttgtttacatccagcaaggcttgtaataatgccttgtttatatccatcatcttcctcctgagttgccaagctgggaatggaagaagagcatgtatacctgggaaacttctagacatactgtggctctcaaccctggtatcatattaaatcagctgggaagcttttaagaatccagatgctcaggcccaacccccattcaattaggtcaggatctctgggggtgggaaccaggaaatgctttctgaaatctcccccggggcattataacatatagccagggctgagaatcactgctttagagtactgattctcaaggtgtggactcggaactagctgcatcagcatcacctggcaacttgttagaaatgcacattctcagggcccatcctggacctactgaatcagagactgtgaggatagtccccggcaattgattttaacaagtcttaggtaattctcaggcatgataaaattgagaaccagtctggatgacaaggctgtaatattattttttttaatctgctgggatacttccactgtgagctgttgcctcttattttcttatctgcagcaaaacccaaatttctcttttgatgactgtcagaaataacatggttattcctggctcacctgggatgaaaaaacacagatgacacacctgggtctctatgcttatttctggtctgggaaccaacaaagcaatcttatgaatagccatatgaagcagtggaggcaaattatttggtttcctctaattaagtcatctgctttagcattgtcttacagggtacaactttctagtcttctgctgtctcttcatctatcaagcttagagctgccagaaaaaaaaaaaatgtggcccaaacaggtttaattagagagatactgagttaaagttcctgaggaaaatctatgataccataggttggggtgtttattgtgtagaattgggggtagagaacctaaatttactctaattaagcagggtttgtgtcaacactggaggatgggaagccaggcagagagaagagggtgatcagcagcaatctgagccaagagaagtgaaagcaaagatgacatgttctcccatctggagagttacttaaatttgagcatctaaaatcttttgacccaagagttactgagagacacaaatgagtatttttgtattagggaagctcaaagattgtcatctcctgtcctttccttcaatatacaggaccaaatcacaggaaaagacagctgactttgtacatgtctttataagtctcttacaatttggggatccaaaatgttattttttaatttttttttgaagcagagtcttgctctgttactcaggctggagtgcttcagcctcctgagtagctgggactacaggtgcacaccaccacacccagctaatttttgtgttttttttgtagagacagattttcaccatgttgcccagaccagtcttgaactactcgcctcaagtgctctgcctgcctcagcctcccaaagtgctgggattacaggcatgagccaccatgcccaggccccaaaatgttattttttcaaagtaaaaatcaaagaatattaggtggtgaactaacctgtattcagttgcgcatataatatattttaatccttatggcagcactatgaggtaagtatcattggcttgattttacaaattagaacaccgaggatcagagacactaagcaaataacttatctgttaaatgacagagctaagattctaatccaggttcgtccaaacctgaggcctttctttgcttccttggtccaaaaaatattaactggagcttagacttgtgtagccagctggcagttctacatccaaccacgacacaaatagattagtccagaacttcacccatacaaggagacactgttggggcaattctctatggtgcttctacgtatcttgtgatagattctatcccagactatctttccaaggatgtttatagagcaaagagccacagaagatatacgtctctccagggaagaggacagattggttttctgactatgataaaatggataacatatctctctgggacaaaggttgggtaagtttactacggcctcccccttataagtttgaggacttctgcttgagttttctcagacccactatgtgtacaacacccatccacctgggcctgcctccgcattgccctcacgggacttaagaggcaagggaaaccactgtggccatgagtgataaagtcctttatctctaacctaggagtctcatgtcttctgccagcatcaatgaaactgtggcaggctcacttgttagcttgcaaacagggtaaaatctcagacccttcacagtccttgatagacatggattcctcctccttagtgtatgtagcagcacatggaattccttcagacttccttggttctgagtgagcgcaactagctgactggagttggtgtgttagaatcgtcccactattccctttcttcctctgtcccttttgccgcgattactgaacctgagcagtcactagaatggacagtggggatttaggaagacagtgttaagcagatgttaacatcaaaaagacctgaggctcatgtgtataccgagttgaaaccccactgtcattgaatgaggttgaaagtgactttagtagtttaggctactttccactcaaaggggcaaacttaatagaacctcttgtcattaatccctccatgatggaagctcatacctaaaaaggaaagtgaaattgactcaatatttacaactctatggtgtcttctctttgatcttagtcctgttagcagcagcaaatcatacgagtatgcagcaacctcaattcttgcctcttcagaagaaataattcaacaaggggcataaggcagagggagagacggaggcaagtttgagagcaggagtggaagtttactaaaaagtttacagcaggaacaaaacgaagtaaagtacacttggaagagagccaagtgggcgacttgagagattcaagtgcatgacgatttgacctttgacttggggttgtatacattggcatgcttccagggggttgcattacttctctcctgattcttcccttggggtgggctgtccgtgtgcccggtggcctgccagcacctgggaggggctgcacgtgcagtgtgtttattgaagctgtgctcatgatcacttgaggttcttccgttaccagcagagtgttcctagaggaacactagaggtcatacaccgggtaaacgcctccattttgcctcttagtgtgcatgcttaagcccacttgctcaactcctgagatcttattgggaagctgctgatcaccagtttcaggtgttttctgtgtattgggagactgcctttccctgacgctggctgcaacccattattattttagagaggcagtttaacaaacaaccgcctgaccatcacctgatggtcgcctgataatcctggttcaggggaccctctcctgccctgctcaagtctgcctaactacctactgtgacagtcctgtcttctaaataaacatagactaaggtggatcttcaaataccttccatctaccacccatttttcccatccccacacccccaagtctaggcaaacattttccaatctatcaaccactccttcttaacatgaggaatagaccctgtgcccttccaggctttctcctctgaagaggctctattttgtccaccttttcatctaagtcctttaaaaaaaaaatcatttggttcttgaataggcaatacctgcatgcagtacagaattcaaaagatacaagtgtgtttccttccctgtcaaactccagccacccactcccctcctccaatcactcttactggtgtcttattgtcttattcttcctcctattctgtatatagtcaaggttcattgaataggctgaacatacagggcacaaccagaaaacagctttgggttgtttttttcctcattactatctttaaactcagcagacggtttttgttttttgtttttttcttttttccagcatatcagccaaaatcttttaggcattcaaatgcctgttttagtatgagatttaagttttagtcttacacttgacacaatgcttctctctcccctgcagctcagactggaccttcagaccaggcaccagcagcaaagaagtggaatgtagtttgttacttccctgtgcctctatctcctctccactatttctgatgcctccaggattagggttgttaaaggcgtgattagagggaaaggaagagtcttccttcataaatactgttgttattcatccttgatgccctatgtggccatgtgctaatatatcaatacagtctcaaggcagaacacaaaataggtgctcaacaagtgttaagtgaatgaatgaatttatgagtaaatggatgactggaactcagcaataggtgtgtcccaattgacaaaagattagaaaacaccagcgtataccattaaaaaggacaaaaaaaaatatgtatacacagctctgcttgatacaccaaggtccatgggggagaagagataaacatgtgcattcaagttatcactctaagccaacaatgaccttttagaaaatgtaatatccaggactgtgttaacataatactagcacaaggatagtggaactctgtatttatattgcttattttgaatattaagagttctcaggtaggttctctcaacttgcaaacaagctgtagtcattttttagccctaagccagacttcatatttatccttatgaaattttatctttttagttttgacccatggttcccctctcttgtgatctctttttaatacttatctattatttaaaatataattgagcctccaagagttttcctctgaaaatatagcaagatctttcatgtgtttattaagtgaactaataaaaatattggccaaatacaaagccattggaaatcctcctctagtctgagacatactttttgacacaatagcatcgtttacattcagtatcatttagggttaagttcagctgcatgtaacagaaaataaataaataaataagataagagtttagttctttctcacttaaagtaaacctgcaaaccagcagtacacagctagtatagcaactgtgacaggtactaaggacccaagggtttactttctttcggcttcataacatgatcttaagaccacccaatgggttaagatagctgctggagctccagccattacatccctaatctaaccaataggaaggagaaggatagaggcaaagtgtgtaactactcaatggattcttcctgcctagtgtacagataaaatcagaccatggcattgcaataaagaaagtgtttaatagatatgaagctggccacaccacatgggagacagagttattactcaaatcaatctctctgaaaatttaggggccaggatttttcaaaggtagtttgggctaaggggtggggatggctaggcaatgggtgcttgctctgattgtttgggggtgcaatcacaggggtgtgggaaatggtcctcctatgcactcagtcattctggtggggccacaggagtggttagtgggtccaggtggagccaacgattgtcagacctgcaaaaaacctgaaaagatatcttaaagggccaatcttaggttctacaatagtgatgttatctgcaggagtaatatgggaagttgcatagcctgtgacctccagaataatggctggcattcattcatgtctacaccttagcagaattcaggctcctctatcctcctacactggtggtctctcattagctttacaaaggcagttgaatttgggggaagggctattatcatttaaactgtaaactaaatgtcccccaaagttagtttggtctaagcccaggaataactaagggcagcttgaaggcaaaaggcaagatggggttggctaggtcagatctccccgactgccataattttctcactgttataatttttgcaaaggtggttttaatgggaccccttccttttaggaagacttgaaaacattgagattctgtcacccagactggagtgcagtggtgtgatcttggctcactgccacctctgcctcccaggttcaagcaattctcctgcctcagcctcctcaatagctgggactacaggcgtgtgccaccacgcccggctaatttttgtatttttagtagagatggggtttcaccatgttggccaggctggtcttgaactcctgaccttgtgatccacctgccttggcttcccaaagtgctgggattacaggcatgagccaccatgcccagcccatgctgtacattttacttaactagaatctagtctatatttaagaagaatgtgagaaaatttttgttaaattccttgtgagtattatggttatagtaataactatctaattcttctgatatactaacttaacactcttaccccaaatcaaatgagttagacaaaatttatctgtaataaatccatgtttgtgtctagttatcaccatgttcattttttcctttgattgttcataatccataggtttaaattctatttgagaatttggggggactaaaatctgtaaaacaaaaataaaatcctaagccccctaaccaattatgaatccccctatgggccaaggggatcccagagaagtctgaaaaccaaattcctggccatgatggaaaaggaggttggacacacctcatcgtactccctccctttaggagttcaggcagcactgaccagcattaacattaaaacagacatcataagactgacacaacagactcttcgtggcaataaaattccaaattccagcctgactctggtgtagcatcacatggcagactgaaggaaataaaaatattttactaccaaatatatttctttgacatattttgaaatggcactgtgaagccatcttttggggggaactgcagagaactgcagagaatctcgcttaatacggttcagcctttcccaggtctagaggagattaagactctgacccctttaagggtccaaaaggagacatttaccacctattctctctgaaagcagttacccggaggcttcacctacgtaacaagaaccttggtctccacagctacccttagaactcaagcattcttttttactgacttcaaggctttacaaagcttaactcttaaccaagtgacaatcagaaaatctttgaatccacttacaacctgtcagcctcacttcaccttcaaaacatccaggctctttaggctgaaccaatgtacatttttaatgcacttatttatgattttacttacagttcctgtatccctaaaacataaaaaccaaactgtaacctgaccacttcaggcatactttctcagaacctgttgatactgttctccatgccatggtcactcatattcactcagaataaacctctaagtagtttacagagttgttgtttttgttgttttctcactgacccatcaaaataagtagttttctgaatccacttcctcttttggaaagtagtacacacgctcatctcttctgtgctgagctgatttctgaaataaaatcaaaagaagttcatcattacaattgcaacttctctagttccttgggttataatctatatccattgggattcaaactgaaacacaaatactaggtggaatcaagaattcattctagggatttgacttcaggcacttgcggacgcttgtcttacatctggtgttggagtctgaattctgcagggcagcgggtcagggtggcaaggcagatgcagagcagggaagtgaggacagactggagccatcttctgccttgtgttgtctccaagtctggcccctttggctcaaggacctaaacatgtgctgcctgggtctgagagctgaaggagtggatcatctggctgcttctgcaggcccacaacatgagccagcagactagcggcatgcctcagatgccctggtgatcctcctcccaccttcagagcggggaaagaacaaggctgccacttcccttttggcttccaactgtggtgcaaatgtatctttgctgggcccttgccgggaaccatgcagggtaggggattctgggaaatgtagttccagctgagctaaaaggccccacaaagctgtcaatttgaagtctttaaggctgaaatcctcctactatcttgtgacctattttttcttaataatgttcatcttatcctttctactttaagtttatttcccttggtagagaaaatagaaagtgaatagatagagtaatcctgctttctctccattattcgctagcgttgtgctgtatgcacccagcagtgggctactcccctcttgctccctgtgactctgatgagagctaaagtgtcctgtctgtccttggtaggtcccatgagctcctgctcttctgaaatgtccccttctcaagctattggatcagatccattgttgttctgaatgaaattcattgtttcccttcttttgtctgtgctaaaatctaagagggtgtgggctcattgtctcaaggcttatacattcacacttctcttgctttagagtcaaaagtaagtctaatgtaggaattccccttccttctcaacagtggggcaccacaccaccaaggccatgtaacaggacagacatacccttctggctacctgctgcccttctgtgatcatttttccctttgagactgccctttatgcaattaaaaaaaataatttggacaaaactgtgtatgtgtatgcaaacatgtgtgtgtctacaggatataatttgccctggtaaggcgggcctacccagtagtttgacttcacaaacactgcatctcctgggggtggcttggagcagtctgtagggagtatggaggtgaagagcagaattggccaaaacctctaaaaagagaatgacagagagagagagagagagagagatgtattctttccctcaacaaagagtagaggctgactttaacccctgagaaagagagagagagagtgagtgtgtgtgtgtgtgtgtgtgtgtgtgtgtgtatgtgtgtgtgtaagggctgccaacggcaggaaaagctacagaaacaaaagccttcactgcagagtcaaaaaatgaacaggaaatggtcattaacatcctgcaaatgttctgatctgctgtagaggccctgactcctaggtgattaaatgtgaaagaatttcaaaaatcaggctgtgaaatgagtctttttagttaggagagaaggaaagccctattgggtaattctaaaccttaagaactgaaggagagtctccaaatttcagcgccagcatcctatttaatgtagatctcctctgctgctttcttcagacataatcccaaatttccccctaaaagcaccgagttagttactaagtattttggtagccattgcctcccaaggggacaaggctcttctatgtcctcttggagctctctgaattgtcccttctaccctaagtcaccagagtcagaagaccctcgaaaatttttgaactaaaacacaaaacggaaaacaataagaacaaagggtattttctcctctttctttatttacttgttttaattggtatttatatttacctatgtgaaaccgtattgctctgaccttgtcacatggcatggattcatatctggaatgaggttaagtcttctggagctgtgctacatttttattcttaacctgaggaatatgagaattccgacacccattggtgataagcctccatttacttctagatttaacctaataccatgcaacagtcttgatccacagtgcttgagttaattgtactggacaaggcaagtgtgtgtccaggtggtagacatgtctatgagatggattaaagatgcaacagatacaaacatctctaattcagaggtgctttatcttgtacatggcgggaacagcaactgcatatctagcacatggtatatacataatagcaaacatttagcatattgtaccactatttaattcttacagcaatcctataagaatacatattgttacattaataatttcatcttatagatgagagaactaggttctgagatattaagtaatttctttgcccaaggtctgggcagttttagaactgggatttttgacctggccattacacttcctgctcctcggaaaggtctgaagcagctccacttttataagtgatggaattaggctccaactctggttaacctgcaggaggtttctgaacaggaacagttcacagcttgctcagctgccatacttttctctgtggtctttgttttcggctgtgttttggttttcaagacaatcatgaacctcaccacaattggaagacatctcatctttgatgagctctgacagggctgatgagttggttcctggactctccacggttgctgttgggctttaggctagaactcttctgtactttcatctctttgaatacgtttcaggcagcagttaagcgggtctgaaattacatgtgaaatcaaatttaaaaacaactgattattttctcttcctcagtctttcatctataaaatataaatgtgagtcccttttttttttgttttagaactaaactagggtctgtttgccaagtgcggtaagaccagatatccacaccaagttttgcatcaggagaaagaaaggtgtttatttatcgggcaccaagcaaggaggactatgcagccaatgcttaaatcctgacctccctgatggcttgtaggttaggggcacatttcaggaaagcagaagttacaggcacaattataaatcaatacatggcacttattccttggttttgtactaaaggggtgggatattttggggagtggctataagtcataggtagattcaaggattttctgatttgcaaaagctttatttaaaaatttagggtcagcagaaaagaatgttgattctagctcgtgggtgtgactttctccaggcccctcaggaagaaatttagaacaaagaatggggctcaaagttcagtccctaggtcccccttatctgaggtctatggtgggcagatccctctggtgggggtcaagtttctgaaaagcaactctggaaacatgtgttaagatattatcttaatttctgtaggggaaccaaacatcccatgattctagcttccatggctatcgttttaggctacaattaccttcttgcttatcaagtcgcttatttacttttctgggctagctaggtacctagaatttcacttgaagaaactcaagattttccttcatttctatgcttggagggtgggcacaggtccctaagaggtgagtccccgctctgtttcacgttttcattttttctgaaatctacagcacctctcatcaacctctagtgtcagtttcacagtggttcatattaaggcatggttggctggagtagctcatcatcatttctatttaaaaacctaaaaatgtgacagtcttaaagttagactgctgaggataggatgggatccttcatcaatatggaggcttctgtgacctaatctcatcagaagatccttggcttggttgattcagtggccgggatgggttttgcactggcgtctttgagcagtttcctctttgtgacaaggccagtgagggttaggcttgtagtctaggaatggtagttctgaatcaagatcaagtcttggtctaattagtgatataatctgttcaaccagtaaaattaatacatggaatttgcccaagaatagctgaagctggtaccttttattggagagactccactgagaccccagatatctcaaaatacctttccttttgtttcaccttggcttatcttggtcctattacctgcaataagattattcccaatatcccagactaaactagggtctgtttgcccggtgcggtaagaccagatatacacaccaagttttgcagcaggagaaagaaaggtgtttatttattgggcaccacgcaagatactatttatacaacagatctcagaagttgagccacaggatttcgattttttgctaaagtgtaagaatgaagacattatgctgagaagctctgaagaaattgtcaagatttcttctactagtacatgttagtgaattagagtaggcagtgtagccttagataatgtatgagttaaagtgtgtccccccaaaagatatgttgaagtcctaatccctagtacttgtgaatgtgacctaatttggaaataggatctttgcagatatcaccaagttaagacaaggtcattctgaagtagggtgggtcttaattaatataatcattgtctttcgaaaaggagaaaagacatggacacagggagaatgccttgcgacaatgaacacaggcatcggagtgccacgttcacaagccaaggaatgccaaggactgccaacaaagccagcagctaagagaaaagcatggaaaagattctcccctagagcctttgaagagatcatggcccctcctgtcaccttgattttggacttatggcctccagggttgtgagagagtacattgctgttgtttgaagccatctggtttggggtaatttgctatggcacctctaggaagctcctacagacagcaaggagaggctggccctggtgtaggggttatggatttccatggaattagaaagcaggcactgtcttccttgatggctataagttagaggcaggagccaccggcagctctgtatgggtaatttttcaggcctggggttcattccatgtgggagaagctcctgcaagccaaccacagttctgctaaggctctgggctgttgccttcaggaggaacccaggctaaccgagcagcacagcacagtttgcaaaggatcaggtgcttgggtgggtgccagaagaaagaagagttttcccaacaatgtctgtttcacagctgtgctcagggccagtttccctgaaaaaagacagaacacatcaacttgcttctgtgaaatctaggagttaacgtacccggtgcttgttcctggcctgtttgattctgcgccacctttcttagggttaactgacattgcccattctgatttttccaacctaagcattccctgtctctgtgtttatggcctgccagcaagacagttcagggagccgatttagttacctttagtctgctaattccactaggtgcttaataaatattggccaataaatgtttatttttgcatccagaaaaccaatgacatgaacgctgtggtgcattatccagaattctgctcaggactgaagcacttactattccagctgttgggagtgttggctgctgagagctcatgggcaagtctctccttaagctttgcctgaagcaggctgcctggcccaaagttatgtcctttgctgggcactttctccatttaatgactagccaatgcaggagtataaaggcccagtccccttgcctcaagtaagacctctctcaagggtcatccctcctccagagctccccacaggatgggctgagatctttattgcagctacatcacagtttgatttctgcccaattctccttcccttgctttcctgcaggtctttttcctaagaacagtcactcctcagtgcgcactcactccctcacacaaatctcagtctcgaggtctgttttctggggacactgatctaaaagatccttctgcttgatcctatgtaagtgagaaatacactaactgcacttattaggtacagaatctgaaatgtaagagctacaggaagtaaaataaaatgccaccctgtctctgcagtgtctccgtccccagactaatggctgagcctttaagggtctacagctcatcagggttctcatgggttctgagcacagcgccagctctcagtagacatctgttgaataaggtaatggacaagtgttcaggaatttactttggccctgaatcaactaaatgggcttttaaaaaggttttctatccctttgaggctgggcacagtggctcacacctgtaatcccagcactttgggaggccgaggtgggcagatcacttgatgtcaggagttgaagacccgcctggccaacatggtgaaaccctgtctctacttaaaaacaaaacaaaacaaacaaacaagcaaaaaaacaaaaaagccaggtgtggtagagtgcgcctataatcccagctactcaggaggctgaggcacgaaaatcacttgaacccaggaggcggaggttgcagtgaactgagattgtgccactgcactccatcctgggtgaaagggcaagactctatctcaaaaaacaaacaaacaaaaaaggttttatatccctttgtaatggggaggaaggtctttggagtccgtattagtttcctatggctatattattattaaggccaaaataaagacaagagaaattcattctctcacagctctggaggccagagtccaaaatcaaggtggcccaggccatgctccctctgaagactccagggaagggtctgtccaggcctcttccctgctttggtggtttgctagctgtctttagcattccttagcttgtagatgcatcatgctgagctctgtcttcatgttcccacggcattctccctatgcgcgtgtctctgtggccaaatttccccttttataaggacactgttatattggaatgaggtcccatcctactctagtatgacctcatcttaactaattacgtcttcaacaaccctacttccaaataagatcacattcggaggtactgggagttaaaaacttcaacacataaattttggtaaggacataattcaatccgtgacatggcgcctcccaccattttctatggtgttttcatttttgggttctgaatcccagattctccaccttgccctgtggtaagaatgctggggctgcagaaggaagatggcagaaaaaatgggacccacagcagcaggtctgagtcagaggcggtcaggttctagttgtcagaggagtgagaatattgaaaagcccaacctcaacgatggggcctggctggattgggaaaaggttctgtgcattttgttggtggctacaaacacaactatgtatcattctttaattgatgtagatactcttccctcaagaccagggaacttcactcctcactccttaagtagaagctatgcatataatttccttccaaagtgtggaaaggggaaaaaaaagagtcattttgcagcagagaaacgtgacaaacatcccctcagccaggagatcaagatcaaggtcaacagtgataagttatgtcgatagtgcgtagccttgatatgatgcaatgaaaatgacacttcacctctgtgatcttcctccccaaaattcacaaccacatataaccatgaggagaaagatcagacatgtcccaactgagggatggcctacaaaatacctagcactcctcaaaaccatcaaggccatcaaaaacaagaagggtcacagaaggtgccatagccatgaagagcctaaggagacatgatgactaaacgtaacgtggcattctggagaggaccctggaacagaaatagacattaactgtaaactaaggaaatctgaataaagtatggactttagttaatatgaatgcaccaatatcggttcatggagtgtagcaaatggactacagtggtatgttaataacagggaactgggaaaggaatatgtgcaagctctagctccccaattttgctgtaaatctaaaatccttttaagatgaaagagtttttaagaatataattttaaaagtaccctttgattattttctctaagcactgatcgttccaccttgtgttgaaaggatttatctttgctttcactggactttcttggcttccttttatcatagccttaaccacaggctacagtataattgttgaaaaggcacccatgcccttgtcatgagtctgtgcctctaaggcattgctgcctacatgtttgagatttctttggccagacatgtctttatacgtctattctaatttgtggttctcagccttccctctgccaagatagctctgcggagtagttctccacctgggcagcacatggaaacaaccgggaaagttttacaaatcctgttgcccaggccccagccagcttcaggtgatccaatgtgcaacccaggtggagaaccactgctgtgtgctcctcccccatggctgtcctctgtgtttctgggacttcctaccagccccactcactccagttctgctttatactcctactttggtaagctaggtgatttttcatttcaaaaacttcagtaaagagttctctcctttatttcttgcaaacagttttatctcacagctactcaagaacagaagggaggcttggcgtggtggcacatgcctgtgatcctagcactttgggaggcagagggagggagattgcttgagcccaggagttccagaccagccgaggtaacatggtgaaaccctgtctatacaaagatgaaaaaaaaaacaaaaacattagcccagtgtggtggcaggcacctatagtctcagctacccaggaggctgaggtgggaggatcacttgagcccaggaggtcaaagctacagtgagctgtgatcgttccactgcactccagcatgagcaacagagtaagaccctgtctcaaaataaaacaaaacctaaaaccaaaaaacagaaggcagagaagagtggccactgtaaaaggttgtttatttccagggataatattaaaaaatgcataacaagcaggacattgaccaatctgaccaccagtgggaggtaaataattggtaaggggcttattggttgaataccagccctgcttattcttcccctacctctatttaaccagagaacttaaaggaggagatatggagagggaaagagaaaattcttcattcttactgtgcctgccatgctgcgagtaatggagacactgaggcacccaagagacaaaactagagttcccatcagctgctcagcccctctcagaactttgagaaggaaacaagatggaagctcctccaccttggattaatttgctcaaggtgttctcctaagattatgacttatactccttggaaatttgtgtaattgatgcctttggaaaatatgtccaagactcacctttcactctgttccggaatgaaggctgaatccagagaagctcaccctgctcccttctccaacgtgacacagaataaagagggtcagagtacaggtcttttattgttttaacctgaaccctggaagccaaagcctgcacaggcttatcttccacaagtatgggtcaatcactttgacctattgactctgcatctggtcaagcactccagaacgccatggacagctataggattccccaatgagcaaatgttgacttaccctgtgggtctcctgacactattataaagtctattccatcagagactaagttgttaaaaaaatgaagaacttggttttagtttattgtctgttgttcaaggagtatttatgcaaaattgcaatattactactccacatgaaccaatcaatatactgccactttcaaaagttaaaagtgggaaaaaagatggtctttgttttagaatgtgctaatatcttattcttttctttcaattttctgttatatgcttaagaagctcttgtactctcccttaattttgctataaaatattctttacattaaatattataacaaagacaaaaattaatttggtctgcataataccttctctctcaacctaagtgtccctcaacagatgattggataaagaaaatgtgatatatatatgtatatatataaatatatgtatatttgactttcaatgtccttgttatgcatacacacacacactcacacaaacaaaccatggagtactactcagccataaaaaagaatgaaatcatgccttttgcagtaacacaggtagaactggaggacattatcctaagtgaaatgactcagaaacagaaagtcaaacactgtgtgttcttacttataaataggagctaaataatgtttacagatgaacatggagtacagaataatagttactggagactctgaaaggtgggagggtcggggggtgagggaagagaaattacttaatgggtacagtgtacattattcaggtgaaggttacagtgaaagcccagacttcatcactacataatatatccatgtaacaaaactacacttgtactttttacatttatacaaattaaaaaaaagatttcaaatgatttttaaatgaattacatatataccctaacttgtttattttctttttccttccaatgtttgaaaaaatgtttttgtataatacaaacacatttccaacattaaatatccttaaaactttaaagttgaagacaaaaatataataacgataagcaaagacaatgtttgatccaaataacacatattacatcttttaaatgaaggtgtttttcattctgatttgtgcaactggtttactaggttttccagtatttctgccgcttgactgtatctgctgactaaagttaattctgttaatggttattatcctataggttttttttttttgtagtttctaaattggtttaatttggagaaagaacatttgctgtagataaaataacaatgaaagaacatattttagtaaaacttacgtacatgccactctatgttataataaatgtttcatctgattttcagattgttgtaatcttttcactatcacttgttcatgagtttatgcaaagcagtaatactttgataaatgattctttacacactcgaaaattttttgtgccttcggagtgtttatcataatgaaacttttaaataactattttattaaaggcgaattcaactgaagaatagttttgcttatgttgagttgcattttgcaatattgtcatgataatgacttgatgaggctttgcttttctgattattttgaattagaaaatatttgcttatgttttcaaaaagttttaaactgcccctgaatcactctcttttaataaagtttttaaaagctgtttttattaaagtatggtccatacagaaaatgcacaaatcgtaagagtacagctcagtgaattataacaaattgaatgccccaatgaacaaccatgaaggtcaaggtaaaaaatattaccagcacacccaaatttctcatcgtgcccattccaatgactacattctctttcctcaaaacttcccctcttctgaaaaaacaaaacaaaacaacaacaacaaaaacccacaactgtcctgacttgtaacactttagttttttctgtctgtattttatatgaatggaatcatactatataatctctttcatgcctgacttcttcactggacctaatgtttgtaaaatgcatttgtatcacgagtgtaggtaattgcatttattatctttattttaatttcattgtatgactgtaccacaagtaagctatctattctactattgatagacgttttggttattttcaggttggggcttgtgatggttaattttatgtgtcaacttgactgagctatagagtacccagatattttgttaaacactattctgggcattcctggatgagatttacattgcatcattaggctgagtaaagcagattgccctccctaatgtgggtggccctcatgtaatcagttgaaggcctgaatagaaaaaaaaggctgatcctcccctggctaagtgataattcctcctgcctactggtcttcaaattgagaggttggctttttcctgcctttggacttgaactgaaacatcgactcttcctgggtcttgagcctgccaaccttttaagtggaactgcaccattggctctctgggtctcaggccttcagactcagactggaacttgcaccattggctctcctgagtctccagcttgcctagggcggatttaggacttgtcagcctccataattgcatgagccaatttcttataataaaactccttctatatatacaaatcctattggttctatttctctggggaactctgactaattcagggctcttattaataatagtactgtgagcatttttttttttttccagacagagtctcactttgttgcataggctggagtacaatggtgtgaccttggctcactgcaacctccgcttcccgggttcaagcaatcctcccacctcagcctcctgagtagctgggactacaggagcatgccagcacacctggctaatttttatatttttagcagaaatggtttttcaccaggttggccaggttggtctcagactcctgacctcagatgatccacccaacttggcctcccagagtgctgggattacaggtgtgagccaccacgtccagccctgtgagcatttttgaacctgtcttttggtgtatttgaggcatttttcttagctatatatctaggaggggaatatctaggttaaaaggtaagcataagtttgactttaatagatactaacagttttccaaagtggttacaccagctcttttaccatctccaccttgctcaccaggagagtacgagcgtcttccttgctccacattcagaccagctttgtgttggtttggtttgtcagtctttcaagttttatccattctgtgaggtgtgtacaggtattgcattttgagtttaatttgcatttgtctggtgactaatgaggttgagacatttgtctatctcctgtgaagtgtctgttcaaatctcattttctgttggattatctttacctcgatatgtataataaattttaaaaaccacttatgatttcctcttctctaaattttttaaattcttcacttgttaaaggtagtgtttttgtctactcattatcaaagatgaaaattttatctcacctatctctagaattctcttcctctacctcaaaatttgtgttagttataattattccagattttgtcttaaaattttaagtaatacacttaaacttttgctttgtgatcaaatatagagtctgttgattcttcactataaaaaataagtcacctagaaaagtccttggcacatagcagggcttcagcaaatacttgctgaagagaggaagataaaggataagagagtagaaaggaggagtacatccatatttttctcccccgttcctatgcatttatgtcagtaatataattttgtttatattttgaaggtttgtaaaatttacattttgatctatattatggtttccttccatgttttatctataggctggtttaaaaaattcaaactaatgaacagtatatgatcatgtgatcacagtgacatattgtatcccccaaaatggctacagcagtattttcagtcccacatgagcttccaaagccttgccactctcccatcaagagctggaatctatctccccttcctttgagcctcggtgggtttcagctgactacctggcttaataaagtccagtgccagtgatgctttgtgacttagtccagatataacaggcaacatagcttcagcctgattctttcttggagagctgagccatgtctggctacactgaagctgcatgctggaaagcccacatggtcatagagagatgccaaagaattcccagctgtcccagccctcagctgtccacctctcttcttcttcccagtacgggcactagacatgtgcacacagaagccttcaagatgactctaggaccagcctccattgaactgcaacctcacaagaaactttgagccagaaccatcacccagttgagctactcccaaatttcttgcccacagaaaccatgagagagagtaaatgatttttgccttaagccattaagttctgaggcaatgtgttaggtagcagtagataactagaacaatcacttactgtaaaaccagttagcatggttgaacccatagaggaaaatgaatattgttctattttattaaacttgtgccactcacagaaaaatattttaaacatcaaaatcaaattaatgctctcttcttactctactcaaaactatgccacattttcatttatttcatatccgaaaacaattgctttgtacagcttaaaaaattttttttttcagtttttatctggctttctttttctttgtaaacaggaaagatagttgctttatattttgtattagattctaccttcttcttgaaggcattcttcacagagttctctgacctgttcatactgactgctacatagctgctatcaaactgggatttcatttcagtactctctagattagcacctagtatttttgggtctctttcttggattcctttgttctattagaacatacactaagggctgggcttggtggctcatgcctgtaatctcagcaccttgggaggctgaggctggaggatttcttgaggccaggagtttgagaccagcctgggcaacatagcaagaccctgtctgtaaaaaaataaaataaaattcgctgggcatagtggtgcacacttgtcctagctactcaggaggctgaggtgagaggatcacttgtgcccaaaaattggaggctgcagggagccatcattgcaccagtgcactccagcctgagcaacagagcaagaccttatttctaaaaataattttttaaatttaaaaataaaaataaataaaaaataacactaatttttaaggatgcatgaatcataaagtttctgaatcattgcatatcttgtaatcttctcaattttgccctcacttttcattgcttagcctccaatcatctagtccccagtcattctccctcaatattttaaagacatgactacactgtctactagctttcagtgttgcaggacaaggtctattgtctatcttatatttgttctttggaggtaatttatttttctctctgaaaaactctgggattttctctttagccttagtgttctaaaatttatacagacatgtctaagtatgggcgactgtcattttattcaaatgcttgacatttgttgggctttttcaatctgaagacctgagtcttttttcagagcaaagcaattttctttattgtgtcttggattacattctcccttgcattgcttctagaactcccttaagataaacactgggcctctgtctattttcactgacgtaatttttcttttatatttttttgcctttttctttttatatctggccttctgggaaatgccttttatcaaccatgtccctaatttggtcttcagctttcattctatttagatttatcattgattttaaaaagaatttgaccatcattttaaatttgcaataaatttttcttgttctctaattgatcccctttgccttcaaagcagccagtgcttgttttatagatgcaatagcctctcaaatctctctgaggataaacatcagtttaatcttattgttttttctgtttcttcagaaatgatcggtgttcagctccatatttctcttgcctctcattcatcaaatgcctggagatcctttctcaatcgttcatatgtataattgaagaattctgttgattacataggtcatataagatgtattgcatgaagagctgtgtttatttgaaaggccattttctgaatgggaaggctgatcatgattctgtgtaagtggatggctctgccacagtcaagctttatctagccagcaagttcagtgctattacaattgcccaaaggggaaggactttatctatatgcagggtggaactacactttggactggagctgggtttctgtttattgtagaggctctaaagcctttcaggctggacaatacttctgtcgccactcaagccccaagtccctcctatagagagtctactttctacagaatatactcattggtgctccagctgtgggtaaatagcttctctatacatggagtggggagggtgggcctggctggcccagctgttctgtggtttatctcttctgtggttacctaccctgatcactgctccaggtccatgtttgttcttttttactcattggctccaagcttcgagcctctctaggcaaggactatgagtgaagccacctcacttgcatgttgatggcttgtatatcactctgctttgttatatcgatatggatcatatgctttctgactcccggaaatttatccaagttattaaaatttctgctcatgacactctgtttcagcattctaatagacttattcatcctttagatatctttattctcatttcaataggatcttggaagaaagagtaggcaaatatgcatgctctgtgtgccttgttgagctgggatagtccaaaaaagtcctcaatttttaaattacctaaaaatattttatttaggcaataaagcatttctacatttccctaaatcagagaagacagaattatgttactgtttctaatggaaaaattgtggattcaaaaatcagaagaatcatcttgtccactattgatatggtttggacttgtgtccccatccaaatctcatgtcgaattgtaattccccaatgttgcaggaggggcccggtgggaggtgattggatcagggaggtggatttctcccttgctgttctcatgatagtgagtgagttcttacaaaatctggttgtttaaaagtgtgtggcacctccctctttgctctcttcctcctgcttcagacatgtaggatgtgcctgcttcccttttgtcttccatcatgattgtaaggttcctgaggcctccccagccatacttcctgtacagcctacagaactgtgagtcagttaaaccccttttttttccttgataaattaaccagtctcaggtagttctttacagcaatgagagaacgaactattacaaaaatcatctttctaacaattagagtagcatagttatttaaggcttggtctttgagtcagacaacctagaatagattcttggttactttacttactagctaggtgacaatgggcaattacttgaactctcttggcctcagttttctcatatgtaaaatagagattatgataccttccttgcagggtgttataaagatcagagtactcaacagagtacctggcatgaaataatctaatagtagcagtagcagcagctgctgcaatactagcactatcatcccagttatgagacattctccctgtaattattctaccttctccttgatattattgttctaattcaccagagctataagacctttatgggtttcagttttgtttggatgaccttcaatcccagcctctgctttaatttccagattgcagaaagtatggcaaagataaaggagtacaaattaaatacagatgatggaacagcataaatataataataatgcccagtgttaaacagcaaagattttccagcatttttctcacttgttcttgcaaaatattatgatgtatgtagtttaggtatttactggacatttatccaataaacttttttgagcaagttaactttctgggcacctgttgttgtaggggagagcaattgttttcccaattaacacaggatttttaaaagacacatttaaatcaaatatatttctgacaatacaggggcccatgttctaaatgatagagatactcagttttaagagctggcaggtgtgccttggaaaccggagagttgaaaagcactgccctaagctaagagtttcttttcaacaatctctttcttttaaaaatggggcagtccaacacagaatttcgatatataaaatagacaaaggaggggctgctctggttgaaaagggggtttggggacctggaatctgcccactgggtatcccctttcccttcagcagctgccagtgggaaggctgcagaaccacatctttatccctctagagcagtgatccccaagccccggccatggaccagaaccgggcctcacagcaggaggtgagtggcacacgggtgggcattactccctgagctctgcctcctctcagatcagcggcggcattagattctcataggagtgcaaaccctattgtgaactctgcatccaagggatctaggctgtgctctccttatgagaatctaactaataatggcttatgatcataggtggaacagtttcatccccaaaccaccccccatatggaaaaattgtcttccatgaaactggcccctagggacaaaaaagttggggaccactgctctagagttctgaggagcagcatttgaaaaccattgatctgacttattccaaggacgagttctccagtttccatcaaaaagctactagatttaagtgtcttctttatgtgccagacgaatgtctacaatagttttcttttttttttgagacggagtctcatcctgtggccaggctggagtgcagtggcacgatctcggttcaccgcaatctttgtctaccgggttcaagcgattctcttgcctcagcctcctgagtagctgggactataggcatgcgccaccacacctggctaatttttgtatttttagtagagatggggcttcaccatgttggccaggacggtcttgatctcctgacctcgtgatccgcctgccctggcctctcaaagtgctgggattacaggtgtgagccactgtacccggccctacaatagctttaatcttcctaattaccactcctggaagacattactattctgtttagtataatgtaaagaaatcatagttcaaagaggtgggtatcttacccaaagttccacagctcataaacagaggattgggcttttcactcacatatgtctgactccaaattctttgtctttctattgcctcaaaatgaatgagaaaatctctaagctcctttctggcaatacagttctacaatttcaaagtactttttaaagagaggactataaagcattgatcaaaacatacacacttccagacgcagcagctcatgcctgtaatcccagcactttgggaggctgaggtgggaggatcacctgaggtcaggagtacaagaccagcctggccaacatggtgaaaccccatctctactaaaaatacaaaagctagcgggcgtagtggcaggtgctggtaatcccagctactcatggggctgaggcagggagaattgcttgaacctgggagacagagagttacagtgagccgagatcatactattgcactccagcctgggtgacagagtgagactccatctcaaaaacaaaacaaaacaaaacaaaaaccatacacactgagccaaaactgagatagagaagggaatctactaacaaaaaaaaaaaaaaaaaaaaaagagagattgagaaagaaaatttgagtgcagccagggatggcttttgactagtccattttctaaaatcattggctctttctaaatttattgtagagagaaatatttttttagatgcttccctcccaggtagttttgcttggttccatcattctcaatagaaaccctggttacttactctgctgttcatggccattggggtcctgtttagtttgtgatgatctccttctagacctgttctgtcagtgattctgttgctgaatttcctggtctctcactacgtgcatcgtactgcactaagtgccagaggcagaatccccgcccttaaggcaggtatacacaggttagaacaagagagacatatttgggaagataacaaggaagtcatactgcacatgtcagtgagaatcacagaaaagagtattctcgaatgcagatgtgggagtggtcactgtgctcttgtccagttaggaaaggctttggggaggaagaagagcttgaactgaggctccaggatagatggaacttcaagtaagagaggagaggtgaggttaattccagatagagaaacaggcaatgggtagaatgatttggctggagaagagggcttacgtctgccagcaccgttatctattagcaataccgaagactctttctgtccaccccacttcaccacaggaaaataggcccagtaaaagcaacttattccatatgagctaatcctgagtctgaaaaaataaaaatagtgtctcatcaaaagggagaagatatcacttctacatatgtcttcccttgtgtcagcaccttggggcaggaattctgtagatctaaatccttatgaaataaaactctgggtcaggattgtattagttttctggggtggtcatagcaaagtaccacaaactgggtggcttaaaacaacagacatttattctctcacagtctggagtctagatgtctgaaatcagggtgttggcagggccacactccctctgtcaccggcaggggagaatccttccttgtgtcctctggctctggtgtcttactggcagaccttggcattccttgtctttgcatctacagcactccaattgctgcctttgtggacccatggctgtcctctccctgtgtgtctctctccacttcttcttttttttttttttttttttgagacagagtcttgctctatcacccaggctggagtacagtggtgtaatcttggctcactgcaacctccgcctcctgggttcaagcgattctcatgtctcagcctcctgagtagctgggattacagacatgaaccaccatgcctggctaattttttttttttttggagagacggggttttgccatgttgcccaggctggtcttgaactcctgagctcagtcgatccacctgcctcggcctcccaaagtgctaggattacaggcgtgaaccaccgcgcccagccagtctctctccacttcttacaataacaccagtcccattggattaggagtctaccctgctccaggatggacccagctagttacgtctgcaatgaccctgcttccaaatgaggtcacgttctgaggtacagagcattaggacttcaacgcatcttttgtagggtgatatagtttgagtatttgtcacctccaaatctcatgttaacatgtgatctgcattgttgaaggtcagcccagtgggaggcatttgggtgatgaaggtagatccctcatgaatgatttggtgccgttcttgcagcaatgcgtgagttctcactctgttagttcatgtgagagtgggatgtttaaaggagcacagctcctctctctcgctccctctttcatcatgtgacatgcctgcttctcctttaccttgtgccacaagtgtaagcttcctgaggcctcaccagaagcaaatgaggcaccatgcttcctgtacagtctgcagaaccgttagccaaataataccttttctttataagttacccagcctcaggtgtttctttatagcaactcaaaatggactaatacagggggatgctagtcaacccatcacaggaataaataggatgattacaggacctgaggaggagggttttggctggggaggagagggcagtgagattttgaagaccagttagcatctaccttagagactggtcttctggatgccccctcttgcccctatgaacttctgtttgacctcttgaagagtgtttttcaagtgaaactatgaatgatttcctcacaaatttctgtgaaactttggggtcatgagtcaatgaatgaagcataaaagctgggagaaagagaggaagggagaagggagagaagaggagagaagcaactttcaagaagctaggagcgcttgtttggaggatactcaagagtgtcactagtaggactctgtggccacagagcaagatggagactttaggcagactccaatcccatatcacttgaagcctcataagatctggcccaggaaattgggaagaagctggaaagagtacacaattcaattcataagaaggagaatatttgaaaaaatttcactttcacttggagtaagagtaacagacttctgccacaatactagatgacattttctgaagctgggtcaacttgaatccaaagggaaagaagcaaaatcagtcctgacagaacgatgccttattatcagggtgttcatcaaaagagcttagtaagaaaattatcctgaacatctgcagatatgcgtcctggtcaaaaatttctagtggataaaaaacatgaactcacttaaggcatacaataatagtttttagaaatattagagggtctttgtgggaaggtcccataattgctatgcagaaatgagcctgtgaaagacaacctgtatgtctcagcccctgggcactgagctcctcaagcatctctgctttgcctgccatggtatttggagcatgataggtccttattgcttgtcaaatacatgaactctaacttcaataaaaataaagcagagtgtatgcagaaaggcaacaaaataagaaaaattagtttactaattttttactcagcagaaaatgctatgcctggtgcttcatccacaaacatagatagttattggattatctatgtggatgaagatagatattggatagatattggattatctatgtggatattggataatccaatatctatgtggatattggataatccagtatctatgtggatattggataatccagtatctatgtggatattggataatccagtatctatgtggatattggataatccagtatctatgtggatattggataatccagtatctatgtggatattggataatccagtatctatgtggatattggataatccagtatctatgtggatattggataatccagtatctatgtggatattggataatccagtatctatgtggatattggataatccagtatctatgtggatattggattatccagtatctatgtggatattggataatccagtatctatgtggatattggataatccagtatctatgtggatattggataatccagtatctatgtggatattggataatccagtatctatgtggatattggattatccagtatctatgtggatattggattatccagtatctatgtggatattggataatccagtatctatgtggatattggatccaatacgtggatccaatacgtggatccaatatgtggatccaatacgtggatccaatatgtggatattggatccacatagatattggatccagtatgtggatattggatccacatagatattggatatccaatatctatgtggatattggattatctatgtggatgaagactggtgctattgaccttacattaataataattattgaccttacattaagaatgtcataagaatgaataggaagacaaatagaacaaaattaaaagtccacaaagtgacacaagaacacctttgcacaataaagatgatatctcaaataactggggaaagttagacttcttaacaaaatgtattgggacaactaaaaagtcatttggaaaaatataaaattgtatccaaacttcacataataccaagaaaaaccccaaatggattagcagtcttgatgtacaattgaacttgttcatttttccaagaaaacttgggtgaatttccaacctagcagttggaaagcctttctgtgactcagtattcagaagaaataaataaataaatcaatatacctgtccaagtataaataaaacctttttttgtgacaaaatagaccacaagcagagtcaaaagagaaatgaaagactgggagaaatttttgaacttatatcagtaaggactaagctccctaatggttgaagcactctaaaaaaatcaagaagaacaacaaaactaattaaaaaatacgggcaaaatgcatgaatagagaattcacaggataaaaaaggaaatggcttttaaacatgaaaaaaataatcaaccaggcttacaagagagattcagactaaaatatactgagatattattcacctacagattggtgaatactccaagagttgaacaatgcgttctgctggctggacttggagcctctggcacttcacgcattgcaggtgggagagcaaaatgctgcaacctctgtggaggggaatttagcaacaattaccagaattacatacatatttatcctttgatgcagcttctaggaagccccctaaaatacatctctgccagtacaaaacaagtttgctcgactccattaattgcagaattatttgaaatagcaaaggattggaaatacaaatgcctatcagtgaggcataagcaaatactaaggcactagtacacaatggagtcctcagccacatgaaaagaatgaggaagagttgggtaaacagagtgttctccaggatacaccgctaagtggaaaaaggtgggaaacagtgatacggtgtgctgtatttgcatatgaaagcagagaaaataagcatgtaaatatgcacatataaatatattacttatgcatgcatatatgaatatgtttctatgtatatgttgtggttcttttgtagaaagaaacactggaagaataaaccagaaactgtagtcacctataacagatgtgggagatgtggggctgaggtaataggaacaaaagtgagacatctctgagaaaacttttttatatagttttgattttgaaccacaaaaatgtactataccttaaaaaaataatgaagcataaaagaagaagaaaatgaccatgctaactagatctttagacaaccatcagaaatcagggagatttctgagtcaaacttttctccaaaaacttattaccaccacccaacccctgtggcacccagcaaattctggaaagattgataaaaatggagaatgagagctaagcctgggtgcccaacgacaggctcacagccagctctggggatcgcctgagaagcaggatggtaaagattgcaggctccagagacaggcagacttgggttaaactggccactcacctccctgagaggtgagcttaagaaagcaactagacctctctgggcctgtttcctcctctgtaaaggagcacagtaacaccttccatgctaggtactataaagctgaaatgaaatagtacatagtctagtacctggcctgtggaaaattagtctcatccaaccttgttgtagaaggacctaccaattccaggaacaagaggtgaccatgtcaggtgacctagacttcgggaaggagaggggctcaggcaggaagcacacttttctttgtggcgtatctagctctttaggttctcctagacttgagggcagtagaaacagagaggtcccagagagggcatggacgggcatttccaaggggtgtgctgtgcagtgggccccacaaacatttgcctaggacccagaatttaaaccactgtctgcttccttttccttttcagtatggtttcccttcttctccagaattctctagaaactgcggtgaaggaatttaaattactttgttttctttttatttttgtcaaagaaaaatgattccatgaagaaatgagctttgaaaaatgcctgcaggagattgttaaatatttgagctcagtgtggctgttattggggaccagaactggaattatttttttcattaatgtaattttgtctccggaagaagcagagacacagaggcacctctgggttcctgagactgtcaaagatgtctgcaattgaagtacaacaaggaatgggcggggacacggcaggaagcaagaggtagcccttgggtctgggttccaaactcacttccaatagatactgatctgggtgtgtgacactttatttctaagtctgactgattaaggtgaaaaaataacaaaactataatgtttaggtaaaccagtcttaaaatcatattcattcattcattcattctatttgttatataaacatatattgagtacctgttacaccagcatgcattctagctggggaaggtagagcccacgagacctgattaagatagctgctgtggttgagaggagaactaaaacaaaaatcaggatgggttcttgggtttggaaggaatcttagaggtcatctcacattacccttcatgttgcagatcaagaaactgggacccagggcagtcccacccaaaaccatccagttaattaagggcagaatctcctaactccaagtccagcacaatcttcatcacaagctgctggttcagagaacaactagcaagtgcatgaaagagagaaaaaagcctagaaaatatttagttggtaaaatatttatttatttatttatttatttggtgagttgatgacttaattttcctcctcaaaattctggaagagaattcctggagggcgggtgctgggcaggtagggaaaatgtatttaattaatcgtttcataattcactcacaattatgggcttcttgggataacatccattaagatcctgaaggaaggcttcgctgtgctgatggaggatgagtcaccttactatcttacatactggtttgctcttcaaaatatgtgcctttgaataaaagggcctcgctatcgcggctgaacttggattcactttgtctctatggcaaccacagcaaatccccacaagtcacaggaaaagggcacttgacatcttgaagcacaacagacagaccctttatatcacagccattcctctcactgctagaaggtagaataaagggagaagccaccatcaaacacgcattccagagctgcagaatcaaaacctttctgcacccagcctgattgtttaagctgttgctgagttcaagagtcattcatgaatatcgctacttaacaagtgacaacttcaacttgctctctgatagtctcctcaactaccctgaccccaaacacttgcagagttggacctagttataatttacatatatgagaaattgatttggctgcataagacagacgagctaaatgaacagtggctgaaacctacaaggttgtattccttcacacagaaagtcgagaggaaggcagcccagtgcacctatggctttcaacaaagcctttaaaaaaacaagaatccttccaggaaacgactccactctcttcctcatggtcccaaagccatcacagcctcatttcaggtagagagaagggagggatgatgaagaaggagcaatgtgtgtatgctctcttttaaagaggttttactgaagttgccatacagctcattgacgagtacttaaattactttgttatacatggtttcggaagaggtagagaaatacagtttttattcctgatagtcttgtggttctttaaaaagcaggggttctattgtaaggatggaaggatggaaggggtcatagatacatagatacttaggtagcccacagtcctagtacccttgaagacctgaactaaccccttgatgcctcttggttcaaactatagctcaattttggctcccagctctagtccataagcccattggttgaaatggtcttgttgtaattatgggccaatgatcctaaggttgcaatatttgtggaggtgttaccccttggtgtagaagaagttatataatgaagttatcaggcagagggatatggaggcctctatggcctggcttggtgctggctggaccttgtggggggacatgttccctggaggatgtgggctcctgagctcagcattttgaagagaagcatggtcaggctggggaataactggacataatatgaagcagagagatgtcatctccacccttgtggacacaatgactgctaaaagtccaagcttgggtgcaagctatggggtggagggaggctgagaaagctggagccagcacctgggggcctcagcagccacagagcctcaggtgcatgagaggttggattcaggcatagcgttttctgctgagttatttatgggaaaacctcacttgtctctttccaggattatagagggtcatattttcagggagcctggacttattgcttcaatgaaggaaggccataacagaacaatttagattcagaatatcactttttcacttctgaggttcaaaagaaactttcaaactcccagaagatataatgagttgtcagaaagggattttgtgtctgaaggcctggctcttgggtattaaaagcaaatatttctgccataagtgacagatttggggaaaatccttgattataaggatgtaagagccaatttgtctcagcccataagttttgagtctatctggggacaggaagaagagtcagggaagagaacaacagagaaacacagtgatggggatctgtattctgctgcctcagtctcagtctggaaggaaaggtgtcagggaagccccagactggttggggattttgtgctctgaatttcccttggggctctgagtggaactaagaacacctaatgtctcctgctccactgtgacataggcaaagaaagaagagatgacagcatgggagatgggtttgaggtggtgttacatgaaccctatgcaaaccaccaattgtgctgatggagatcagaatatgccacccgaaaatatgccatgttggcataaggattatttcgagttgaaggaaaatggaaaatggcagatgcaggaaaagctctctacccttcccctttctgcctaaaagcagagcataaatttccctctgtcaaggtgttgccactctcctctcccataaagaaagagaactcttatcacaggggatggtgccagctcaaatctgcataaacaaaccttactgaaataacccggatcttccatttgtttcctctcatatgtttgccttcccacaatttgtcaccctgaagccctagacctctccctttgtcttgtcacttctccacaaatgtactgctctttgttaaaatggtctataagctctgaggcctcacagcttctttgggttttcactttcttttctgtgagagtgctatgaacacataacaaaaattaaaatactaatgtcaaattaaatatgtatgcttttttttctgttgatctgtcttttgccagtttaatttgcagggccccagtcactgaacataagagggtaaaggaaacaggtttcccctcccctataggaacaagggcagcagttgttttctcaaaggtcctagagattggtaaaagcaagaggttgagtgacagagtgtgtgagcacagtgcagcggggcaaagggacacatcacagtcagcaaatgtgggtagactagcacacgatggcatttacacaagcccacactgccttgatttttcatcaacttctcagaatttagatggtaccctgaggagtgggaggaacaatttctgaatggacagaatttaaagctaaaagggccaagaatactgaattaatcagatcgagtcatttctgccatcagaaaacatacaggctcaagacaaacactcaattcaggacaaaacaaagaatgccccatatttggtactcctgagttaagagcacgagaaatttgaatttgctacagaattgtatatcatctagcttattaaaaaacactgggctttacatctatctgaatgaaacagtaaaaggaagatgctattatttctgacagggtcaaacactattcaatcaggtattattcatatttacaaataaacaattgcataaaaacctaatgaaacaaggatcctctaaggaggaaatagttgacttatcaaggactgcccaagaggagaggtccttcactgctagaccttcactatcttccagcaaaccctaaaatctcaggggttgttctccaagacaggttctgctctgcttcttctctgctcagcagctcccagaagctcccacaattttattctgcctcgcccttcatgacattctctggggaagctgggtgccattgctctaggataattacgcgcaaagtactggatggagagtcttagcagtggtgctcttgcatgtgtgttttatcacctcctcccttcattgaatttcattctttagccatgaaaaagaagctatctgtgaatgccttcagtggacatgaccagatggtctcccctgggtctgttaggttcctgtctctggtcacttcattgggaatgattcccttctggctgtcaagtttgggctcattatatcacctctcttaacttcgactttctcatgcatataacttggatattcactttccacacagaaatgtttaggagtcaatatcaatctctttgcctggcacatagtgggtgctcattagtgtttcttccctttctttttttttgaaacagggtctcactctgtcacctaggctggagtgcagtggcatgatcatagctcactgtagccttgaactcttggcctcaagtgatcctcctgcctcagcctcctgagtagctagaatgacaagtagtcacctccttatgatttccagatttctgtgtgtttgtctacatcttcttttttatttttcgtagagacagcatcttactatgttgcccaggctggtcttgaactcctaggctcaagcgatcctccctcctcagcctcccaaagtgctgggattataggagtgagctgctgcatccaggttcttccctttcttgataccttttctggagtgaagaatgtctgagcatttcttcacacccagcttgtattggaatgtttgaatagaatttgctgaacgtcttctgtaaccagtgccacattttgaggccatctacaaaaccgtgtactcatacttcactctttatttttaacagatctgaacatctatttagtaggaatactgggaaaacttgattttctcaaagggaaaagtgattttgtcagttggataagtgtgtccaaacaataggaaatctacctgacatacatgagcccactctttctatggtaagtatttaattatgttagacaaagacctgagaactgttgctaagttcccagtggatgctaaaaataggtaggatactgtggtttccttatctgaacaggggcgaggagactttaaaaatgtctagttaagggccattcatagtcaatcaaggtttatttaaataaatagcaattaaatgtagagcatttatacaaaaatagaggaaaaatagaaatcatgttctatattggctattaagataaacaacagaacataaaactctactaaacaaatacagtgaaaaataaaaccatatactgcaaaattttgattactggagctctttagaaaggagctgatcattgacttttctgtatggctcagggtttatatctttaagaagtgatttttttaaagacttcgaatggaaagctctctaaaatggaccccatgcttccaagcattcttaaacatagtatgaagaacacaatctaacctcttcctgatatggttcggatgtgcgctcctccaaatctcatcttgaaatgtgacctccaatgtgagagatgggcctagtgagaggtgtctgagtgaaaggggaagatctctcatgaatagcttggtgctgtccttacaataatgagtgagctgtcacgctattaattcatgccagagccggctgtttaaaagagcctgggacctcctcccctgtctcttgctccctctcttgccatgtgacatgctggctccccttcaccttccaccaggactaccttcccgaagccttcatcagaagcgcagcaagatactggtgccatgtttgtagagcctgcagaactgtgtgctgaataaacctctttcctttataaattatccagtctctggtattcctttatagcaatgcaaaacagactaccacagggtctcaattaattcatattaatctctattattctagagtcctgtgttaatacaacaatgtcctcaatatcagcttaagtgcatagagctgtttgtctccatttcttttcttttctctttttttggagacagggtctcactcagttgtctaatctggagtgcaatggtgtgatcatagcttactacagcctccacctcctgggctcaagcaatcctcctgcctcagcccctcaagtggctgggaccacaggtgcttgcctcttttttagtcccagatttctgcgtgtttgtctgcatcttctctctttgcctggctgtgacttctccctgcagccatatgtctacctttcataccccttatctctgttagtgattggaaagttgggtccaagtttgtgaaaattttttatttgttaactaaaaatatattcattctggtgaacatctgacagtttaagaggaatggatatgagcctttttattttttatttttcgctctgcctgttccagattatatcttattatcaattgatgtataatgcaataaaagctttttataaaccataaagcattaatacagctataaagtagtgtgagtatctttactgatttttgtgcaacctgcatttcccagctagccagccatgcccaccccttctaggccctgaactgaaggcacttatccacctactggttatctttattaagtgactgggcaaatagattgagatggtgccagtagtgtagaaatagattgtaccaggatcttggattttatgttcaggagtcacagttggctcatttttgcaacaagttcgactgagcatcctggccactatgctattccaggccccaggcttgctggaagcattggggcgggtgtccaggtggaactctgtaatttccctggaggctggtggggcctggggcacctggaaccctcagggcagtctcctcctgctgagagcagccttagtggtttatctcagtttgctgtacagatttcatgcgctgtgtatgtcatggtgtgaaaaatgctgagaaggccggatgttaggtggttatactgagttgcaagttgttgcattgaaggttatggatggcgtgtcctctaccctgcttggcaggctttgctgcaaatgcattttttgtccttgtcacagtaaacagagacatctatatttgagagttcactctcattaagctactgatttagttctctgtgagacaaccaggctggtcctaatatatgaaagtgttttaatagttaaattcattcaggctgggcatagtggttaatgcctgtaatcccagcactttgggagatggaggtgggcaaatcacctgaggtcaggagttcaagactagcctggccaacatggtgaaaccctgtctttactaaaaatacaaaaattagccaggcgtggtggcgcatgcctgtaatcccagctactcgagatgctgaggcaagaggtaggctgaggcaggagcctgagcttgagcccaggaggcggaggctgcagttagccaagatcgccccactgcactccagcctgggtgacagagagactctgtctcaaaaaaaaaaaaaaaagttaaattcattcattggacacgtatttcttgagcacagacaatgtaataaactctggagacacaggttgaataacataagactcttcctccagtgggcttgggagggagatggctgggtacacaaacagtcaccatctgatgtgatgaaagccccgcacaattctgaccttcataaggggacacttaccctgccctttctctcctgttccaaacacgacatgaacatagcatgacaagattctcaatctcgctaaacacctcatggtatgtttgacctcctatgtcatagttctttgtgatataacagcttattgcatgattgaagactcatgggttcattacattgcttatcctcctatcctatctgcagcctctagtccaaggctcccaagggccccacgatatctgatgcatcttagcacagagcaagctaatgccgactcatgccacatccccgttacacacaagaggtcagagaggaagcagggcagagcagttttcctctgagccagacctcagaggtggccgtggtatttttgttttcccttccaccaaacaaaaggtttgttacacctacaaactttccactgtaaatgaggttgagacttcattgagaaagatctggaatggaacagattaggtttttaaaaccgaattaagcttgaaacaaaagttgagtcaactatgatgataataacatttgacctacaagaatgaaaggaaactacacaagtaaacaaagccacatttaatgatggaggcctatttgctttgttttgaaaatacaggattattttgagcttcaaaaggaaatgtgcttacgcacaatttgaaggttgtagtttccgtctcaaagaaaaatgattggagatttcacttgggtaaaatttaagagagctttgtcctttgagcacctaaaatcttcagagttaagttgtgatttgtcttttttgtctgataatgactacaactaatgttaactgagcatttgccaaggactatgccaatgaattatctcttactaatcagaaacacagcacagtagtggtgagccaaattttatgttgcttttgttgtatgataaaagattcaagagatataaaagaaagaaaaataaggttatctctgaatacagcatgtggcattgctgttctactggtaattatgtgaagggcaagatcacttttgagaacatgctcgttactcctccaagaccacatttagagtccgcatgatccaaggacagcagctgtgtttgttatcaattcagattctactttgtactttgtggaacccaataatgtaccagcaagaaactcgagtctcctatgttgagaaaaatgtgactttggctgtaaggaggtttcaagaggcaaagatttttagtctccctgaacaaaattttgtgttttgtttttttttccaggagaggttcatatcaatgcttggaatatctgaagtacaggcattctggaattaatgaatataccacccattcaagcaagtcagggagttgtgttgcaaatgggaaggcttctcatgggcctggagaccagaaggcaattgcagaccccttcctcttcccagggcagccagctcaccaagcttctgtcacactggcctctttctgttcgtccaacacatgactcatcttttgcattggggcctttgtatctatgtacattctgcctggaaggctccttgaactctgctctttttttttcttagctcaaaaatcaagattttttttcccctgactgtcttatctaaagtagactttctcaagttagggcgtctattctagtctacaattgtatgttattgcaggtcattattatctggctcccttcacctccatgtaagatccatgacagcaggccctgtgtccctcttgttcaccagtggggtccacttgacatatagttgttgctcaatgcacgtgtgtgtgtatgtatgtgtgtgtgtgtgtatatatacacacacacatatacatacatattatattttatatatacatatatatatatatatatatatttagagacagcgtctcactctgctgccctggctggagtgaagtggcatgatcatagctcactgcagccttgacctcctgggctcgacaaatcctcttgcctcagcctcctgaatagctgagactacagatgtgcactgccacacctggcttattataattattattattatttatttgtagagacagggtctcgctgtgatgcccaggctagtcttgaactccaggcctcaagggatcctcccaactcagcctcccaaagtactgggattatagacatgagccattgcactggctcaatgcatatttattaagtgaatgaatgaatgagaagtgaattcatgaataaatgaataatatgaatttagctatattagcaaaatgggatattacaggacagcacacaaaccttattactgttgtttctctgaaaaatatgccccctgagaatgcaacttgtgaatgggcaagagactacataaaagggttaaaaagggctagggcatcaaaagtagaaataacaatatacagacatgaaatttgcctctgaagaagcataaaggaaatctgcttgccttgaataatctttaagtctgaaaacacttcatctatcaaaatcctgtcacgtgtcactagttcccactcccaataacacttttcttgagaagatagaaatgtgcacccacattcttgactgcatcacgcttcctgcaaacattgcgggtggagagacgggagaaaaagcatcagggaagtgttgaaataactcatattagtgacccctaattccacagtcagttttaagtgggcaactctgtcttcagaagccttaggcttttgaatctgtagaaatctgcagctcacaatgtaagctgttggctaccaggaaatgaagggatgaaatactaatttgatgagtagaggagggaggatgtttgctcatagagttgtctgcaggttgtgagagagtgccagaatttgggcttctggaggagggagagaagattggagcagtctgaaagagaaaaacaaagtcctctggtcctgagaccttccgccagggattgagaggctggggtagaggttaggggctggagggagaagtgagagctgcagtttggggaagttctgggatcttctgcttctatccctgcacacagcaagccattgggattttccaaagcttcaggatagatgagacagtgcggcccagagtctgaagtggcctcagctatgtaggcagaaatatgttggtgatgcctgaaggttcttgtgtgagcatgagagtaagctggcagctaattccctgccactgagcctgctccttcttgtcttagggttacagtcttgggttacggtgtcactgacataatctccaaagatctgatcatgtcttctaatgtgtcctaagaaccacttgagaggtaccaagtcctgtagagattcagaggaggaaaagtgcacttctggctgtgggtcaggaaaaggctccaggaaagagctggctcggagggataaggaggcttttagtggatggggaaagaaaagcattcaaagatgaaacagcgagagcaaagtacagagggaacgcagaggtgttgtcaaagactgatgtggagacctgctgcatgtacttgggaggagagggaggggctaacagccactgggaactatggatggaggcagtgttctcaagaagagtaaaacagtaaaaacaaacaaacaaaaacaaaacaaaacaaaaacagaggctgatgacaaaggaggcacttgaaaaacaccacttttgccagggattgattggcatcaccttctcctgaatgaagtaatcatttctttgacaatagatatttattaaattcccactacattgccaggtgccatcctgactttgggaataaaacaaaggctagtaaagatgaaaacaaaagtcccttccttcgtggagtttacatttcagtggggaagataggaagtaaacaaataacaaagtcagtcagaaagtggtaaatcctatggagaagaatacagctcagccggggagcaagggtaccggcagtggcacagaagccgtgttgtctgggactgtgaaagcagacactctgcctcccaaggtttcatgcacatgctcattcattcattcatgctctttgcttatatttattttgccaggcactggggcagagctataaacaagatgagcaaaatctattcctcatggagctcagggtcgagtaagcaagtaacaaataaataatatcatgataagtagtggtagtggtcattgtgatagagaaaaatagcagaggaaggagataagaagggacgggggtggggggtgggtgggggatagtaaggagatgatacttgagcacagaaggaatgaactatgaatatcccaggaggagaaaagcaaggacaaatgccctgagaggcactgaattttgagtgtcacggaatggtaaattcatgcatgacaatgtcttctctctcctcttctttcttttatattaaacacatctgcttctcggcaaaggatctgtgtaaagcaaggcatcatcttactgcaaggggagacatcgctggggtctggttagaagatctggctctattttctccaatgaaggtctttataggaaatctgcattagtgccttgtccatgttcatagaccctctgcttcatggcagaagggcgctgacttgaaggcccctaagcagcgaaggaaggggagcctctgtcccctccctagctggcttccctggcacatgctggtttccctccaattctgtggtgcacatcatgaccagcagaggaaagaattcagctggaccacctcaagctctgtgtgacggagttgaaagctttgctgatgtatatgttggtggtcaaggaaggctttctgaacacttacctggtgcccacagaggctctgagagctggaagctggaaagagtcagtctggggtcctaaaaggtatcttctcttcagtgccaacatcaggggcatattggtgatagaaacagggtctctgcatggctacaggcaccattaattggttcagttttcttccatttctcctgagctcaccctgaccctatgcactgctgaccaggaattctaacccgcagcatcgtgggtgggcccaccttgcagcctcatcacggttgagtttgttactcttattgatgaagaaactgagactcagaaggataaaggccccgacccagggttacacagtggtggggcaaggacatgagcccagcttctctcacttagaggaaatctgcaaggacgatcattgtgctgaaagaggagtgggagggggtctgaacttctgaggcagcctcgcttctgcagcgttgtctgtggtaaggacacaccaccctggctgcacattagaatcacctgggcagcttttaaaacttacctcgggccaattaaaacagaatctctggaggggagacccaggcatcggggttttttttccaaaactgcccaaatggttccaatgtgtagcccagattaagaaccactgtttaatggcaaactcagttgcagctgttgaaaagttttttaaatgcaataatcttggaattctcttgttttaaaaaggactaatagcttgctatttcttccttctctggtcactccagagtagtcatttttcaagataaggacctgggttaagtgagcataaaaacatgaataaaaattaaaataaattactaagtgagaaataaaagccatgaataatgtaacaaggggaagagctggaagaactagggcagaaagcaaagcagagaaaagaagaagagggtcactggggaagcctctgtggagttggaataaaaatggaggaaggaaagctggtgtgtaaatcctgtctttttgatactcgggcccagtaagtatctaggatacctgagggatttcagttcttgcagatgattgacaagctccagccacaggctgccagcatcccgcagaaagagcagccatgcccaggtctgtacagcgtgttctagactgagcagggcacggtgaagagcagtagaattgcagtcacatggccaggcatggtggctcactcctgtaatcccagcactttgggaggccgaggcaggcagatcacgagctcaggagtttgagaccagcctggccaacatagtgaagtcccgtctctactaaaaatacaaaaattagtcggacatggtggcgcatgcctgtagtcccagctactcgggaggctgaggcaggagaattgcttgaatccgggaggcaggggttgtggtgagccgagatggtacaactgcactccagcctgggcaacagagtgagactctgtctcaaaagaaaaaaaaaaaaaaaagaccgcacacgcatataggtgtcaaaaaaaaaaaaaaaaaagaattgtgtcacgtaagccccaggcctttgtattggaatccaggggagatgatgaggaggaaggggccttgttttgttcgaaaaagccccagtgatttggtcatactccttccctctgccttcccttttcttctccacccctacactgagaattactgtccccacaagggctcacccgtgtgaccagctctcctgcaggtccaaaacaatccaaaactttgtgactagcatatcatttgcaccttccaggcagcttctgaaggaacacactcccactgggaagggtggcaggtaatgattcccggaacctgtcactcaatgattgacattagtcttagtcatggttaccaccaaaacttccccaaaggagggacgtccgggtcctttgattgaccaatagtatattctctaggaagatttgcttccaaccaattcccagcaagctcaagcaatagatgacaaaattttataaacccaaatattttatcaaatggtaaccaagttttgggtcttcggataacacgttgtttcttagacacagtccactaaatagagacctccccataaatgatttgtttgtttgaactggtgattcttcgtcatcaatttattatggttgaaagttgagaaggcacatacaattgccagatatttgggggacaattggaaggcaccgagtttcctaaatgacctatatgaaattgtagttgagctggggcaagacagttaggagcatatttggatgaattttgttctcaggtattgtaaagagttacgtatatgtatagttttaccccaacctatttgacctgcaaaaaccttcttgaggtatgggagttttgattaacaagtactcattacactatctgaagaccttgtctgtaaatctagaatatataaacagttactatgaacatagctgaaaaggaaaagttgaccctgcagggccttcctgcctcctggatacactccaagtggcacctttccctttgctttataaaatggcatattccagaatgttatcaaagtgtgtcttaaaagatatcaacaccctcaatgatttacagtgtcactatggtttcttgtaagaaagaaaaaaaaatccaaattggcaaactggtataaatggtgcataacaatatttttttgatggcctaggacagccaatgggtgcctttaatgtgaatggctgcaaaggtgctttcgatacctgtgtgtaaatgtggaaagccaaagctttcacaccacatggtgcaggcccagcagaagtggccgtagactcagaaactcccaaacaaacatgtaacttaacaactctatcaaactaaccaaaatgttcccattgaatcatctaaaataagatgagacctctcttgccttcacggaattagtcaagttcctctcccatatgattacatctctggcagaagctcccttcaggcctaacccactttttaaagcatggctggtgttgtatacttgttagtgggaaagggacacctcttatctcttagaaatacaatcaggtggtgaaaaggagaaatagtcatagaccatttgattggtggccaggagaagaacgagccacaggctcagcatttggatgtttgaccaatccctgggctcagctagaatagcacagagaaacatgcttgttcagcagatattcagaatccccaaagctacccaacccaaagtcaagccatgttctgggagtctcgctgatatattttaaatagattccagggaaagatcacgccctaccgagaaatagtatgagttggcaaactttttgtgaataagggccagatagtaaattttctctttttttgagatggagacttgctctgtgcagtggcgcgatcttagtaccatattgtggcagagcatggaaggcgcgatctcagctcactgcatcctctgcctcccgagttcaagtgattctcctgcctcagcctcctgaatagctgggactgcaggtgcccaccatcacacccagctaattttttgtatttttagtagagaatagggtttcaccgtgttagccaggttggtctcgatctcctgacctcatgatccgcccacctcagcctcccaaagtcctgggattacaggcatgaaccactgcacccggctgatagtgaacattttaggttttgcaggccacatggtctctgtcacaactattcaattctactattgcaatgcaaaagcagccacagactgtgtggaaatgaatgaatgtggctgtagtctaataaaactttatttacaaagacagaccatgtgccaggtttggctgagggccgtagtttgccaaactcctctccctatttatattattgagaatgatctgtgtaggtggaagatggacgtgttcaccaaattatagagtatgacttttagaggccagtatagggtagtggtaaagaatatggactctgaagcctgaattcagatccttactccacgagctggataaccttgagcaaattattataccactctgtgcttcatctatatgaggcacatacttttatctatacaatgaagttttaatcatctatgaaatgaggataataatagaacttagtgttataatttgggttcatcccaaagtggacccagataaaaggacttagatagaagtgattttttgagaggtgatcccaggaagtacaagtgaaggaataagggcgagtgagagcgcggggagagaagctcttgaagggggcgtaaaggagcagtcattcttgagggcaatggaggcaccatcatgttgaggaccttcacagtattgtacaggacagggaactgggatgtttacctgtgcacgcatgttcctcactgtcattccatgtcaaactgtccactgtgactgcaggtgtaatcaggaagtggactgagggcacatggatgggcaatagtgtctgccacacgatttcacagggctgttataaagatgacatgaatttgtatttgcaaagcacatgggggaaaaatgcctggtctttaggaaatgtcatttaagtgattgccaaataaagagtgggtatcctttgaagcagtaggaaagaatattaggcataacaaagattaaattgttgaaatttcatatctgtaaaggtaatatgggtggaacactgaaacaagttccacaatagattatgaaggaacactagaaatgccaggaaacatgtaggtagattataagcagtggcctcttcaactctgtaaagttgtcagtcaataccgtgtactacattagctgatgacagtgatccggagtgaccctaggaaggctggggacacaggaaaacaaataaaatgtatgccatatttaatctatgcctagttgttataatttggcactgtaattaggcacaaatgacatgttctttacatgaattattataatttgaattacttttatgcaaccctataaaaggtttttctttttttggagacagtcttgctctttgcccaggctggagtgcagtggcaggatctcgactcactgcaacctccacctcccgggttcaagcaattcttctgcctcagccacccaagtagcggggattataggtgtgtgccaccatgcctggcttacttttgtatttttagtagagatggggtttcgccatattggccaggctggtctcaaactcctgacctcaggtgatccacccaccacagcctcccaaagtgctgaaaatacaggcatgagccactgtacccggccccattaaaagattctcttatttggttagtccttcagtacctaaaattaggaaaagattgtccatttttcctaatacagtttaatcgtttcaaccacctgtgtgcatgaatgaaagtgtagaaacgtaacccacatactctggccttttgtttacaaccttcctgactctcaattccattcattctcaccctgtcgggtctctcccacatgcccccatccctcccctgtttttcatgtgattttaaggcatatgcatgtatttcccctcctcttttcctgagtggtctggctggtggcagactctgtgtggggaagtgtgctcttatcttagtaccatactgtggcggagatgagagagagagagagagatccctgactcaggaggcgataggaggagcacagtagatatgagccctggctcttttgtgtctagcagttccaggtagatggaaagtgaagggttggacttaatgagaaataaggctgtgagaagaaagtgctcaagaaagttggttcttgtttccaggatttcactgcaaaagcctaaacaacaatctttggcatgggtcaaagaataaacctacaaccactttcaagaaccaggggaataatcttgagtgggaagaggaggaaacagccatgcctcctatccaaccttgccaggctcttgtgttactgaaatagaatagtcttcagagacacttccagcatgtgtcacagtcaaatgcttttggctgcaagaaacagaaacaaaaccaactgaaagtggcttaaggtataaggaaatttcgtattacacaaaagaaaatgtccaagattgctaaattcattggttcaaaaaatgtaatccaggatccaaactctattctgccaaccttcatgtgtcatccttgtcctcgggctggctctccccacggttgaaggtgtctactgcctctctgtgtatcacaacaaacacaaccacatccagaggaagaagaaaccgtcttcatgtgtgcctcttttaggagtgaggaaagctttcccagaagtcacccagcagactttctgccagaactctttggtcacaatagactgcaaggtcagtcctaaacaagccatgggcaagagcaggaccatcatggctggctcagatggataagaattgactgccggagctaggctggagctggtgactcccttgagtcacatcagggaggaataggttccaaagcaactttggaactctgccaacaaagaagggggtggattgaatgttggctgactaccaacagtagggttgtgaagatgtcctggagccccactgatactgtttctttttcccagcctttcctacttattagcaaatggctaaagctcctttgaaaaaataagagctctttgatgccacaatttcaaatgaaaagcactaaagtcgggcgtggtggctcacgcctgtaatcccagcactttgggaggccaaggcgggcggagatcgagaccatcctggctagcacagtgaaaccccatctctactaaaaatacaaaaaattagcctagcatggtggtgggcacctgtagtcccagctgctcgggaggctgaggcaggagaatggcgtgaacccaggaggcggagcttgctgtgagccgacaacgtgccactgcaccccagcctgggtgacagagagagactccgtctcaaaaaaaaaaaaaaaaagaggaaaagaaaaacactgaagtatgaatgtgggtaggaagagtgtgagttggatgagtttccctttaattggaaaagtctaacatgcagtcttttcttctttggaaagaggaagagtactagaaattagaaaggtacttggtacctcaagaggttggcataaccctttgtatacaaatttattgtagtatttaccatctattgtggttatttacatatatatgtcacccctaccactctctgagtccttgatgggcaggggactacactattcttcatcacatccctgaaaccagggcggaccagcacatatttcctgtcctgccaagcttcactcatgctcaccttggtaggaactgtgatgagaaacacttagctccgtcttgtaacccagacatacgtaagtctggctcatgctggtcagatggttccagctgactaggtaccttttcttgctcccagttcctgatgacattttcttgaaagaatttgtccacatctaatcaccctctccccacacatattcctgccccttacatcttgagttactgcttctctcctgcatttttagttatttcctctcaattcttctcccttttaggtccccagccagcttcaagctccagaagacactcctctgctttatctttaactaaatgccagtctatcggttattttaacatctattaactactgtaataccactatggtttttgtcttggctgcatttgtcatttcctctgatacctttttcgttaggttcatgttttcctattttccccaacaatcttctcctccgctgagacccatagtccccactgttctatttctgccaatcaccatcttatctattatacaggagcagccaccaaactcccatttgcatcaacatgcaaaagatgaattatgtgtccacaaaaaggggaacaaacacaaaagaggcagtcctggatttccaaatgcctcatacaaatgggcagttgtacacgatccccctgcacccatcccatcacactcttcagtgcatataaactaggaggctgcagcatgcataaattcaataagtgctttcagaaacctatcaagaagaaatctaatgttcttttcccttctacagttgatcctagtttgtacccatgcaaatgatgctgatatttagacaactttaaagggcttataaagtccacaaaggactctgacacccaaattaaagttgtatccttagttcacctcactgtgcaaaagtattgccaaatatttggtgaagttaatccctatctgaccacctccgcaatcactaaccacaacaggagaagttaaagaaatgaattccaggcatgcattatgatttatttgctgtgtgagttttaagctaaatccttaacttttgatatatatttgattttcagaataggctgcagaagaacaaacttaatgtaactgcttcactgtagtgtgaaagactgtctcaggctcctctgaatctgctgtcatttctgttgattcatgaggttgggttatattttgcaaattttctttaattagtgtatatgtgtattgtatatacgttgcaggttcttctttactccattgtggagatgactgtataagctgtcaatgtctattcccagtggttcatgctttctattctgcaaccaaagagagaacaagttgatcagcgatgtggcagtaatgcatatgtaagggcctagaaaccagtggtaagaacatgagtttatggaaacactgcataccagcccctaagggagtaattacagatagactttgaagctgcttaataactggcagcatcatagattttttgtaatcacctgagaagctgtagattagcctaatacagttccaagtacacagagggtggacaacaaccacttgttgagctgacttgaagcttaagaagaaaggctgaagcctgtgcacatgggaggggaggagcacctaacccgttcttagaaatgaatgaaatctcagtgctctgtcttctagccccttttgagtttgaagtcaattttcctaaggtcagtgtttgaagaggaaggagtggattggggaaaaagatcaaggatgaggttataaagctaacaacttgaatttactaggagcttactatagaccaaatactatcatgatgaatgaaaggaaactctggactcaggagctttaaactaactctgctatttaattaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttgttgaggcactattcactatagcaaagacttggaaccaacccaaatgtccaacaatgatagactggattaagaaaatgtggcacatatacaccatggaatactatgcagccataacaaatgatgagttcatgtcctttgtagggacatggatgaaattggaaatcatcattctcagtaaattatcgcaagaacaaaaaaccaaacactgcatattctcactcataggtgggaattgaacaatgagatcacatggacacaggaaggggaacatcacactctggggactgttgtggggtggggggaggggggagggatggcattgggagatatacctaatgctagatgatgagttagtgggtgcagcgcaccagcgtggcacatgtatacatatgtaactaacctgcacaatgtgcacatgtaccctaaaacttaaagtataataataaaagaaaaaaaaaagaaattaatttataatatgtcttcatagtattcaatctactctggcatttcaaaataaagcgaagccattttaatttgctcttatactcaaaaactgacgaggaaacaatagtaaaggattttattatgcaagaaaaaaaagaagactgtggatataatcagaattgatgttgatttataaagaaaagaaaattggccaaagtttagtacagttgtggacattaatcacaatattcttttttttttttttctttttgagacagagtttcactcttgttgcccgggctggagtgccatggaatgatctcagctcactgcaacctccgcctcctgggttcaagtgattctcttgcctcagcctcccaagcagctgggattacaggcatgcaccaccacgcccagctaattttgtgtttttaatagagacggggtttctccatgttggtcaggttggtctcaaactcccaacctcaggtgatccacccacctcggcctcccaaagtgctgggattacaggcgtgagccactgtgtccggcctaatcacaatattcttgaaaatgacttattccaaccagactgtccttctcttctgtggcaggaagaagcaatgtgctgtgggccaaacagcagaacaggacttgctgtctcatgtattccttaacaaatatttattgggtcttattaagtgccatgcactgtactaaacatggaggatatgacaatgaatgaaatgaactccctatgcctaagtaagtcattgtctggaagggaacaatgtaatgtcaaggtcaatagaatatgaacattttaagagagggaaagtatcaagtataagaagcatataaaggagcatgtagtccagtttcagggaggaaaggaagaagaagaagagggccatctaaagcaaagacctggaagagcagtagaaagcaaagattggggcagaaacgtttcagagagagggaaggaactattgtgcaaggccccaagttcagggctgtagccaggaaggaatgaaaacaatggtggagtcacactgggaaatgggatgttgctctgggcattcagaccatgttcctaagggcagtaggacaataaccattattcttttttttttttttttttgtgatttaaaaactacaagtttatattcttaagcttttttttaaatttattattattatgctttaagttttagggtacatgtgcacaatgtgcaggttagttacatatgtatacatgtgccacgctggtgcgctacacccactaactcatcatctagcattaggtatatctcccaatgccatccctcccccctccccccaccccacaacagtccccagagtgtgatgttccccttcctgtgtccatgtgttctcattgttcaattcccacctatgagtgagaatatgcagtgtttggttttttgttcttgcgataatttactgagaatgatgatttccaatttcatccatgtccctacaaaggacatgaactcatcatttgttatggctgcgtagtattccatggtgtatatgtgccacattttcttaatccagtctatcattgttggacatttgggttggttccaagtctttgctatagtgaatagtgcctcaataaacatacgtgtgcatatgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtcttcctatttctccacatcctctccagcacctgttgtttcctgactttttaatgatcgccattctaactggtgtgagatggtatctcattgtggttttgatttgcatttctctgatggccagtgatgatgaacattttttcatgtgttttttggctgcataaatgtcttcttttgagaagtgtctgttcatatcctttgcccactttttgatggggttgtttgtttttttcttgtaaatttgtttgagttcattgtagattctggatattagctctttgtcagatgagtaggttgtgaaaattttctcccattttgtaggttgcctgttcactctgatggtagtttcttttgctgtgcagaatctctttagtttaattagatcccatttgtcaattttggcttttgttgccattgcttttggtgttttagacttgatgtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattattaaatagggaatcctttccccattgcttgtttttgtcaggtttgtcaaagatcagatagttgtagatatgcggcgttatttctgaaggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatgtgaactttaaagtagttttttccagttctgtgaagaaagtcattggtagcttgatggggatggcattgaatctgtaaattaccttgtgcagtatggccattttcacgatattgattcttcctacccatgagcatggaatgttcttccatttgtttgtatcctcttttatttccttgagcagtggtttgtagtcctccttgaagaggtccttcacatcccttgtaagttggattcctaggtattttattctctttgaagcaattgtgaatgggagttcactcatgatttggctctgtgtttgtctgttattggtgtataagaatgcttgtggtttttgtgcattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctgattgtcctggccagaacttccaacactatgttgaataggagtggtgagagagggcatccctgtcttgtcccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtatttgattgaggatttttgcatcaatgttcattaaggatattggtctaaaattctcttttttggttgtgtctctgcccggctttggtatcaggatgatgctggcctcataaaatgagctagggaggattccctctttttctattgattggaatagtttcagaaggaatggtaccagttcctccttgtacctctggtagaattcggctgtgaatccatctggtcctggactctttttggttggtaaggtattgattattgccacaatttcagatcctgttattggtctattcagagattcaacttcttcctggtttagtcttgggagggtgtatgtgtcgaggaatttatccatttcttctagattttctagtttctttgcatagagatgtttgtagtattctctgatggtagtttgtatttctgtgggattggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctcgatttccttcagttctgctctgattttagttatttcttgccttctgctagcttttgaatgtgtttactcttgcttttctagttcttttaattgtgatgttagggtgtcaattttggatctgtcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctaagttcaattcctgggtgtccttgttgactttctgtatcgttgatctgtctaatgttgagagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttgccattatgtaatggccttctttgtctcttttgatctttgttggtttaaagtgttttatcagagactaggattgcaacccctgcctttttttgttttccatttgcttggtagatcttcctccatccttttattttgagcctatgtgtgtctctgcatgtgagatgggtttcctgaatacagcacactaatggatcttgactctttatccaatttgccagtctgtgtcttttaattggagcatttagtccatttacatttaaggttaatattgttatgtgtgaatttgatcctgttattatgatgttagctggttattttgctcgttagttgatgcagtttcttcctagtctcgatggtctttacattttggcatgattttgcagcagctggtattggttgttcctttccatgtttagcgcttccttcaggagctcttttagggcaggcctggtggtgacaaaatctctcagcatttgcttgtctgtaaaggattttatttctccttcacttgtgaagcttagtttggctagatttgaaattctgggttgaaaattcttttctttaagaatgttgaatattggcccccactctcttctggcttgtagggtttctgccgagagatccgctgttagtctgatgggcttccctttgagggtaacctgacctttctctctgactgcccttaacattttttccttcatttcaactttggtgaatctgacaattatatgtcttagagttgctcttctcgaggagtatctttgcagcattctctgtatttcctgaatctgaatattggcctgccttgctagattggggaagttctcctggataatatcctgcagagtgttttccaacttggttccattctccccatcactttcaggtacaccaattagacgtagatttggtcttttcacttagtcccttatttcttggaggctttgcttgtttctttttattcttttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccctagctcggagtaatttgatcttctgaagccttcttctctcagctcatcaaagtcattctccgttcagctttgttccgttgctggtgaggaactgcgttcctttggaggaggagaggtgctctgcttttcagagtttccagtttttctgctctgttttttccccatctttgtggttttatctacttttggtctttgatgatggtgatgtacagatgggtttttggtgtgggtgtcctttctgtttgtagttttccttctaacagacaggaccctcagctgcaggtctgttggagtacccaaccgtgtgaggtgtcagtctgcccctgctggggggtgcctcccagttaggctgctcggaggtcagggtcagggacccacttgaggaggcagtctgcccattctcagatctccagctgcatgccgggagaaccactgctctcttcaaagctgtcagacagggacatttaagtctgcagaggttactgctgtctttttgtttgtctgtgccctgcccccagagatggagcctacagaggcaggcaggcctccttgagctgtggtgggctccacccagttcgagcttcccggctgctttgtttacctaagcaagcctgggcaatggcaaagcccctcccccagcctcgctgccaccttgcagtttgatctcagactgctgtgctagcaatcagcgagactccatgggcataggaccctctgagccaagtgtgggatataatctcctggtgtgccattttttaagcccgttggaaaagcacagtattcgggtgggagtgacccgattttccaggtgccatctgtcacccctttctttgactaggaaagggaactccctgagcccttacgcttcccaagtgaggcaatgcctcgccctgcttcggctcgcgcacggtgcgtgcacccactgacctgtgcccactgtctggcactccctagtgagatgaacccagtacctcagatggaaatgcagaaatcacccgtcttctgtgtcactcatgctgggagctgtaggctggaacgcttcctattcggccatcttggctcctccttcaaccgttattctaagtgacgtaaataattgaaaagtctgccaaaagaaggaagacattgagcatacaaaatgcatctcatgtgctttggggcattaatctcactacttgaggctcataatttgcacttggacatagttcactgtgtgagccaaataaaatgtacactggcatctaatatttaacaatacgtggacatgtatataagcataagcctgtttactgttgagctgcacggtaattgagcttcaataaccataatcaatagtactgttacagagttaagccaattttcttttcttttctcactctgttagcctctaaatgtgtattatcattgaaatatcattgactgttcttcacctcatgctcaagtgattaaatgcaaattaaaaggcaaaaatccacaattgttcttcccgggacatggggtgcctcccatcactccacacactccatgttgaaataacctacatgtgaatgaatcaaacaagtgaagtactgtgtgctcaaatagcaatagcctaataaggtggcaagcagatagattctgaaactataattgctttgggagaggagcgttttaatggtgaggcataagaaacaatcaccaaataaaggcttctaagaaaagtgcagacaccatcctaattgcataaaaacaggagggcttacatggtcaataataggctttttgttgcagtcattttctatcaggcttattccattctttttgtgagtattttcatactaaaggagaggtgtacctttctcaatggaataaattgtgcagtgaacaattatgaacagaaatagtaagtcaatagaaataaagttggtgaaacctttatttcagagaatgcaatctcaatgattgcaagcatgaaaagagaaacatttgtgacttgtatatcgagtcatgcaagcttgattaggccaacaggagccaccatgagacatgcactggaggggatgcagaagcccggggcccggaccaaagccagaatgagctttcacccaccacttctaggaatgagttccaccatcatcctactggttggggagggacagaggtgcattaatcatggtagaacaacactatcattgtacttgaacattatttcaagtgtgccatgtgtctcgctgtgtgtggcaggatgccattctcattcttccttccttttgtttctttccatacgctggtgatctaaagttatgcaataaatggcaatcagcatcagcaagacacaattttccttgtctttttgatgacttttgctcaaagtgtggacaacagaccagcaacattggcatcacatgggtgcttgatagaaatgtaggcccttgggtcccaccccaaacctactgaatcaaagtctgtatcttaacaagatcccaagtgattcctatgctgtggataggccactctatagaatatgggctgggcacggtggctcatgcctgtaatctcaggacttgggtggggcgaggcaggtggatcacaaggtcaggagttcgagacaagcctggccagcatggtgaaaccccatctctactaaaaaagaaaatacaaaaaat

SEQ ID NO: 584 - DNA, 20001 bp, Homo sapiens
atggacctacattgcaccagacaccacgttaaatgctaattaggtatggctcttgcccttaaaaagctcagggtcaggcatggtggctcatcatgcctataatcccagcactttgggaggcttaggtgggaagatcacataagaccagcctgggcaacctagcaagaccccatctctacaaaaaataaaaataaagaaattaaaaggaaaaaatctcagtctagtgagggaatgatagcacaatgtgaaagtaaaagaggtaactcaaaagtgattaagcagtagaagtatagaggaagtgatagctatttggtgtaagatttcacttaataaaaatggaatgcttgctatgccccacatccacttcatactttattccactaaaaagccattctcccactctagaataccatctttgcaccagatttacagaagagttacaaagagtgtacagagatccctcatgtaccctcaccccactcaccctaatgttaacatcttgcataaccatggcaatttgtcaaaacaaaaaatttaacattggtacactattaaactatagactttatttgggtttcaccagtttttccactaatgtcctttcctttttccaggtttccacattgaatttggttagcatgttttcttggtctccttaatctgtgatggtcttttattgttttttataaccttgacaattttgaagagtactggtcaggaattttgtagaatgtctcccaatttgagtctttctgatgttttctcatgatcagactgggttttgggaatggataatacagaagtgaagtgcccttcttatcacattatatcagagggtatgtgatgtcaacatgacttgtccttgatgaagctaatcttgatcacttggataaggtggtatttgtgaggtttctccactgtaaaatttctgtttttccctttccatgctctattctttggaatcaagtcactaagtctagatgacactgaaaaggaaggggattaagcctgtgacccaggagaggggagtatccacatatatcatttggaattcttctgcagaaagatttatttgtccattctctctccttccttcctccctccctccctccctcccttccttcctttgttttctttcttcaattatttatttgtattactgtggacctatagatattttcttctttccttgagttgtgtgatgctctgccatttttaacgtgacgttcatagatacatgcttaaggttatatactacattaagtgcagtcttatcatctttcttgacagtaaacttccaggaaaagcaatgtgccctatttcacttatcatcaaagttaggtcaaatgtcaccttccagatgcctacattggccagtcctctaaagtagcgcccaccccccactgctgccagtcactctcagattattctgttacatttttattttctttataacacttgctgcttggtagtaattttatagacttatttatatacttaatatttgtcttttcccactagaatagcagcttcctgagatcaggagcattgtttttcttgttcatttctgtattctcagtgtcacaaacagggtcgggcacattgccagtacacggtaaatgtttactgagtaactcaataaatcttcatatttctcactatgcccagtgactggccttagagagatcaataactacaaatgagtggaatctggaactctcccagtacctgttaaattatggttaaatacatttttatttataaaattctaatgcataaaaataattttcacaacaacactgacattaaaaataaaaataacaaacatctgaatatgtctttgctgtcaggcagcagattctacttcctgattgtgttgtattcctgttaacactggaaattcaagtcattgttctctgagcccacaccagctggctgcgcaatggagaacaagagtagaaacagagagaattgtcccaggtgctgagggtctctggctcatgcctaatccacaaagtaggccactgagatgtgcctgggtggtcagataataaagagactggcataggatgaagaaagaaagaagaaagaaaggaaaggggagagaaagaaaaagacagaaatacatatacaagctccctctccctctccctctccctcccctccccctccccctctccctctccctctccccacggtctccctctccccacggtctccctctctttccacggtctccctctgatgccgagccgaagctggactgtactgccgccatctcggctcactgcaatctccctgcctgattctcctgcctcagcctgcctagtgcctgcgattgcaggcgcgcaccaccacgcctgactggttttcgtatttttttggtggagacggggtttcgctgtgttggccgggctggtctccagctcctaaccgcgagtgatccgccagcctcggcctcccgaggtgccgggattgcagatggagtctcggtcactcagtgctcaatggtgcccaggctggagtgcagtggcgtgatctcggctcgctacaacctctacctcccagccgcctgccttggcctcccaaagtgccgagattgcagcctctgcccggccgccaccccgtctgggaagtgaggagcgtctctgcctggccgcccgtcgtctgggatgtgaggagcccctctgcctggctgcccagtctggaaattgaggagcgtctctgcccggccgccaccccatctaggaagtgaggagcgcctcttctcggccgccatcccatctaggaagtgaggagcgtctctgcctggccgcccatcgtctgagatgtggggaccgcctctgccccgccgccccatctgggatgtgaggagcgcctctgcccggccgcgaccccatctgggaggtgaggagcgtctctgcccggccgccccatctgagaagtgaggagacactctgcctggcaaccgccccgtctgagaagtgaagagctcctccgcccggcagccaccccgtctgggaagtgaggagcgtctccgcccggcagccaccccgtctgggagggaggtgggggtcagcccctgccatgccagccgccctgtccaggagggaggtgggggggtcagccccccgcccggccagccgccccgtccgggaggtgaggggtgcctctgcccggccgcccctactaggaagtgaggagcccctctgccgggccagccaccccgtccgggagggaggtgggggggtcagcccccccgcccggccagccgccccgtccgggagggaggtgggggggtcagcccccccgcccggccagccgccccgtctgggagggaggtggggggatcagccccccgcccggccagccgccccgtccgggaggtgaggggcgtctctgcccggccgcccctactgggaagtgaggagcccctctgcccggccagccaccccgcctgggagggaggtggggggtcagccccccgcccggccagccgccccgtccgggaggtgaggggcgcctctgcccggccgcccctactgggaagtgaggagcccctctgcccggccagccgccccgtctgagaagtgaggagcccctccgcccaccagccaccccgtctgggaagtgaggagcccctctgcccggcagccgccccgtctgagaagtgaggagcccctccgcccagcagccaccccgtctgggaagtgaggagcgtctccgcccggcagccaccccgtccgggagggaggtggggtcagcccctgccatgccagccgccccatctgggagggaggtgggggggtcagccccccgcccggccagccgccccgtccgggaggtgaggggcgcctctgcccggccgcccctactgggaagtgaggagcccctctgcctggccagccgccccgtccgggagggaggtgggggggtcagcccccccgcccggccagccgccccgtccgggagggagttgggggggtcagcccccccgcccggccagccgccccgtccgggaggggggtgggggggtcagcccccccacccggccagccgccccgtccgggaggtgaggggcgcctctgccgggccgcccctgctgggaagtgaggagcccctctgcccggccaccaccccgtctgggaggtgtgcccagcggctcattgagaacgggccatgatgacagtggcagttttgtggaatagaaaggggggaaaggtggggaaaagattgagaaatcggatggttgccatgtctgtgtagaaagaagtagacatgggagacttttcattttgttctgtactaagaaaaattcttctgccttgggatcctgttgatcggtgaccttacccccaaccctgtgctctctgaaacatgtgctgtgtccactcagggttaaatggattaagggcggtgcaatatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaaaaaaagaaaggaaggaaaggaaggaaagaaaggaaagaaaggaaagaaagaaagaaaagaaagaaagaaaagaaagaaaaagaaagaaagaaagaaagaaagaaagaaagaaagaaagaaagaaagaaagaaagaaagaaagagagagagaaagaaagaaagcgagctggccaaggctgccaactatctaaatttgagttcattatggtagagccattttaagcctcatggagaatttacccagttggggaagaaagaaatggaaatctgaaaagccagcaacagtcctttccctgaactggagaggtggctgaaggctggtaggaatttggacttttcttcccagcttgtttggtaaaaattatcaatggctgacatttaagagaaatgaaatctgatgaggcagagtaaatgcagtgtgaatgatttgcttttccccataactgagtggataaacatgattatttacttaataaagaattctttgatgttcccaaaacaatcctattagtttaataaatggttgaaaaattatgatttatacaagcttggttaataaatatactctgcagtctctgtccatttatcattgatttccatatgtttgtacagacagctgagttctttcttttcctctgaatgctgcatttgcaggaaaatcaggattgaatttaaaacatgaaataatcattataaacctcctaggtaaatagtactgactcatttactcacacactgaagaatcagggccagcacccaggaataagaatctttttctattttctttctgtcttttggaagagaaaactgacccagggtatatcatcacccctaactcggtgccagagttggggaagataggagaaactatatgtactccatgatcattgcctgccaaaagcacttaccggtgcatcagagatgagcttctgaaaagactaagagcaaaaatctagtatctgatctcaagtatgaaaggccatcctgagtcatattacgaggctgccatagtatattaatatatctcacaggcttactcttttagatatgccaagtttctaaaatcattgtctttgtaatcaaaagcttttactaaatacgtcacatggtggtaagatagtgagcccctttcagttgaagtatgcaagctgaatctgaatggccatttgtgaaaaatgctttgaaagaacatgtagagcagatggagggttggcttgcaggaactccagggttttcttttttttttcaactccagggttctatgcagtcagccacctaatatcttacaatctaaataggaggaaccatgtggatgctagtcaatactgaaaacctacaattaaaataattaaattaaatgaatacataaattaggtgagagcacctggacatttggtgggaagatgagtgaggaggatatgaaccgtacttagaaggcaatctattacacatgctgtaaaggtaggagacaaattcttattggaatgacagattaatatttcaagagttagtgagtgatgggagtataacagagctgtcactgctccactcataccccctaggccttattactttaacacctgcctgcccaacttccaacccccagcagctgcatctctttgcccctgagcaaacatagtgactagcttctaatgaatagaatgtatcagaagtattcgttttccactcccgaaattaggtcataaaaggcattgtagcctcctccttgctctttatcttggattggtcactctgggggaagccagctgccatgtggtgaggacaattgagcaagcttatgaagaagttcacatggtaagaaactgaggcctcctgccaacagccctgtgagtgcgccatcttagaagtggaacttccaacctcagtgaagccttcaggtgcctgtggcccctgccaacatcctgattgacacctcttgggcaagaaccacccagcaaagctgctcccaaattgctaacccacagaaactgtgacataatacatgtttatcattgtaagctacaaagttttagggaggagagcaatttgttacacagcaatagataacaaatacattcagactaagctaaaatacagagaatgatcaataaggtcaaaggccaaaaaaaaaaaaagttcaaaggcttgggagatgaggaggaagacaaagcatggcttatattatttttaacaaaaagtagaatgatactgtttatttcatatatgaattttttaaaagctgaacctcagatggaaatttattaatcataattcttagatcatgacagttgtctttcattcagcaatgatcctctattttatttatgattttagtaatataatgcacacttataaaaccaatgttcaactcaagaactaactagtcatttacattcacctacacataattatatatttttcacttaataatataccatatttcttcctcatacctacataattttttttatgtctacacagaattctgtaatgaatattcatacttgattaaaccgttctttattgttggacatttaaaatagtcccaactttttgttattaaaaataagatggtgatgaatatcctcatgcataaattaatgtgctgctgtgattaattccttaggatacattctcaaaagtgtggtggctcacacctgtaatctcagcactttgagaggctgaagtgggtggatcacgaggtcggggttcaagaccagcctggccaacatggtgaaaccctgtcttttccaaaaatacaaaaattagccgggtttggtggtgtgtgcctgtaatcccagctactcgggaggctgaggcaggagaattgcttgaacctgggaggcagaggttgcagtgagccaagatcatgccaccacactccagccttggtgacagagcaagattccctcagaaaaaaaaaaaaaagtgcaagtctctatgaaaaggcaaaatccagctctactgctcctgcagcaacagctatccctggcctatcagaaatgtctcatcttctccatacgaagcctctggatcatacacctagatccaagcaattcagtttcctctgaaacagtggtccccatcgtttttgacaccagggaccagtttcatggaagacaatttttccacagatggtgtgggagggatggtttcaggataaaactgttccactccagatcatcaggcattagttagattctcataaggagcaggcaacctagatccctcgcatgcacagttcacagtagggtttgtgcttctatgagaatctaatgccaaggctgatctgataggaggtggagctcaggtagtaatgtgagctatggggagccgctgtaaatacagatcaagcttcactcgctctcccaccgctcccttcctgctttgccacctggttctcaacaggccacagactggtaccagtccatagcccagagggttggggacccctgctctaaaagatcagaactacaatgacaatgttccacatgcctttttatctatcaccaagaacgaagcccctccatattttttgtcttctactcagtcttccccaaacggtgctgtaaatcccaaatctgttccaccccttttcctcaaaaccaaaatccttccactgcaccttctagaaatttctcttcattgatgtctcataaattttaacttcctctgtaaaccatacccgcccccgtctgccccacttttcttaaccaaaacttgactctacatcaggaatactgtttctcctatagctctctcagatagaagctgtttactctcactcctttaagaccattatttttcttccttattgaataaaaatcattcttatgtgtctggcaacttcgtctctctttacaagaaccatagagcaattttgtggtcattctcctcactcgaaaaagacataagcacatgtcttcttcttcaccccaactcctgacatcacttgacatagcctcaagtttggccgctcaaatctttagtcttctcatctccaatgttctttcactctgtgctacacttggttacatccctgacctcatcaccaacagaaaccataccacgtgcaagattgggaactcaactcaagtgatagccaaaattggaagctattgaactttgtgctgattcagacaatgggcacagctgaaaaaactagatggaacagataagacttgattgaagcacgcgataaagggcccgaagccgctccttgaagaagagagaactggaagaggaagagaaaagcactggaactgtaggctgaagttctagaaggagatagggctacaacagaggtgagaagcgagatcccagggaaactgataagcaaaggggatttaaactgttttgctgtgacaaaaaatgtaataattatttttttttttttttttttttttgagacagagtctcactctgtcacccagactggagtgcagtggtgcgatctcagctcaccgcaacctctacctcctgggttcaggtgattctcctgcctcaccctcctgagtagctgagattaccggcatgcaccaccacacccggctaatttttatttttagtagacatggggtttcatcatgttggccaggctggcctcgacctcctgacctcaagtgatccttccacctcagcctcccaaggtgctggtattacaggcgtgagcttctttgcccctttttaagctattttagttcaaaatttaaaatgcttgttatgcttccttacatgttggactgatgtttcttttgaatgcaacaccagggtgagaccaggcagcccaacattattcaaggtacacaaacactcccatctttggcctacccttctcactcacttttcatacaaggaaaattctttgacttgagatctccaatcccctaaactacgtcatcttttctctatagtcatcaactccttcctattttctaatttcttcccaagttcagaatgtgtgtccagtagtttagtaatcctcgaccttggatggatgcccactgcagacctctatgcctctgtgcctgcataatgcagctgtaatggtgctggcggggatgcccataatgctgcagatttttttagaatctatgtttataaataagatgagtctgtcatattttacaattacactgtcatctaatttacatgagtttactttttaaatgagatttggggcattcctcttttttcctattctctggaagtgttttataggatttgaattttgatcattagatgtgtttccttttcctttttttttttttttttttggtacagttgtaattatgttagtcatctcttggatgtgttttagatagaactttgttaaaaacatctgggcctaataatttcaggcagaagtttaaagaaaaagtagatattaacccactgattcaatttctttattggttgtaagtcttttcagatttcccatttctacttaagtcaattttggtatacattattttctaggagattgtctgttttgaatatctttaaatttattagcctgaagttatttatgtaactcccttatttttatttctacatctgtaaccatgtgcctttttcattcttaacactgtatatgtgtgctatttcttttttgtcagaaattaatttgtttaggtttttattttaaagaacacttctttattgattgtccctatcttatctttattatttatgaatttatgatctttaaaatgtttttccttctacttttttcgggttttcttgaattgaatgcgtagcttgtcatttcaggcattcttttttaaaaaacaaacctcttaaaatataagttacatacaataaaatgcccaaatttttatatttcattgagttttgatgaatgtgtaaccaccactataaccaataaagagatcatttccagtatgccaaaattcccttgtgcccctttgcagccaaccttcaccactaccctagtctggtcccagggaacaattgatctgctttctgtcattataaattagtttgccttttctaaaatttaatataagtggaatcatacacatattttcttctgtctggcttttttttttttgcttagcataatgtatttgaaatttattcatcttaaaatttatccatgtattagtagttcattcctttttattactgagtagtgttccattctacaaattatattacagtttatttcacttgcctctcaatgggcattcgggttatttccagtttggggctgttatgaataaagctggtatacatactcgtatacaaatcattttttgaatgcatgtttttatttttcatgagtaaataccagaaataaaattgctgagttatatgttaagtatatgtttaacttataagtaattgtgaaattcttctcccaaatatttatacaattttacaactactttggaaaacagtgtttgagatttccaattgctccatattttcaccaacacttggtattttcggtcttttttaattattctcaataatatttaaagtcatctcactgtagttttaatttacatttccccaaagtctagtgatgttcaacaacttatgtgatcactagccattcataaatcttatcaatatgtgttttcctcattttttgtcttattattgagtcgtaagagttatttctgtagtctagatataagccctttattaaatatatttttgatacataactgagagaaaaagagagggaaagttttgatattaaaccttttctattgttctttaattagtatttttaaaattccactgtaatacatattgactcatgagttacttacaaatgaattttgaattttcaaacatgtaggttcttttacattatctctttgttattgattactatcaattgtatcgtggtcagagaacatggtctgttttatgctggttctgaaatgtgttcacatgtaatcatttatgttactttatgtgacaaatttcacaaatgtatgctcaaggcgaatctgtattctctgtttggttcatatatacttttaattgtgatcaatgttagatcaatatttttaattgtgttgttaaaatcttccatatatgtattataacataaaatcttccagtacaactataaatgtgtaggttctactgtacatctatcagcttttgccttatgtatttccaggtcttagtattagacggacacaagttgaaaaattttaaatatttctggtgaatgttagctattatcatgtagtgagtgttatttccctaataatgtttttggccttaaacatatgaccttttaaaaagtattagtaatagtatttgcgtgctgtatcttcctttatcctttcactttgaatctttttatgtgcttttgttttagatatgcctcttgtcaataccattgtattagtctgttctcatgctgctaataaagacatactgagactgggtaatttataaagaaaagaggtttaattgactcacagttcagcatggatggggaggcctcaggaaacttacaatcatggcagaaggggaagcaaacaagtccttcttcacatggcagcaaaaaggagaagaatgagtgcccagcaaagtgggaagccctttataaaaccatcagatctcatgagaatgaactatcatgagaataggatgggggaaccacccccatgattcaatatctccacctggtccctcccatgacgtggggattatgggaactacaattcacgatgagatttgggtagggacacagccaaactatatcaaccaccaaactaagttgttgtttttttttttgattcaatctggcaattctgtttctttagaaaaaatagttcctttacatttattgtgattacatacacacctacatattgaggtataattacctaatgtaaaatatacagtgtataatttgatgagctttgacaaatgtatacctttgtaatcaacacaacaatcaagattattctatcctagaaatttctcttaagctcctttccctttattctcactctcgtcacagaaacaagcactattctgatttctttccctgtggtttagtttggtctgttttgggacttcatataaattgattatttatgtcttttttggactgtcttctaatacttagcctatttttttgagattcatacccattgttgcatgtatcagaagtttattgttttattgctgagtagtatattatatgaatatagtcacatatttttatcagtaccatttcatcttttgcttttaatttacttgcctattctgtccttcttttgattcatcatgtctttcatccatttttttccccatcaactagtttgggagttacatactttatttctattctttcagtagtaatcattaataatttaacatgcacactaacaaaatgtaaaattactgaatacctctcatctcctcttgaacaatacaagtagcttagtacactttattttcaatattcacttctcattttacaggtgttttgtccagcattttagctccatcttgttttctgaaattcccaaattataataattattgtttcatacactgaagtttagtttagacttatacatgataactaagtttttttgctcactatttgtttttatttggcagattcttaaggggtcatggtttcttgtaagacatctttttaaaattcccttagtgatactagtggtacactcagttttgtttattcaaaattatttactttgccttcatttttgaataacatttttaaaataatatttttaaagagagatgtaattcttgttcaagaataattttttctcaacaatttgcaaatattctagtcttttggcttccatttttgaataaataatttaaattttaattgacattataattgtacatatttatgggtacagtttgatgttttgatacatatatgttgtataattattcaatcagatagtatatgcatcatctcatgaatttgtcatttatttgtgtcaagaatattcatttggtaatatatggtattttactattaaccaaagtcaccctcctgtgaaacagaataccagaatttattccttctatttaattgtaactttctactcattgaccaacctctcctcatcctcccctcctcagtctgtggtaaccagtgtttcatggttctacattctacttctatgatatcaactttttagaaaaaatttcacctatgagtgagatcacgtagtttttgtccttctgtgtttggcttacttcatttaacatgatatcctccaggttcatgttgtcacaaataatatcacttctctctttttaaaggctgaatagtattctattttgtatatatatcacattgtattaattcattcatccattgctggacatttaggttcagttcatatcttggctattgtagatagtgctacagtaaacatgggagtgtagatttctctatgacatactaattttatttccttttaatatatacccagttgtagggttgctggatcatatggtggctctatttttaattttttcaggagcctccatactgttttccatagtggttgtactagtttacaatcccacgaacacgtgcaagtgttcctttttctccacatctgtgccagcacttgctttactttgtctttttggtagtagacattctaactggagtgaagtggtatctcattgtggttttgatttgcatttccctgatgattagttatgttgagctttttttaaatacctgttggtcatttgtatgtccttagataaatatctattaaggtcttttgtctattttttatgtattattatttattattattatttttgagacagaatcttgctctgtcacccaggccggagtgcagtggcatgatctcggctcattacaacctctgtcccctggtttcaagcaatcctcctgcctcagcttccctagtagctgggatcacaggcgtgcactaccacgcccagctggtttttctagttttactagagacagggtttcactgtgttggcctggctggtctcgaactcctaacctcaactgatccacccacctcggcctcccaaagtgctgggattacaggtgtgaggcactatgcccagcctcttttgtctatttttaaattgggttatctggtttttggtttttgttttgttttgttttttttgctggaaagttgtttaaattccttatgtattctggatattaacctcttgtcagatagataatttacaagtattttctctcattctataggttgtttcttcattctgttaatcgtttcctttgctatgcaaaatttttttagttcaatgtaatcccaactgtctatttttgcttttgttgcatgtgcttttgaagtcatatttaacaaatttatgcccagcccaatgtcatgaagcattttttctatgttttcttctagtatggtttcagtttttggtttcacatataagtgtttaattcacattgacctgatttttgtgtatgttgaaagatagaatatagtgtcattcttctgcatgtgaatatctgattttcccaccacaaaatttattgtagagactgtcttttctccaatgtgtgttcttggcacctttgttgaaagtcagttgggtgtaggtgtataaatttatttctggactttttattcagtttcattggtttatgtgtctgtttttatgtcagtaccatgctgtttaagttatgatagctttatcacatattttgaaatcaggctgtgtaatgtctccaacttttttctttttattcaggtttgctttggctatttgaggcttctgtggttttatatgaattttatgattttttttcctattactatgaggaatgtcattggcattttgatagggattgcattaaactgtagagcattttgggtagtgtggccattttaacaatattaattcttctaatttatgaacacatggtatcttttcatttatttgtgtcttcttcaatttctttcattgaagttttatagttttcattgcagagttctttcgtctccttggttaagtttattcctaggtatcttttttatctgtagctattgtaaatggaacctctttttaaatttatttttcaagtagttcactattagtgcatagaaatgctactcatttttgtatgctaattttgtatcctgcaacttttctgaatttttaaaattagttctacagtctttggtgatgtctttggggttctctctatatacaattatgccatatacaaacagggacgatctgactctctcttttccaatttgggtgtcttttatttctgtaccttggctaattgctctggctaggacttacaatactacattgaataaaagtggtaaaaatggtcatacttgtcttgttcctgttcaatataatgttagctatgagttttccatatatggcctttctcgtgttgaggtacagaacttctgttcctaatttcttgagagttttcatcatgaaggatgttgaattttgtcaaatgctttttctgtgtctattgaaataatcatttggtttttgttaaatcatgcttgcatccctgagatgaatctcacttgatcatagtgaatgatctttttatttttatttatttatttattttttattatactctaagttttagggtacatgtgcacattgtgcaggttagttacatatgtatacatgtgccatgctggtgcactgcacccactaatgtgaatgatctttttaatgtactgttggattcagtttgctagtatctggttgagaatttttgcatctagtttcctcagggatattggcctgtagttttcttttcttattgtgttctttcccagttttggaatctgaataatgttggccttataagatgagtttgaaagtattcctcttaaattttctgaaattagtttgagaagtggtattagttcttttttaaatatttggtagaattcagcagttttcaagtctttacctacagttgaactgtggatgttttcccttttctttctaattgcctttaagaactatttgtctctctgttctgctcatacagtgaatcttggtaggattttttttttattgttccttttcttgtcctttctaaatctgatgatttattgtctttgcttctagaaaattcttagcctttgatattttgaatattctctgtctcattctctttttctggaactttatttagacacatggtaaaactcatttttcagtatctcttactctctctttatattttctatttctttcattctttctgtaagtttccttaagtttcatatcttgtagttcactagtctctctttagctctggctaatcttttgctttaattatttcattcagtttttaatttcaaagattatatttttcacatctagaagttcactttaattactttctcctcacatttttctattctgccttctaattccttaaataatttaatttaatattaaattattttggtcctacttctgctgattataatgctggctgtcactcatagtgacttgtgttttgtaatttctattgtttttataattttctattataaactcattgtcatcccagtgactttaacggtagaaattctgtgaggttgagttaaaagcatgtctctccagagcagatttatttttcttctaccaaatgccctaagatgactttaagttaatttcttagtgtgaggatttatggaccttgtgaatagcataaatgcaaagccaacgcttacatgaggactgacacattgttatgaagtctcagaggtgacttttttccatgtagagtacaggttgagttagatacatttccttttgatgaaaggcaaagatgtagaaatttgaggcactcaggtttatatggagatatcagttctaactccccacctcacatgggccaaagcctagtctctccactgggctaagccattcaaatcctactgtcttcattaatgagatttgtaaatatctttgaggtagctgtagcttcagttttgctttatcaccctgattatttttaaatttatgatcattgggattgctcttactttcttgacagttcaacatgacatctagcaagatagctgttatattttacaaagcactttaaagtgttggtattggaaggtttgcagaatatctagttaattatgttgctgaaaattgcaattaccattaactcttcaacccatatctatggatcttccacctctacgatttattaaaactgttcttgccaaggacacctccatgttgacaaacttcatgtacagtgttcagcctcaccttactaggcctctgaaagatattcaacatatgcaaccatttcttcattcttgatgtactttattttcccatgctcttagtttttctcctaactctctgggtacctcttcttagtcttctttgcccgtctaatcaatccaaacctaaagttttaaaattatccttataaatattgtaataaataagatgagagaaaaactcaaaatgttataataagcagcatatgtttcaggagtcttcagtacactgccagctaatgcttattgtgatactattattgctatgctcttactatctttttttttttgaggcggagtctcactccatcacctaggctggagtgcagtggtgtgatctcggctcactgcagtttctgcctcccagattcaagtgattctcccgcctcagcctcctgagtaactgggattacaggtgcctgccaccacacccagctaatttttgatctttagtagggacagagtttcaccatgttggccaggcttgtctccaacccctgacttcaagtgatccgcctgcctcggcctcccagagtgctgggaatacaggcatgagccactgtgcccagcccttattaccatttttatgtaaagttaattgtcatgacagtaagttaatcataaagtgaagctgaagtttaacatagtttggcttcaccatgcagaactattctgccctataacgaagaggaattacctttttgcttaagagtgtgaactctaaagctatactacctcatttcaaattcctgctgcactactttctagcttgatgatccaaagcatgtactttaacccttctgtgccttgggttcctcatctatgaaatagaagaaattagagtaccacctagatttgtcaaaagaattgaggacatacttagtccctggcacatacaggttgaataccccttaaccaacatgcttgggactagaagcatttcggattttgaattttttcagattttggaatatttgcatatacaaaataagacatcttggggatgagactcaagcctaaaccaaaattgatttatgttttagatcaccttatatacatagcctaaaggtaaattttattttccattgggaatgctgaataaactgtgtgttgtgtaactgctttttgactgtgccccgtcacatgaggtcagggctggaatttttcatttatggcattatgtcaatgctgaagtagttttgtatttttgagcattttagattttagcttttcagattatggatgctcaacctgtactaagcactgtataactgctatcttttaagattctttacactattacattgacctctgtactctccaggtacagctaatgggagtaaagaattctgaactgttcaaataattttgacacagagattgagatagccaggtatatttctggacgccccataaatgagttagtctcagctactgctgagtcgcttgctacgtgctttggaaactcatacagaatgcaaagaagcaaaaagagtaactaggaagtctctaactttttcatttgtcctaatgaaaatcattagataatggcattgtttagcaatcataaggtaacagcctggggtagcggacacctcagtaggttcagaatgacagagtgcaacatggtcatagttaatgagaatttttttttttttttttttttttttgagacagagtctcgctctgtctccaggctggagtgcagtggtgcgatctcagctcactgcaacctctgcctcctgggttcaagtgattctcctacctcagcctcccaagtagctgggattacaggcgtgcgccaccacatccagctgattttagtatttttagtagagatggggtttcaccatgttagccaggatggtcttgatctctcgacctcgtgatccgcccgcctcagcctcccaaagtgctgggattacaggcataagccaccgtgcctggccgttaatgagaattttctaagcatagctggccctccaagacacttcgctgagata

SEQ ID NO: 585 - DNA, 20001 bp, Homo sapiens
aacaagcacaggttgagatcatgacagaaacaggaagtgccaaagtggagctgggaaaagcatagcaagaggccgggcgcgtggctcatgcctggaatctcagcactttgggaggccaaggcgggtggatcacctgaggtcaggagttcgagaccagcctgaccaacatggtgaaaccctgtctttactaaaaatacaaaaaattagctgggagtggtggcgggcgcctgtaatcccagctactcgggaggctgaggcaggagaattgcttgaacccaggaggcagacgttgcagtgagcccaggtcgtgccattgcattccagcttgggcaacaagagcaaaactccctctaaaaacaacaacaacaacaaaaagaatagaaactccaaggttttggtgcagctacactgatgagccgatgagcatgtggagggaacttaggggcagtataagtgtccagatttgggtcaggggtgtgtttaggaacaggaggcaagattttagttaaaatgagacttctgtttagggataagatcaggaacagagataacctctagcaccttttgatctgacataggtactccaggcttccagaaaaacaggcttgaggctctataattataccttgtttggcctaaaaatgacatttctggccgggcgtggtggagcacacctgtaattacagcactttgggaggccaaagcagaaggattatttgagcccaggagttccaggtcagcctgggcaacatagcaagaccccgtctctatttaaaaaaaaaaaaagactcagcttgatcactggcgttagttcccagacttaatcccatatgaattttatctgtttcctaaagttaaatctactttcagaagatgaagatttgccaccaccagcaatgctgacactgatcaataatgtcttctactacatgtcaggcatggtgtgtgcccagtgttctcaattcatcctcacagcacactcacatatctgtggctcagagaagttaagtaacttgtccaaggtcacacagccagtgtttagtggagccattccactgaccaagcacctactatgtgcttggttttacttgtgttatttctagtccctacggaaacttcaaaaggcaagcaggcatttttcttcacctccctgtgcctctatttttctagtccataaagtggtgacgacacttggaatcgactttatggaaattgccgtgaaaattgaatagatagaaacgtgcagtgcttagcacagtgctggccacagagcaagtatcctatgaaatgtcagctatgtgctgttttaccttcatttcaccagtaaggaaatggaggcccaggtccctaaaggaactccacctcaggcctccagggcttagcttacctggcacagaggtgaaaggaggcgactttggagaaagttaaaggagagtggttttgcccagaaacagacccagtgtcccgcttccccaggtttctgctgggtggccttgggcaagcattccccctgcttggaggctccagcctgggcatcagtgtctcaaacgggcaaaagacattttgcatctcaaaaggatccatgcaggtgggctcatcagaaatgggaactgcggtcacctgagggtgtgtctgggctcttgtgaaatagaaagtagggctgagctttgatcaggctcacacaggcttaagttttgtccaggttgtgttgttacatcacatagcccctggccgtctgttctaaaaggaattttctctcagtgaaccctaggagtccagtgccagggttcttgtgttatccttgcttcttggaggctcagagaggttaagtcactgtccaggtctcccaggtgggcagtgtgagtgagtgggattcgggcagattctctgagctcagagcccgggcacagccccactttggcccgcagaggggcttctcaattgttggttggacaaagccctgggtggcagctgggcactggctgcaggagctggaaatgcaatgcaagcccagtctttgccctcatggagctcacagcctgggagatgagagttgctggtgggcatgtacagagaatgaaacaaaaacactcatgtcttctctagagagaaatctggacggggcacagtgactcatgcctgtaatcccagcactttgggaggccgaggcgggcggatcacctgaggtcagaagttcgagaccagcctggccaacatggcgaaaccccgtctctactaaaaaatacaaaaattagccgggcgtagtggcaggcgccttaatcccagctacttgggaggcagaggcaggagaatcgtttgaactagggaggcggaggttgcagtgagccgagatcaagccattgcactcaaacctgggggacaagagcgagacttctctcagaaaaaaaaaaaagaagaaaagaaagtggaatctggactgggcgtggtggctcacacctgtaatcccagcactttgagaagccgaggcaggtggatcacttgaggtcaggagttcgagatcagcctggccaacatggtgaaaccccatctctactaaaaatacaaaaatttgccagaagtggtgatgcatgcctgtagtctgagttacttgggaggctgaggcaggaggatcgcttgagcctgggaagtggaggtcgtagtgagctgagagggcaccactgcactccagcctgggcgatgggagtaaaaccttacctcgagaaaaaaaaagtggaatctgacaagtgatgctactgggggcctccatggcttttcacagaatccatgtgaatctgagctggccccagcagagtcaggaatccctgggtagacacagttcttccctctgctcacacatgcccaggcacaggctgctctctgtcttccgaagccatcatgctgcacagggacagctgcttgggaagcttttccacccatgaggccaattctgtctcagtacagcacccctctgtggtccactgggccccccacagtgggacagtcacagtcttagttcagccagagaggggcctccaccctccaagcccccaaggacccaggggtagaagcagcagcagtcccctggtcctcagctcctatgcccagggcaagtgaatggggaccagatctgcagatctgtttctgtccagtcaggcagagaccaataggagagatggatgagggccggagccagaggacagacaatgagacaggtcaggctgttgtggtgcggcgtgaggtccattcaatagctattcattgagcccctactgtatgcagggcacttctaggcactccactcacagcagtgaacagaatggaccaaagtccctgcccctgaaatactcaaaagatgtccttgagcctctgcgtcccatccctacttccctctgtgttaacaggaggggtgcctgtgcacctttcctgtgtccatgccagtccccccaagaggggcctgactgccctgcttgcttaccctggctcagtcggttgagtccagtggtgggaaactcggattaccggctggatcctgtgcctgcctctgtgcccgctctctttgatggctagcccctccctatgggacagtgatctttctagaacagaaaagagcagttctcttgataattggcgagtagtccaaacggggtgcgactgatggagtagtgatactactattagcagtagcagtagctgtattcattgagagcttgctgggttccaggcactgctctaagtgctttatctgctgtattagctcgtttaatactcaacaattaggccctgcagggtggctcacgcctgtaatcccagcactttgggaggctgaggcaagagaactgcttgaggccgggagttcaaggctgcagtgagctacgatcacaccactgcactccagtctagtcaataaagcaagaccctgactcaaacaaaaaaagaaaaaaaaaactcgacaattttacatgatttacagttttcacacctgttttacattggaggaaacttcacggaaatgtgcagtcacttgctgaaggtcagtacccagcaaagcctccctccagagccgctctggagccaccccaccccacgctaggggcaggaggatcagagcccctgctgcaggctggaggctgtcccgaggtgcacgccctctgctgcagctgcatatttgtgagtccccggagccaaacacttggctagcacccccagagcagagggaagagccccgaaacagaatgggcgagttcagagcagtggctgtcactctggctgcccatcaggatccctcctgagccttacagcgccctagactggttcatcagaacccctggtgtagggcccaggcgtcagcattcgtcaaggatccccaggtgaattcaatgtccagccaaagcggggaactaccagggtagaggccttgtggcttattggaaatagttgtgggttaaaacccacctgggcttgagacttggctccgtcatttcaagctgtgtgactctgcgccagtcacttaatttcactgagcctcaatgtcctcagctgtgaaaaaggggtaagtccctctaccgtacaaaggggttgtgagggtggaatgagacagtgtctgcaaggactctagcacgtaggctccatctttactagtaaggagggggcaggacagactaggctggcagagcggaggcaacgactcatcatcgctggaatgggtctgtggaatgtgttgggacccccgaaccccaggccctcccaccgtgggctttcagctcttccgggagcttaaggcttctgacgggggccagcccaggcttggagtgggagggcggggagggtgcactgacttagccttaccaccaggtggcgacacgaacacacccaccggggaggacaccggccccgcggaaggtgaggataactgggaataccaggcatgttacaggacttggttttggtttggtttggttttagtactaggtacatattttctttcatttccattgacttcgtgccacagtcctgtggtagcgccactgccctcctttagcgggtgaagaaactgaggtggtgctggcaactaggatgtgaactccacatccgcttcctgaccacggagtcaacagcagtcagagctgcaagggaaagcgtcaagtcccgcggttcctaaacctgtctgatgataaaaatcatccaaggctcttaaaaaaaagaagaaaaatatcctgggccacaggccagatattgaattagaatctcctgggaaaagaggcctgagaatgtgtgtggttaagagcacctggccgggcgcggtggctcacgcctgtgatcccagcactttgggaggccaaggagggaggatcacttgaggccaggagttcaagattagcctgagcacatagtgagagcctgtctcaatttaaagaaaaagttaaaggccgggggtggtggctcacacctgtaatcccaacagtgggaggccgaggcaggcggatcacttgaggtcgggagtttgagaccagcctggccaacatgatgaaaccccatctctactaaaaatacaaaaattagctgagcatggtggcgggcgcctgtaatcccagctattcgggaggccgaggcaggacaattgcttgaacccagcaggtggagtttgccgtaagctgagatcgtgccactgcactccagcctgggcgacagagtgagactctgtctcaaaaaaacaaaacaaaacccaaacaacaacaacaaaaaccacaagagcacctgttttagaaataaggatctgtttccagagaggaaagtgacctgcccacagtcacacagtgaatcccctctaagctcctatcgaagctcctcacaccctctagtccagaagccaggccactccccacaaagacgagaccctctaccaaatgacccagcaatctcaattctgggtttatgctcaaatgaaagcagggtctcggccaggcgcgatggctcacgcctgtaatcccagcactttgggaggccgaggcaggcagatcacgaggtcaggaaatcgagaccatcctggttaacacggtgaaaccccgtctgtactaaaaaaaatacaaaaaaattagccgggcgttgtggcgggcgcctgtagtcccagctactcgggaggctgaggcaggagaatggcatgaacccgggaggcggaggttgcagtgagctgagatcgtgccactgcactccagcctgggcgacagagcgagactctatctcaaaaaaaaaaaaatatgaaagcagggtctcgaagagatacttgtacattcatgtccttagcagcattatttgcagtagctgaaatgtggaagcaacagtagtgtccatcgtctgatgaatggatgaacaaaatgtggtgtacccatacagtggaacattattcagcctgaaaaaggaaggacattctgacacagctacagatggaggaacctggaggacattatgctaagtgaagtaagccagacacaaaaagacaaatactgtatgattccacttatgggaggtatttaaagtagtcaaattcatagagacagaaagaatggtggttgccaggggctgaggtagggggaatggtaagttactgtttaatggacacaaagtttcagttttgcaagatgaaagaattctggagatggatggtggtgatggttgcacaacaatgtgaatgttacattgaaaaatggttaaaatgggttgggcccagtggttcatacctgtaattctagcactttgggaggccaaggcaagaggatcacttgaggccatgagtggtcaagaccagcctggtaacatggtgagacaccccgcccctacaaaaaaaaatggttaagatggtaaattttatgtcatgcatattttatcacacatatacacccagagcagagggcagtgcacccccagaatacacacacacacacacacacacacacacacacacacacacacgagacaatctgcgcccagtctgatttttttttttttttttttgagatggagtcttgctctgtcgcccaggctggagtgcagtggtgcaatctcagctcactgcaacttccgcctcctaggttcaagcgattctcctgcctcagcctgctgagtagctgagattacaggtgcccgccaccacacctggctaatttttgtacttctttagtagagacggggtttcgccatgttggccaggctggtctcaaactcctgacctcgggtgatccacctgcctgggcctcccaaagtgctgggattacaggcatgagctaccacgcctggccctgattttctttatcttttttttttttttttttttagtgagatggtctcactctgttgctcaggctggagtgtagtggctccatgatcatggctcactgcagcttcctgccaccactactgactaaatttatttatttatttatttatttattttagagactatgtcccgttgagttgcccaggctggtctcaaactcctgggctcaagcaatcctcccacctctgtggtccaaagttctgggattacaggcgtgaaccaccacgcccggctgatagttcttcattgttgtttaaatttatgtgaatatttattagatctaaagtagaatgtccagaatttgctactgtccttgacagcctcagaatgattttccccaaaatgttagtatccaatttataatatactgaagaaaacaaatccatggttattgttaaaataagtcaataaaactgctaagttggccgagcacggtggctcacgcctataatcccagcactttgggaggttgaggcaggcgcattacctgaagccaggagttcaagaccagcctggccaacatgatgaaaccccatctctactaaaaatacaaaaattagccgggcatggtggcgggcacctgtagtcccagctactcaggaggctgaggcaggagaatcacttgaacccaggaggtggaggttgcagtgagccgagatcatgccactgcatggagcctgggcgacaaagtgagactctgtctcaaacaaataaacaaacacaacaaaacaaaaactactagggctatgattgaaggaggagacggctcttgctttgactgttcctccttattcagcagaagttccgggttttcacagggaggctcttagggcagagggatggtgatggggagcacttaaataaaacccctgctgttcatttagactcagggccattttcgtttgtttgtttgtttgtttttgagacggagtctggctctatcacccaggctggagtgcagtggcacgatctcggctcactgcaacctccatcccccaggttcaagtgattctcctgcctcagcctcccaagtagctgggactacaggtgcccgccaccatgcccggctaattttttgtatttttagtagaggcgaggtttcaccatgttagccaggatggtcttgatctcctgacctcctgatcaacctgcctctgcctcccaaagtgatgggattacaggcgtgagccactgcgtccagctgactcagggctgttttgctgctccacctgctggtattaggtggctcctaggtcactccccttgtgataggacaaaaatggtcaaggagaagctgggcagatttctcccaccctggcccactagagccccataatttctccgccatctcacctccttcttaagactgattcagggccaggcaccatggctcatgcctgtaactccagcactttggaaggccaaggcgagtggattccttgagctcaggagttcgagaccaacctgggtaacatggagaaacaaacctcgtctctacaaaaaatacaaaaattagctggcggtggtggcacatgcctgtagtcccagctactggaggggctgagatgggaggatcacttgagcccaggaggtcaaggctgcaatgggccgtgattgaaccacttgtctcaaaacaaaaaaaaagactaatcatcccatattgggaaagtggctaagttgaggtgggtttggaagaggagagtttttctggtgggagatagagattgaaatgaatcgcacagagttgctttaggaaggaagaaaagagaaaggaaaggggatttttattagtgtggctttgactatgtatatgtatatgaatcattttaaaatcttttgactttaaaggaaatggctttttaattaccttaggcaattaattttttttttttttgacagggtttcactctattgcccaggctggagtgcagtggtgggatatcggctcactgcagcctcaacctccctggctcaagcgatcctcccaccccagccccctgagtagctgggactgtaggcgtgcaccacagtaattgtattttttgtagagagatgggatttcaccatgttgtccaggctggtcttgaattcctgggctcaagcaatcctctcaccttggcctcccaaaatgctaggattacaggtgtgagccaccacacccagtcaagttgtatatcttgaatcagatactattctgagactgaagcgtgtgggactgagctttattagggtgacacccttattaatgaagactcctcatggggctggaaaaccaacaccttggtgtcttggctcctggacagctgggccacccactgccatggccatgccctggaccctgtcatcacccgaaactgctccacctctcaaattacaattcagatgcccattctctgacgacagtctcctccaccacacctcttctttgaccccattgggacttccaacccgtagctcccagttcttctgcccaagcatctttttccttttctcttggtaatggtacccacttttcctttgaggaaaatccagtttccccccatatggataatcagattcagctgaggctgactccattctccccaactagaggcacagaccatgacccacatctggtcacccatcctatgttagtcctttggcctcagccattggtcaagcatgggcatgcgactctagccagtgtagggagaacaagccccaggactattgctaagacttcaaagaaggagatgttttctttctgttcaggtggctcgactggaaggacatagcctggacttgctgggagctgtcctcagtggggagctgtcctcagtggggagcctgcaggagaatgagaaaatctgagcaaagagataaagagaccaattcctaatgatcttgttggagtatctgaaagtagccattcctgaatctactctggatttttcaggttctgtatgtgagtcagtatttgagatctgtgaatcagagttggttcacatcacttgaaacagacttgacttctgttttgttttgttttgtttttgagacggagttttgctcttattgcccaggctggagtgcaatggcacgatcttggctcactgcaaactccacctccagaattcaagcgattctcctgcttcagcctccccagtagctgggattacaggtgcgtgccaccacaccccgctaatttttgtatttttagtagagacagcatttcgccatattggccaggctggtctcaaactcctgacctcaggtgatccacccacctcggcctcccaaagtgctgggattacaggcatgagccactgcgcctggccagacttgacttttctttctttttttttgtttttctttttttttttttttttttttgagatgaagtctcgctcttgtgccccaggctggagtgcagtggtgcgatctcggctcactgcaacctccgcctcctagcttcaagcgattctcctgcctcagcttcccaagtagctggtattacaggcatgcaccaccacacccagctaatttttgtatttttagtagagatggggtttcaccatgttggccagtttggtctcaaactcctgacctcaggggatccgcccgcctcagcttcccaaagtgctgggattacaggtgtgagccaccgtgcccggccacagacttaacttttttttttcttttgagatggggtttcgctcttcttgcccaggctggagtgcaatggcgcggtctcggctcaccgcaacctccgcctcccaggttcaagcgattctcctgcctcagcctcccttgtagctgggattacaggcatgtgccaccatgcccggctaattttgtatttttagtagagacggggtttctccatattcgtcaggctggtctcgaactcctgacctcaggtgatccacccgccctggcctcccaaagtgctgggattacaggcatgagccactgcgcccggcccagacttgactttcatagtgtctctccagcaggctctagagcaggagtctctctaaatgtggttgtccatcggaattatttggggctgggcaaggtgtctcacttctataatcccagcactttgggatgctgaggtggatggatcacttgagctcacaagtttgacaccatccttggcaacaggtgaaaccctgcctctacaaaaaatacaaaattagccaggcatggtggtgcgcacctgtagtctcaggtactcaggagactgaggtgagaggatcacttaagcccaggaggcagaggttacagtgagctgagataataccactgtactccagcctgggcaacagagccagaccttgtcacaaaaaaaataaataaataaaagaaaaaaattacagggaagatttcttttttattaaaacctttatgtgaagtaaaacatacttattgcagagaagtgcataaaacataaatgtacaagttaatgcattactatgaagccaactcctttgtaacctcaactaggtcaagaaatagatattgtcaggtgccaaaagcctcatccttttcctcaccttcaaaggcaccaccaccctgatttctatgggtatgtggattagttttgcctgctttggagtgttatataaatggaattatacattaatttttaaaatttatttttaatttttattgccttaattaatttttaaacattttattattattttttagagacagggtctcactctgttgtccaggctggagtgcagcggcacgatcataactcgctgcagtctcaaattcctggactcaagtgatcctactgcctcagcctcccaagtacctaggactacaggtgccagccatacacctggctactccctattattttttattttacttttatttatttacttattttgagacagagttttgatcttgttgcccaggctggagtgcaatggcgtgatcttggctcaccgcaacctccgcctcccaggttcaagtgatctttccgcctcagcttcctaagtagctgggattacaggtctgtgccaacacgcccagctaattttgtatttttagtagagacggggtttctccatgttggtcaggctggtctcgaactcctgacctcagatgatctgcctgccttggcctcccaaagtattgggattacaggcatgagccaccgcgcccggcctattttatttatttattatttatttatattactttttgagacagtgtttcactcagtcacccaggctggagtgcagtggtatgatcatggctcactgcagcctcaacctctcaggctcaagtgatcctcccatctcagcctcctgagtaactgggaccacaggtgtgtgcccagctgattttttgaacttttttagagacagggtttccctatgtggcccaggctggtctcaaactcctagactcaagtaatcctcctgccttgggttcccaagatgctgggattacaggtgttagcccctacacctaaccctatattattttttataagctttattcttttgcttttcgtattgaagactatagcccacctggaatttatctgttgatggtgtgaggtaagggtcaggtttcatttttttccccataggagcacactcagttgatttactgaaaagtttactctttccctgtgtgtgtgcttttttgttttttgttttttgtttgtttgtttgttttaagacaggctcttgctttgtaacccaggctggagtacagtggtgtgatcttggctcactgcaacctccacctctcgggttcaagcgattctcctgcctcagccacctgagtagctgggattataggcgtgcaccaccacacctagctaatttttgtaattttagtagagacagggttttaccatgttgtccaggctgtctcaaactcctgacttcaggtgatccacccgcttcggctcccaaagtgctgggattacaggtgtaagccaccgcacctggccttctgtagtgttctttgcaaatattttgttacattcattcctgtgtaatcgatttatcatttgatgctattcaagaagcttatttaaagcccaggttcttggccaggtgcggtggctgacacctgtaatccagcactttgggaggctgaggtgtgtggatcacctgaggtcaggagttcgagaccagcccagccaacatggtgaaaccccgtctctactaaaagtacaaaaattaaccgggcatggtgctgcgtgcctgtaatcccagctacctggggggctgaggcaagagaatcactggaacccaggaggctgaggctgcagtgagccgagattgaaccaccgcacttcagcttgggcgacagagcaagactccatctaaaaataataataataataataataataataataaaaccaaggttctgactgggcatggtggctcatgcctgtaatcccagcactttgggaggctgaggcaggcagatcacctaaggccaggagttcaagaccagcctggccaacatggtaaaacctcatctctacaaaaatacaaaaattagccaggcatggtggcaggtgcctgtaatcccagctacaaggaaggctgaggcaggagaatcacttgaacctgggaggtggaggttgcagtgagttgagatcacgccactgcactccagcctgagcgacagagcaagactctgtttcaaaatacataaataaataaaataaagcccaggttctctggctcaacatttggagagtctaagtgagtagttctggagtgagcccagatgggaattttgaaaaagctcctggtggttctgatgtgcagatcccatcctgtcttgctgcactcattatctcttttcaatccccttcagtccccctccctcccagctggcccacgcccataagcctgtgaacatgcttagtctccgtgtcttagaataaacctccccaaacccctccaggtcctggcatcgcctttttctcccattaatagccatacttttaagggttgaccacacctgtgctttcatatttttatactccttataaaaccatgcagcccttcacacagtttaaaattgacatctaattcaaaccatccttacccacacctactcccccctctggtctaccaggcagtctctcttcttctaccagcttatacccctccagcctctgcaaaacagttgtgtgtgtgtgtgcgtgtgtgtgtgtcttttgttttgtttttagagataaggttttgttctgtcgcccaggctggaggacagaggtgtgatcatagctcgttgcagcctcaatcccctgggatcaagcgatcctcctacctcagcctctcgagtagctgggaatacaggtgtatgccaccatgcctggataatttttaattttttaattttagatttttttgtagagaaggggtctagctatgttgcccaggctggcctcaaactcctggcctcaagcaatcctcccacctccaccttccaaagtgctaggattataggcgtgagccaccattcctggcctgaatgatctatttccatccctggattatttctctttttcttattggtgtgtaggagctctttgtaataatatagatattaacttatctgtcacatggatttcaaatgtcttcccattttattattccctttgactttgatgaaggtatcttttgctatatacagttttaaatgtttatgtaattttatatgtgtatctcttctcctatagctctggttttctggtcttagtttgaaatattttatatactctggccgggcacagtggctcacccctgtaatcccagcactttgaaaggctgaggtgggtggatcacctcaggtcaggagtttgagaccagcctgaccaacatggcgaaaccctgtctctactaaaaatacagaaattagctgggcatggtggtgggcgcctgtaatcccagctactcgggagcctgagacaggtggatcgcttgaacccgggaggcggaggttgcagtaagctgagatgtgccattgcactccagcctgggcaacagagagaggctctatctcaaaaaattatatatattttatatactctgaatattgtttacatttatatgtttaaagcatttgaaatttattttcacgattttggtgagaagtagggattccacctcattttcctcctagtgggacagcaagttgggtcaacatcacttattaaagaaagtatcgggctgagtgtgatggcccacccctgtagtcccagcactttgggatgctgaggtggacaaactgcttgagcccaggagtttgagaccagcctggcgatatagtgagacctcgtttctacaaacaatataagcattagcagggtgtagtggcacacacctgtagtcccagctacttggaagctgacgatcgcttgagctgagaaggccaagggtagagtgagccatgattgtgccactgcactccagccttggcaacagaggatgatgccctgtctgaaagaaaagaaaatcgcaaataaataaagtatcatccttcctcacagaattaaaattcaaccattgttttttgttgttatttagacacacggtctcgctctgccactcaggctgctggagtacagtggcctgaccatagctcactgcaaacttgaacttctgcctcaagcgatccacccgcctcaacctcccaaagcactgggattacaggcgtgagccactgtgcctggcttccaccattgttatatattacatcaactgtctgttgggatctgttcctcttctgtttcactgacattttcatcattttcttgaccattcttagaaaggtgttggcagggatcagagtctgaaaactttgtctctcctcgtacccttggccagacaggaatctgtgctgaaggtggtagccaagattagagtgtgctcctggcaagaccccctcctcctgcctgtatggggttgtttttgcattgcatgatcacatgcacgcctctgcactctgcttttctccctcacaaccttggcagcccctcagccccaccaccactctgctgcagacacgggactaatctcattactgtctttatccctgttcacatcgcccatcacaagaagcccagatccctgctcagccctcctccctgcatctaatccccatctggctctgcttcccttctccccacccccagctactgaaactctctgccaagtccccggaactcaggcacgggaggtcttctttgaactcttccttcgccttctggctcttctgacactgcttcccctactgtgagcccaggtggtgactgttttccctccctccctccctcccctgccactgggccggcagatgggggccctccttgctccacttgcagaacatgagcttccccctcttcccccaaacccccagctttcaatctcatgttatttgacagtaccattgctgcagacattccacgactaaattcttcaaggaatgagatgactcctcattccttgaagagtttaggccaagggaggtggcacacgcctgtaatcccagcactttgggaggctgaccccaggaggtcatgacccgcctggggaaaatagtgagattccattctacagaaaacaataaaaatgaaaaaaataaccaggcatggtggcatgtgcctgtggtctcagctactcaggaggctaaggtgggaggatcgcttgagcccaggaggtcaaggttgcagtaagccatgattgcaccactgcactccagcctgggagacagagtggatcccatctcaagaaaaagaaaagaaaaagagtttagcagcaaattcactgtcctctctaacactgctcttgaggttcagttcattcggtgtccatgcaggtgagccttcctaccccagcctctcagtccctccacgcatggcctcaccttgccctgacctcagcactgtccctcaggatcagacctggacaggcctctcacccttgggactgctaggtgctgcttccacctgcgatccaagctgcaggtgcccttccctcttccctccccacgatttcttcctctccattactttgggcaccccctttcagccattttatagtttggggttttggcgatctcctacttttattaaagataggctttttgttactgtacaggattcaccaatatgagatcacttgacggggacttgagctgacatgagcatctatctatttctgtaaaactcagcggcataaaacagccaccgttttatttgctcgtgattctgtgggtcagctgtttggcatggctctgtgggcaagtcttccgctggtctcctctgcagtcactcatgcagtggcagtcatcttgtggcttgactggggctggatgcatgacccaagatagttagcctgattgtctctccatggggccttttgtccttcaggagttcaccccagactccttccctggtagtctcagggcagagagagggaagttgcaaggctctggagagctggctcagaacacccacagagtggctgggtgtggtggctcacgcctctaatcccagaactttgggaggccgaggcaggtggatcatctcaggtcaagtgttcaacaccagccggactgattggtgaaaccctgactctactaaaaatacaaaaaaactagctgggcgtggtgggctattacagccgagcatgtttatgtaatcctagctacttaggaggctgaggcaggagaatcacttgagcccaggaggcagaggttgcagtgagccgagattgtgctattgcactccagcctgggcgacaagagtgaaaatccgtctcaaaaaaacaaaaacaaaaacaaaaacaaaaagcaaaaacacccacaaagtcactgctgccacattctgttggtcccagctgtccagcccaaggccaaccctgatttaagtgggtggagaagtagaccccgcctcttgaggggagttgcagtcaagtcacgtcgcacaggtgcatgcatacagagaggagagggatttgtggccattttattttacaatctatcagtttgttagcttgtgcagttgaggagttagaagtttgcttcattgattgactataatttagacttaataatggcctccattcagtgaacttgaggtactagcagttccctgaattaatgtagaaaaaggactccaaaaatgcaggaagagagaaatatgttgtggatttatcacatgtgacctgcatgtcacctccccattgcatcccctgggatgcctcagagggacacccaaccttatagcattagaaatatgttagtaaggggcgtactgatatccacatgaagctctgtgctggctgcagccgggcatggtagctcatgcctataatcccagcactttgggacaccaacgcagccggatcatctgaggttaggagttcgaaaccagcctggacaacatgatgaaaccccgtctctactaaaaacatacaaaaattagctgggtgtggtggagggcacctgtaatcccagctacttgggaggctgaggcaggagaatcacttgaacctaggaggtggaggttgcagtgagccaagatcgagccactacactccagcctgggcaacagagtgagaccctgtctcaaagaaaaaaaaaagaaaaagccctgtgctggccaggtgtaatctggggagacccactattgagatgggttcccacatttctttcttttttttttttttttgagacggagttttgctcttgctgcctaggctggagtgcaatggcacaatctcggctcaccgcaacctccgcctcccggattcaagtaattctcctgcctcagcctcccaagtagctgggattataggcatgcgccaccacgcctggctaattttgtatttttaatagagacgggatttctccatgttggtcaggctggtctcaaactcccaacctcaggtgatccgcccacctcagcctcccaaagtgctgggaatacaggctgagccaccgctcccggccagggctcccacatttctataggaaagctggagttctgaagtagcaaaggccaagtgtccacatttagtccccaaagacagacatgttggacattggaggatggtaatcaggatggtttgacctgtacagatttgatggtggctaattaatcctagtgtccctaggaataaaatagatgggcaacctactaaaatatcacttgatctatagaacagaaaaatcccaggtctggtggccagcaatctgactttgtttcagaataatagtcacagcctctcacccaggttttggacctaaggcagttcatgggcccagagcccctgaactgaatcatggccagggtccctttgagataaaatcttgcaaaatttcatgtgcatgtactataaatcttctccaaagccttcctcaaaggaccccgcagccacttactaaggtaactgtatcctgggaaaaggaacattctcagactttttggagatgactagattctggctttgagttgtcattgatttctggaaaccatacaaaatagtaggggcatatagggctcagatgataaatgcgattttggctaaagtcaaaagcacagggagtcaagtaggaacacagacccattctgtggttatttccttagttctcgaatgggtacttggcaagtggcaattgaatcctcacactgg

SEQ ID NO: 586 - DNA, 55387 bp, Homo sapiens
ttaagtgcctaaccttctctggtggattttgtatagattttccagtaataagatggttagtttgtcctcatctagagtgctttacccatgagaaagaagagaaaattgctctatgtcagactggagctgggatgagaaccctcaggccctgatttattgctcttcagctttgttccctccacttctgtctcacacagcgtgtggtcatcctgaatcattcgtgccacaaatgtttctggacacccactctgcctgtgacactgcactaggcaccatggcagagtgtttgactacatggcccctgccctctgggaactggttcctgctctatttcagcggggagtgcaaggaggttgctgacacagtcattttaggggtttgttttctctgcgccaaattgccctgtctcattaatgacaggctcaatttccatcaggttccttgatgaatcttgcaaaacatccaagagggagcttccttccagtgcagaaatgtaattccctgtggatatgtgttggcatccgccaactcagaggcataatgaagttaattttgagggaaagcaaacacaaatataacggtgatcggaagagcagccacaactgtctgagccatttatttaatggactaattagcttattaagtactttgcactgtcttcttttccacaaaggatttaaagagatgattgtctggctcaaaggactggttttggatttgtgatcaggacactgagttcgagtcccagttctgatcatctgagctctgcctctagctcagcctgtatggccccagtgtcattaaaccatttgtcttatctactttatgggactgatgggaggataaaatgagataataatacacatgaaagaaccttgttaaagaataaagcgctatgcacatgttagttattatttcagaaaccaaagttaacaagagataaaaatcttaaatctgggaggaatttttctatggagctagttggcaggtcacttctttttctcatttcttctttgtttgcatctcagagaattagcaaccagataggaaggaaatgccattattagaatgtgggctgcctgagtggtggggaggtgccagccgaggcatttttaacagtgtggcttccagggctctgatttgcatacttgcagctgtctagcccactgatgaccacatatacacccaagtgatatgtgtatctatattatgcttcagtttgccaaggcatctttgatttttatcttcaggttcattcttttgggtaaaggcatcaacttcaaacaaataaacagatagctcagaatagtgcttaggtgtgttcagaggaaaaatctcttagagagagtgggcatcagcagaccaggctttgccactaatattcgtattgtcctagctgcgagaggccacgccttgcatctgataggaactggcaagtagctcagtaggttgtattttgagaaatccatcttagaaatttcttatttgaaaattaaaatggcacacacacatacatacatatatatacatatatttttttttcctctctctctctctcttaaatttccagtcttttctgtttgtccaccaacaaataggtgtttaccaattggtttttcatcaatattcttcaagtgtttctcgaagagtggtccattaaaagtccacctttaagagaatcgcctggcgcgtttattacaaattcagacccccttttttggacccatcaaataagcctatctgaaggaggggccctggaatctgcattcccaaaaaacttcccaggaagacatcaagcacactcaagtttaggtccccttttgtgaagattgtctacaagggtttggtagttctattgctatttctctcaggttaagtttctgggccaagactcttgatttcattttgggcagctggaccagctcatcctggttacacatccctgttgagctttgggagatccttcaccaatttttatattgctctcgttggcctgaatatcactgttctttccagacaggacagaagcaaagccggagttggagagctccgctttcattttgtcatcctccaaatgtacagaatcgacaacagcctcagacccctctcagattgtgtagttggtcccatcctaccacaatataccctcctttaactcttacattgtcactagcctcactcagtgtggatcaggatcagggtgaccaacggtcctttttttttttttcggactctcccaattatagcattgaaagttccatgccccaagagtcccctcagtcccaagcaaactggaatggtgggccaccctgtcagggaggatattgccctccttgacactctctttcctgttaagccaaacttgtattttcatgtttgatttaatgttcatcttttgtacctatctcttacatattcccctgagagcttcctgagcaaaaatacgggtttattcaactgaatgattatttttattaaagcaggtagagacgttgcttgacttctgttgaatgaaggaatactcaggactccccactaaacatcctgggggtagaagcaaagctgctccaggatttggctgcattttagtcccctgactttctgcatccagcaacgcatcagctgttttgctttccttgtcttttagtagggttatccccttaacatcttaggatattttgtgtcattctcttagtcaaaagtaggatcaatgtggctaggatttgcctgcaggtaggaatggaacccaaacatcaagccagctaggccttatggcgatgcttaacaagacatcaagcactcacaagaagacccaaatattgccaagtttatcccatgccttctactaatacacccctccctgtgcctctttctctgaccttctgatgtgggtggttctaatatcatttggggaggagactgaaaacagaagactattgccttgaggtaaggaagggaatgtcttgagatttgtatttgtcttggtcaaaatgtacacatttccagcagacttgggacattatgttatctgtctcctctgtggttctttggtttcaaatggatagaaaggtctcacaaattacttcaagccaattccacttttgtccatacacccagcacttctattatcatggctgcaaggcaatctgaagactccaagataggtcagtagaaaagaggggaatgtcagtatgtagaaagccaactctaggactggcctccaaggaggagggctgattaaatgtcatagtgacatggctgaactgagattgaatgtgtgttgatgaaaacatcctaagataccaacatggtggctgaaactccgcagcaaaaggatctgggcagaggcatattcttcgtctggagggtgggtgcctctgtgtctaggcacttttgtctgttagcagcaaaacccgagccagtagggaggcgtatggtgaagagtctcctgaacctaggctatgttaataggcctggatagaatgttgtgtttttcaaaatcatgaatttctaacactccaccagctgcttatcatcgctacaggttcctaagggacaggggcaaggggaagacgctctatttctgactcaggttctggccataattacccatagtcttccctatggcagtgggctgggtcatgtatgaactgtaaggaccccatatttctcctctaatccaagacctagattaaagtcaggacactttgacatatcactctgacatgaggatgcacacaaaaagaacccaagagaaagagaaattggccaggttcatgcccatttaatctcctcccatccaaagcttcactgcctaggactgagattgactctgttctgagactccatgatttcagaacttttcctcttggaagcagacagagagtgaggggattgaagaagccacttagagaagagaagccttgaactatttctacaggtgagggtatcagtaacactgttagggtttagacctgcgtcagtgggctgtgattcagagcagggcattcacccccatggaagtaatgggatatggagtagcaatgattgagaggaagaggctaagtttagtgacttggtggacacataatgatcacctaattcctatgagccatcagcttgtatgatgatccaaactaactccaaacatgcctattgattaggataggatttctaatttactgcccggcttcagctggctcagggctacagtaggtctgaggtgttaatgaagggtgttcagttcctacagggcatgaggctgaggcagaagaaagagttatagtacctccagaaagatgctgtatgctctctttctccactaggaagacctacatcagttttttgtagcttacctgcttaaccctcagggtggatggagaaaagaaagagtaatctgtagtgattctgcaatgacatccctgatatacctgggagagagtcagattttcatactgcagcaggaccttctgaaattaaatgctcattgcagaccccggtatgtctttgactagttgttacccagctattctggtatgttgtttgaacatattggtttcttgactaaacttatttcgtttaatacattttaacaatatgcaacaatcggtttgacactggtttggacaatcagaagggatgcaaagatcaaatggaacgggtgccacctccaatcagcatgctatcaatagcctgtccaatcaaaacagaagctgagcagaagcaaccaatgcatccacataagctcagaccagctgaggagcagcccagtccagatgaatgcttggaataattaattccaaaggaagccttctactagaaagagtttcaaaaagtatgatagacttgttgagtttgtggttctgtaagtccttacaagagctttcttgaggcaaggcttgtcttagcatattgcatggctttatgtagtgaaatatcttcatggagggtaaggcagcagctgaagtttggccgctggccacaactcttccgctgcggacttgtgagcaaatgtgtatatgggatggaggcagaaacagaaagatatatgccaagattgtgcttgaattccctggagacggcttggaggctgatacactgacattcaaatgtgtgcactcacacggcactctatgctggttagtgctgcctgggtaaagggagctgggcccaggcagagctagcggcagtcaaaggcattgttcattgtgttgtgagtgacatgaaatccaccatttgacagctagcccacatagctgtggtgataggaaaggctcactttagatcatgcattccactgctgtgcatggattaatatggctttgaaagggcttttctttctttctttcaaacttaatacgggagtatatgaggaagaacatggtagcaattagctgctgctatgaattttatgagcagtttgctagaaaccacattaatgactccatgggtagtgcagagatcagttttgttatattattttttctctttttcacccctttccctcttaaaagaccagcctgaaactgcaggatggtgtcaggcagatggtcctaatagacaaggttttcttttccaggataggtagcccaacacaaccctaccttggatcttgtactgagtctgctggtgggtccagccctgtttctaaccctgcagcattataaagatgggaagtaatctggcattggttctgacaggtggagcaagactcttgcaggaaatgtccacagggaagttgctaccaaggagggaaaaaagaaaatcctgagtgtttctcaatgttagcaatgggaataagaataaaatgtgggcattagctaggaaaaaaatggaaacaaatagtctttatatattctcaggaagcatggagatggtttctaaaatatttccccagaagccaagggaaagggtgggtattggataaagggactggatgcaggaagcaaacagggcacagcttcctgggaatgtgtgatgaagccaactgaggtctgtattcaaaaacggtttcaatgtttgggtctggaatcttgaaagaaacaaaaataagtttgtgaccaagtcacaagccttgatcaagtcccgagagaagcacctgtaaacacaaagcaaattaggtgcagtctcagccacaagagtgaatcagcaagcaggggaggttaaatggaaaaacaaaatcaaaacaaaacaaaaacaagcaagaaataacctcattctgctagagaaaaaaaaatagacacagggagggttgcagcatagcttttacttccgattcttttctccaacatgaaaagttgacaaccaagagctctggaagtagagccaagaaggtaaactgaggccttttctgcaattagacatgggataggccctctgtgatgagagacgtaggaatatcaggctcttgagaacaagcacttgcaaatctttgaactgaaaattatggctttatctccaggaagctctttggcttttgactcaagcagagattcagatggactataaatggtaagctatggatcgatgacataatggcacctcattaacatatttttccctaaaacatacaaaatgaaagtgattggttagtgctagtaatttcagatgttttcatgaagtggtatcttttggactgatatgaagtagaaaattcatgacaataactctagggaggtttgaatctctaattcgcttggatcccaggcacatctgcttcttggcagtttgtttgaatgatgggaatgataccatcaaaatatcatctgagagaaacatgattaaatggcctgtttcctgacatttcctgatgaaaacattgttttagctcagacatgaatattttaataatagagaactagactcttaataaacttggctccttggaaacattcccccttttaaagactttttgatgtagtttgggactttttagaatgggccgtcttataaaattttgatgcctcagctaaattttgtcagatttgaaggaggctataacaaacgtgtgtaagagtttaaaaagtatcattggtttaaaatctaatcagtgaaatccaaatgtaaatgtgattttaaacataatcaccctccacctcctctcaaataaagcaaaatcaaacacaaggtcagttttaatagaaaaaataacttgtggtgggtgcatgcgctctcattttattttgttttttttttttaaactgtgcttgtatgttatataaactctttttgatatccttcacaaagaaaaaagttaaaaaaattaacttgttggaactgtaagctaaacctccctcctacacgaacatacacaaactcacacacacacgcacttagttagtattagtcaaatcctcataaaattttgagttcatgcctctacaatttgagtgacacagagtcatgaaaataatgagttagaaaccagcaactatgagggaaagctgaaggcattggcgtcgtttaacctggagaagacaaggacccggttgatcggttgatttaataatggtctcccagtttatggcgggttattatgcagaagatggtgtccatctgtttttcatttctagtgaagacagaaaaaaactgagaggctagaattgcatcaggggagattagagtgagagatgaagaaggtcttgtttgatagggttgcgagactggaatgaacaaccaaggaggattatgaaatccccatctttggaattcttaaattaatgtgatctgcatgaatcgatgcggtgggatggttttgttatctgcctgctagccagcagagggatggcggagccaatgattctgtaggccaagtctcctggtgcgccatgattctttgagttgagtgtattgcctgtggcagggaatccagtgtgcagagccaggagcctgctgccctgtggcagggctgctgcgtctgtgcgctggggtaagctgacacttcacgttccttttgactcaaatggctccaaagtcgtttaggatctttctgactgccaactgccaccttgaaataggaaaagtattttaaacaaatcctccaggacatgcaggcaaagtatgcatttgcagtactcagaatacatggtcaccggacacctcctagagacaactgaaaactattagcacagcaggaaaccccacggaaaaagaggtgggaaacaggaagatttggatattaaacttatctcctccctttctcattttgagacatatttttgacacaaagctaaattttcttgatgagcagatttattcctctctctctccccctctttctttcattttcctttctttttctttctctcttaagttctttcaagctttttttttttgcttgaaagcaaaatatctcaagtatgacaattaagtcttatggatgctagaggtaaaccctgagaatttgaaggaggcaattaaaatttttttgtgtgtgaaaaataaaagtctggtgctttgctttacttataaaaggatactcttactatgtctgttttaaatatatttcttaaggtgatgaaacgtcccagggaacagagctgtatgtgaagagatttgtgtggaaaggaagattttagaagtttttttcatctttcttaacatcctcccgaagcagcccaacctcacacttcaaaggagcagagcagaacttttacctaagggaggccttgcctctcccagcaggcttggtttccataccatggtttttctggaaatgtcctctttccatacgctacctctgagtcacgcctcattgagagtgatgattatgatctctggacgttcggatgctgctgagaatcgggaggatattttgagccgtggaattcgggctctgccacatgtttggattaacaaccagttaaaccttgctaaggcaatatttttctatgcagttagtttttataccaaacaaggtttgtagtaattggatgccctacttgagcaaaactgtttaccagaaaataaatcactcctggcattaagaaaacacaagcccagggattcgccagcgcagcatcatcccgttcatttctcataaaactagccccaaacatgtgcattctcatctatgatgacttatgctttgaattgtggtctctttatttccatgcccattataatgcttacctaaacatttccctctgtttagctgcggtgcttctggtaatgacttctatttggctgctgggaagcatttgccaggagagagagagagagagagagaagagaggaaggtggggggagagagagagagacagagagagaaggagagagagagggggagaaagagagaagggagggggaaagagagggggagagaaaaagaggaggagagagagtgacggggggaggaggtggggagaaaaagggggagacagagaggtatagagaagagggagggagagagagaagggaagaagggatagcagaaaaaaaagaggcatacttttttcataactggccattgaattacagattattaaaatttaaaacaacttcaggttatctaatgtactttctgtgactggtagatgaggtcaggaggagcatgactggccctaggtgacataggaggcagaaaggtgggctgtgagctctcttgacctttgctctgtcctgaccctcctaccaccccccagtagtcttctttttctctggagatcttggatacctaaagaggaattttaacaagtaagctaggtaggccatgctgtcttaggaagagaggatggaaccgagctccagctagaggtttttccatcatgataactatgagagtcagcaggtcccaagaagcaggaccacatgctggtgtgtggttgtgcctcttataaatggtcctgctcaaattctggcagtcacttaaagccagtcaaccatgtttgaggaagtgattaacaatgcaaatgtcagggcaaaacaagaaaatgatcaaaacatgtgagattttcagactttgagcattttggtgaaattcttatagaaaatggaagaccagcctcccctttcctgtggtctgaatgtttgtatctccccaaaattcacatgttgaaattctaatccccagggtggtggtaataggatatggggcctttggaaggtgactaggtcatgatggtggagccctcatgaatgggattagtgcccttataaaagagacctcagagagcttgcttgccccttccaccatgtgagaacacatggagaaggtgccattgatgaaccagatagtgggacctcagaccccaaatctgctagtaccttgatcttgaacttcccagcctacaggaccatgaaaaatcaatttctgatgtttgtgatctacccagtttatggctttgttatatagcagcaagaacggcctaagacacccttgaaaaatgacttatttattctattgagctcaagtcaaagctaatagctttggtcatttggaatgactctaatttgctttctaccagtgggaaggcctgattcaagtcaattttgttcataagtcataaatgctttaaaagggaaaatgcaccccccaaaaaatacaaaaaatttataatttgcctccctcatggcttcagttttgacttcagtagattgaagtatttgtggaatatttactgctaatgtgtagttttgacaataggaccaaattcatggttttgagagtacataaagaagttgctaaggataagatttaatcattaatgaagtgaacatatttttcccttccagtgagacttttttcttcattttaacagtgcattgtagtttgtcagaggaactggggtcatgaacataacttcaaaggcgtttccccagttcacttatttcaatgataaagccattcacgtggaaccatgtctcgcttggattctagtgttgaaaccacttcttcaggtccaatttgcatagtctagaaattgcgtgaaagctgggacaaaattattgaaccaaccacattgtgtagcattcttctttgcaaattctaggtaatagatacacttttgaagaaggaatctatgaatgaaggtcagaataaatcattttattatgcaatatgctttagatgttcctactcccataaccattaaacagtaacactcaggtccttgctgtgcataaagcagtgtgagaaacacaaagtgcgacacacagacctgaataatagcacccggtcccttccctcaagagcttgcacattgcacagggcagagccactattttttttagccttttcctcttggtgacatcatgggtctggtcagaccatgaggcctgcaagacttggctccatacccttctctctaccttttcgccaacttcctatgtcaaagcacctggcaggataactgcaatggatggttgggtttcttaacctatttgaccattactgaatggtaattcagtaatgaattacctgaatattactaggggaaatcatatgaaatctaaatttttgtaggttagaaacagtcaactattgacaatttcatatggttcaatcaaatatttagcatgttgtatggagtgaataattcgcaagcttttgaaagtgcttttaggtttttccaagaattcatcccctaagactctctcagccagacaggctgagtgtcagaggctgattcctccttaggttgattgtttctgggaggtgagaagtgatgaggtttggttaattccagctgaggtgccctgaactgggttgcttttagtaggaaaggtattttcaaaacccgttgtttgctgaaacaatctgatttgtgtaaatacatcataagaatttcatagtatataataaatacaactatgtgaaaaggtttaaatagctcaaaatgacgtgactttgtaaggccctgttttcactgtaatatcttctgtttaaactcatgtttcttagtgctgggtttgaatagcacaaactgatttcatttgtattttaaacatccattaaaaaaaagaactcaagtaatggattaatcacgtagatattaaaccaaaaaatgaaaaggaggaggaggaggaggaggaggaggaatgaaagaacatttaaacctctgtgaccccaccatagaaagggctgcttttaatattttgccaaagattcttctagacttttttccaaataggtactatttggaaaatgcaaatattcttgggaagctgaggggaaactattaatcatgcataatttacttggaattgatttaatcaaatgtttttagaactggaagtgactaaaaataatgtagaccagtcctcaaccaggggtattttaccccacaggtgatattcggtaatgtctggggacatgtttgtttgtcacaacttagggatgatcctggcatctactgggcagaaatcaaggacgctgctaacacgttgtacaaacaacacacatgacggctcccacaacaaataattattgggtcacgaatgtcagtagtgccgagggtgagaaagcttgttttagaccagcatccttattttccgagtaaaaagtccagggctagaagatggtttgcacaaagtcaatcagtcaattggtggtagaagagagatgagaacctttgtcacttctgccctgtccggggctattttcactgcactgggacaaatggaaattttggtagccaaagaggggctcaggaaagcatgagagtataattctaaaacagggctctggggggaagatagatctaggtattgaggggacagggcctgcaaacagaaggagaaattaaataggtaggagtacagtgagatcattaggagaaagttttagaggaggcccaaaaagagcaatggagctctatccctagcaaatatgacttgctaagcaagtttatatggatgtttccatggtgtttgtatgatcacctcttcccagtttgcttggaactgtctcattttaatactgaaagtcccatattctgggagcctcctcagttctgggcaaaccaggatggttgttcatcctgtttcccgttccttcacataaacatacatgagcaaaagttattctgccaacttcatactagtttggtgaattggaggatatttggtgaagaatgtgtgggacctctctgtacatttctacagcttcctgcgaatatataattatttcagaataaaagtcaagaacagctttgtgaatgagacctaagtgaattactaaccttctctcaactgagactacagggaactttcatgtggccagataggatgcccagagtagaaagctctttataatgatatcataggctgccacaccatcaccataggtgacagcttcatgggaacctgagaagggcagggaggatggcatttgggcacagtgcagatagcgtggttggcatttaggtatgaccatagggttacttaatcttgaagtagtacaagtcttcttgtggtgggaaaaagtatatttttgggaataagaaggaaggatggtttatacaataaaaaaattaggaagtcttccttgagggagtcattcattcattaattgatccattcactgcaatgacaaacagtctgcttagtgatagaaatcaaaagttgagtaggaatccttgtcttcccttgaagggtttttggtttgtgggggctgaaagaaagtcagtgaagaaaaaagtcttgtgtttactttagcaatgtaaaatatacttctttcataagaaaaggaagggaacattagttgaataccttctatgttcaagaatataagttcttgtggatataagttagaaatctgtgtccgtgtcttcaggtaattaaaacaactggactttacagaggcacatggggttttcaatgtatggaaataatttaacagatattttaatttaatggaatttccatttttttaaaagaggcgtatccacaaattggaaaatatcaagtaaattatctgatgggcctgggtatctgaacactgggtggcagtttttgaccagaagacttctcaatccattccactttttttttttttttttttttagcattttaggttaaatcttggagaatttttgtctaattttccactagggatcaagtgcatatgatgcttacacatagccagagaaggtagtattctacatggtttgatttcagtatggctcctgaagtgtctcaacctattttgcctgaagcttgtgatgatgttctcagtgttatcgagcctttcattttactgttatatgtcttctttcctgagaggaggaactctggagatgaattcttttttagctgcaaatgaatgctaccatacgtgttgccaaaagagaaagaaaagtatactaagtgctaagccatagcgaatgggtcaggagagaaagggaatcaggaaacagatggtaatgggggaaaggaggaagaaaagcataaatatgctaaaacaggaagtactggaggcaaatcttgccctgtttctcttactttgagaattgccggagtggtcaggaagtcagagctgccatcttgttttcagatgtgcctctttctagggttttatctttagttttatcaaaggaggtacagctgggagagcttttaaaaaatacctaccctccagccccacctccagagagtctgagtcagtaggtcttcgatgggagggccccaagcatcagtatttccttgaagtaccctgggtgacagccatagttgagaacctctatctagaatagtcccctaattttcagatgaatagatcatgcccaagagacattaggtaactgacaaagggccacacagctaaactccgaagtacatctaggacctgagtctcctgcttttatgtaagaattttctaataatatatttagaaactcccaagtttaaagtactaagctaagcttgctctggatgctagagaagtcccaaatctttccctaatgggcttctttttgttgttgttaaacatctcacatggtgcctggcacatagtagcacttaataaatacttgctgaatgaaggagtgtggcttatgtttaattttctccctcacgcccaccagaagcactgaagtagtactgctctaaggtgctaatgtggaatggaattactccccactcagtccctttcttagaatttgttacttctttgtgactcaacctatgagcctaggattgagtagatcatagcattcgaggggattttcattaaagaaatgaagtagcagttggcttttcggcttcaaattctttcccttgttaaagaaactgaaacattatcttgagtagaattggctatttaaatccggctgaatggttttccaatagaagtgattgaaaaaaaaacatttttcgttttttggaggaatttgttccattctgtcttgtgtttcattataaacagttttttaatagcaaaaattattcttcatgccataaatgtgtggtgaatgcctcccaaccatatttccacatagacctcaggtctttgccagtttttctgtatgtagagcccccactgatgatggctcagaactgaaacccaacctaatgctactaaactcctggattgagaagggttttaaaatcacctttggtggtttacacagaaattagcccaggtcctctggcttctctcctttcctagggttgttgatgatgtaagacaaagcccacttcatgctggagtgtatgctcttgagggcaagggtctggtcaatttcctcactttatatccctcactcaaagcaaatgctctacactgtgaaatgtcaatgcaggagaggaggtgacaatgcccttatggggtgcaaattaattcagggggtgaggatgtgaaaaaaacttaaggcaatggtttgtgatccttcaaagggccatagtacataaataaatatatagtatatctatgccattaaattttcatggggatattgggggaaatatctaaaaagactttttagaggggtctaataatgaaagatcaagagacactgctctaaacgcatctatcaactgattgaataaatgtaatgttagaggcaatggaactctgtgcctccactttttagagctggacaactgacatgcacaaagatgcctatgttaagagacttagctcactaccgcaacattttgactttagtttgaactgttttctacattttcaatgatcactttgagattcaacattaaaccactggaatcaaggtctccttcttggtcttttgcctatttgggtgtgaaaatggtagcaatttctaacgggagcaactggacggaaggtgaggaagctgggtacccgtgacagtggcagtgacatagagcagagcacagcaatttccctaggaaagacccaccaactctcttttagggagcatctatccagaggcgcgttagcttcttacagctctaacacttaccagattttgataagacacgaatctcggtttcctcctttctaaaatggggacaaaagtaggtgatatcatggccaccttacagggtttgtggatcatgcatgtgagcaaactataagttattaattttagcataatcattattattatcttgctgattgaaatgttattatgaatagatttcctgtgaagaagcaagaggatttgaaggaaaaagaccttttcatgcccatggcagtcggggccctagaagactccacacgacactccacatggccccacttagatgcaagggggcttggaaatgagacacctggttgagcagtcatttctcagagggaaatttgtataatggaaaggaagtactaggtggacagctaacagtctctgccacaaaagaaaataattttaacctgtatctaattttcctagagcaaggatacctaagaagttaaatcatcctagaagggttcccttgaaggtgttcccagtttgcagtcttgttcctctgtctttgtcctcaagtcactgcctcttttcaagagtactttcttctttttacttctgttgtgtaaatttctacattgttgggaaatgccactctacctatagaaacttctcttaccataggatccatccttttcccgacaggagttttcccctaaattggatttattcaatgtggaatcatctgcccccttgagaggttactggagggaagtaggatagcagccatggtagtctttgacattccaagacttttagactaatccacgaggggtatggacgcaataaatgtggtccccactgagacttttacatcagggtgaggaggagttacactttcttatttttctagttttctgggggtatttttagaacaaatacacacacacacatacacacacacacacacacacacacacacacacacgaatctttggaggacaaagtttaattcttggcctggcgcggtggctcacgcctgtaatcccaggaatttgggaggctgaggtgggcagatcacgaggtcaggagatcaagaccatcctggctaacacggtgaaaccccctctctactaaaaatacaaaaaaaattagatgggcatggtggcaggcgcctgtagtcccagctactcgggaggctgaggcaggagaatggcgtgaacccgggaggcggagcttgcagtgagccgagatcgcgccactgcactccagcctgagagacagagcaagactgcatctcaaacaaacaaacaaacaaacaaacaaagtttaattctcagtgagggacagaaacactttcctaatcttcctaaccactccttaacttggtagactgcttctcttatagaagagttagtaatttaaatgttactgcaaaataatattgtttgttttcattcatcatttttatgtactccatatcttcaggtaataagaaacttgaagcgttggattatcatttgcaatagcccaaataaattcctagatgaatgccatcctcttgtccaatccccatagggcatctgaatagtttctttcttccacttatgacatttctgtgtcctcccaatgtacttccccctgtcatgcttattcatgccccagtgccattgcctatcctgttcgcctggccaggaatgctctttgaataattcttttatcctgcaagacccaaccccagtcccactcctccataaaacctttccctacttctccagcccacactgatttctgtctctgacctttcattacatttcccagctttgagtgaataattgttctgtgtattttctctctgttgtcaaggtggtatttgcagatacacatactaagcgctatataaaaacttattgactgaatgaatgttgatgtgagactagaagcaagagaatattcttggataacagatgggagatggtgtttcctaaaactcttcaaggacaaggaaattatcatatataggtccttattctcactacttgtagaactttgagaacttatctaacttctttaagtcttcatttatttgtgtataaaacagagggaatgacaaccactttatccaatttttggaagactcagaaataatctaggaaaagtatctagttgagtgcctggcatacagtaggtgctcaataaacattcattgtcattactattattgttgttgctgacatcattgttattttccacagtgcctagtatagtgctgaatatgtgatatcgactgactctttaatcctggatgatgaggttgtacagggccctgcagtgtccttcattgctctgaatatttctgcatgatcagttcacagtccaggaaatctgttgagggaaacaagttggaggagaatcacaaagatccagtagaagtgccatatccaagccccacagcctgagccaggtagaaatgaaaactttctcactgaattccctagactggcatgaccccagaccttagctcagactacgtgaggactgtgataaactggactctgaatagtggctttcatgaagcagctcagataaaaatcttactattcaatttttaaatttacaacttagaaattctagattggttgacattggctcaatactttaaaccagctgatggaaagaaagatctgttattgatttactggccttcttctcccccacccctttcctctgagcactgactaaaacctctccataacaagtactgggggcctcacagtcttcacagcactgacggtgggaggaggagtgcaggaagggaggcatttgcatctcattgctggcttcaaggttgtgtcccttcttcaaacatttgctgtttggggatccaccattcttctccatcctgggacaagacctaatccagcagtaggaccccaaaacacgaatcaggccgggcatggtggtcatgcctgtaatcccagcactttgggaggctgaggtgggtggatcacttgaggtcaggagttcgaggccagcctggccaacatggtgaaaccccgtctctactaaaaataccaaaaattagctgggcatggtggcaaatgcctgtagtcccagcttctcgggcggctgaggcaggagaatggcttgaacctgggaggcggaggttgcagtgggccaagatcacgtcactgctctctagcctgggtgacagagcgagactctgtctcaagcaacaacaacaacaacaacaaaaataacaacaaaacgcgaatcagctaacctggattctgtttgggctgggctctcccaacagctcctcttctacctccgcaagttacgcataccttagtggaacccttcaccagacaaccttggcaatgccacccacagaaggaagggtctagggactggactattcctatcaagtagttaaggttatggggagaaggagaggctggtatagtctttaatccaaggagcctcacactttgtctgctctaaggggctaagactaatagaaggcacaacagaaaaatgacaatcattaaatgaataataattgagtgccacacaccacgcttcgtacttggcctgtgttatttatttttcataacagtcctggatattggaactcactatcctgaacaaattaggctgagagagccagagcagcttacccaatatcatgtggctggtaagtggcacagatgagcagagctttctcctatgcttcatgagctctcgtaggaatgtacttcttgggcttcctcgcctcactcgggatttacagatcacaggacaaattgtgctcagaaggacctggtagaagaacactgccctgtgacgtagaggcctgggctctaatcctgcttctgctggtatgaactctttcactttgtacaagtcaaacaaatattgtgggtctcatccgtaaattgagggagtggaatgtaaacatctctggaaggtttgttccagctctgtgattctacgaactaatatctaaatacatttacaggaataacaaaaacttctcccccatcctaaactcagttatccagcagccctattcatacggaatattgggaagaactagattataagcaaaactgctgtcacaaaatccacaaacatgaagtcatgcccttttgtagaattaggccctttctctaagcctgtttattcatacttttcaaattactctaagaagtttcttccactcggccaggcacggtggctcactcctgtaatcccagcactttgggaggccaaggcgggcggatcacgaggtcaggagatcaagaccatcctggctaacaaggtgaaaccccgtctctactaaaaatacaaaaaattagccagccgtggtggcgggcaactgtagtcccagctacttgggaggctgaggcaggagactggagtgaacccgggaggcggagcttgcagtgagccgagatagcgccactgcactccagcctgggcgacagagcgagactccgtctcaaaaaaaaaaaagtttcttacactcaaaatgtatatgacaaattagaaaaggcatgaggagaagctgacataaacaggaacaaacagaaaaatgaaggaggaggaatcattttaaaaatacctaaggaagaaaacaggtgcagggccagtaagtataaggaaaaaacctccaatcatttcaatagacccttagggaatctttgcatcattaaaaacaagacaagcatatgatgatgttcacatggatacatttgaatcaccaaggaaagattaatcaatgtgggtaaactctgtttaggaaggaaggaagttgtatattccgttttagaatgttttccatttattatagttaatatttttccttttcaagttttgataccttactgggtagactctgaactctagaaaaccctgaagttttggttaactattgctgcataacaaagcactccaaaatattgtggcttataacaacaaatattttactgtctcatgatgctatgggttaaatgggctcagctgggagattcttctgccccacagaatgttggatgaggctaaagtcatctgggggcttaattgaactggaacatcttgaaagcgtttcctcacatggctggtggttgatggtgactgttgtctgggagccctcctggggctgcacccagagtacctgcacatggcctctccatggatagcagctgggttctgagaagagcagtcccaagagtgagaattccaagcggaaaagagaggaaattgccagtcccctaaaaggctgggcctggatttggcacagcaatactctggccatatttgataagcagctgcaggacaaaccaggtgaagggaggggaaataaatttgagctctcagtggggaaagtgacaacgaacttgtggctgtatttaatctaccacacctggtctccagaacaacttttttctgaggagcttggaggactgagtttttactgtgcttcattttcatgttgtacttttgtgtttttcaaaacactttgggaaatatgttatttgattctctttttttaaacacagaagctggagagattcttttaaaaccccaggcaggttatgtcactcctctgctcaacactctccagtggctcctgtctcagagaagcccaaagccttgcaaggcctaccctattcaattccacgtccttctgaatccagtctgcatccctcccagttgctctgcttcagccactctggcctcagggcctttgcactggctactccactacctggattactctttccccagtgatctctcagctcaccttcttacctcctttgagcctatatctcaatggcaccctcttagagacaccccttttttttcctcagcactcctcctaacccttctaggctttgctttttgccaaagcccttagaaatcccatatgttttgtttattcatttatttatctgcttctcccagtggaactccagggagagggagactttcgctgttttgtttactactgcacccccggggactaaaacagtgcctggtccttagtgatgattcatatgtgtttgaatgagatattgaataaaagaatgagttctcattatatattagtatttatgagtcatggtaagtgctgtgttcttggctttacggatgaagaaacagagtcccagaagattttgtgacttgtctgaggtcacgcagcttgtggtagagccagctttagaacccaggggctatgacctgcagcctcaggtcttttgggcaaccacttcctgcatttccatgcagctatttccaggcaggcacatacccggctctgacacggactctggacaggctcaatatgcagatacacagtctttccccgaagtgagaagagggtaccacactgctgctgtcatttcctggacagagaaatgtgcatcttgcccgctgggttcagagcaatagtaattacgagagtctggagggaagtgagaaaaggtatcaggggcatttaacaaccttcactgacctgcaaattattatttacagtaacacagagcatttcctcttcagaggcaaagatgtagaacatatcatatatgtgtctttctttttttctttcttacttttttttttttttttttttaaagaagactgacttctcacagtgctctccggaagcagacagagaagagaaagggttattgggcaggtcagaacggacttacccttaggagatgaaaggaatgaatcttcactgtactttcttaaattcctccaggaactctatgaagatgatattggaaaacctgagaatctcactgtaaacttttgagaggctgggtcgggttttatttaacatgcatctcctgttgattcggcacactgctttgcaacagcaggtctggagaagtgtgttcagattgactgcctgggctgggaggggctttggttctcatctcttccaatctcgtccccaggatgtagaccatctgctcattcctagactgcagctgccaaaccaaaaacacgtccactgactggtagctcattacctatcacagcagcccttctttttatactgcttatgttgaactactgtcttcttcctacaagctccacccttcaggtctagttctttcttctggattgacagaggataaatctactatgttagtaacagataagctttcttacatgaaatagagcaagttctccttatctcactggctctaaaaagcagaacttggcacctagcagtctgtgaaagcaggagttccctgagagtcctcccacagtgtgtgtgtgtgtgtgtgtgtgtgtgtgtgtgtgtgtgtttctgcgtggggagtgtgtttctaatgtggtggtgcagagtttgacattggagtcaagcttcttgggctcatttccaggctctatcacacagccctgtgacttggatatgacacttagcctctctgtgtctcagtttcttaagctgtaaaatgggaagaataatagtgacaacctgatgggattgttgtgataattaaatgtgcaaatgccgtgaagcattagtagagtgccaacctagcatatactgtgtgccaatgatgcagtgtctttgggaggatgttctgcttctcatgggttataacaagcagaagaaagccgtggatctgggggaattgtcccttgtccctggtgccttctccttcagtgcttctctgttttcctccctctttctcctcccctatctgttcccaggccgttctccagtggtctagtcccagtatactgttctctaagctgtacagctgctttttctatgcctggggacacttagactttttcacagggaaccagggagatccacaattcttccaggtgcaaaggagtgactctaagggtgacctctcagtgtggtgagtgggaaacaggtattcagggaactgaaagtaaaacccttcccagtacccctcaccccacaaccacaaacactcacctacttggaccattgattgtgtgtgtccatgaagtcacatcttcctgccacatgttttaaacttgacattttctacctcgctaagttgtgacaaatcctttgatatggccgagaatgaattgctttaaatttagtcggaattcgtgatacatcacatgaaatgagaagaaagacaacctgatcaacaaatgatattaatgttccaaattttggatgggtttaaaactaaacataaagagaggaaactgacagtttttgtttgtttgttttttgttttgtttttttgagacagggtctcgctctgtttcccagtctggagtgcagtagcaagatctctgattactgcagccttgatcacccagactcaaaccatccacccacttcagcctcccaagtagctgggactacaggcctgtgccactatgcccagctaatttttctacttttagtagagatgggatttctccaggttgtctaggctggtctcgaattcctgggctcaagccaccttggcttctcaacatgctggaattataggcatgagccactacgcctggctgaaactgacatttttgagggcctgttttgtaccaggccctgtgctatgtgattagcgtaacccagggaggggtagtagttgtattctccctattttcaaagatgaacagtgagctgctcaaggttcacagcagtcacttgagcattccaaccctagtcagtctgcatccaaaagcagaaggttttgggttgtgcaggcggaatttgaagccaatgatcaggagacttggtttctaatcacacaacagggctgggctactatttctttctttcttttctctctcttttgagatggagtttcactcttgttgcccaggctggagtgcaatggcatgatctcggctcatcgcaacctccgtctcctgggttcaagtgattctcctgcctcagcctcctaagtagctggtattgcaggcatgtgccaccacacccagctaattttgtatttttagtagagacggggtttctccatgttggtcaggttggtcttgaattcccaacctcaggtgatccgcccacctcggcctcccaaagtgctgggattataggcatgagccaccgcgcccggcctactatttcttcacatataaaatgagaatgggaatgataatatccacctcacattcctcctggggtaggtgaagttgctttttaatcatttaccttaatttatttataacagtaatgcatacacatgaacaaaatgtggcaagggctgttggagagtatgtctctctgccccagctctgagctcatgccctggatgtacactccttgaccatgtctttttacttctggtaattcccaccacaaccttagataattcctttataatctatttcttgaaattgtcctatttaaactgtatccactccccctactatgacagggatttttagcaactttacactgtctcatgtcttccatggatttttgtacacactgctattatcctcattcattcttgtggctacttttataggtattaaacaacctacttaaatcttcactttgggatttgttaactgttaggaggaatctattggcttgtgatgggaatggaggtgctgctagggctgagaacatctgtttggttcctccatacctcactgggcctggaaccgtcctgacacaggcaggcgctggaatatccgacaacagcacacccgcactccccggccctcaccaccttcccacctcccttttctgagctgtaacatttccttctgcctttacttctggtgtatacaatttatattctaggtcccccaagttttgtctgtaggctaatttggaaaacagaaaagcaatacatgaatgtgaagtattctgtttatgaaaattttatatgctgccaaaccaagtagtatgaccaaatccatatcattgaacagggaacagtgaggggaagaatgttcccaaagccaagacaaaatggatactctttttttttcacacagaccaatgccatggccgccggttgctctctgaggaggagggcgggcagttatgaaacttggaaaggcctttcattaatctccccacagtccatccctgcttgtggccccaaggctctgatctgggagcctctgcagggctttgctgggaagggcggctctacctccaggccagttctccccctgcctgtggttctgggatgtagatttttccactcagctttatctatcgatatgatcccatcttcttttggtccaggtatttgtgaaattttctggattgcggctggatcctttcatgttggttatgaatttattcttttgcatttatttattgttatttcattggaattggggaggaaggagaggtaaaagtaggcctaaactaccatgttgaacttcaggatttatttcaaaaatttgaaaattcgtaactattccttcagtgagtgaatatatgacctcatggtttaggtaagggttgatcattgtggtgagtttttgacagggccagagaacctgcccttgcatcctttcctctccccaccccaaacaaacaacgccatttcatgtccttataaataaatgaatattcccatctggactgactaatttgaaaagtccgtgtgtcaatgagatgagaacagagaacaaagtacaggaacgaagtgcagggacaagggaagaatgaaagaggcatttcataaattttaaaaatatcctttattgttatatctacggacttgttttgcagccaaaagaatcaagacaccttcaagataatgtgatatagctgaaagtgttgggttggcaataaacagaaagacatttgagaactagttttgtttcttctatcttctgcaaattgggtacaatgataatacgtgccttggaggtggtaatgtcgactgagcaagggagtatgtggagagcacccagcacattgtaggttctcagcaatgttaattccctttccttagagaagaggagatggaccagcacagaagaagcaagatgaaagctctttatacctgctctacttagtttaccacaatcagtttcatatctttattatttctgtctgtctttgtttttttcttttttttaatctccctgcctcttctctcctcttctctaccccaatccacaaagctagtaaaatctttaagcatacatttaaagaaaattgcatggtatcagctgcaggaatgtgttaccattttatggtggccatcctcgactccaccccaaggaccccagatggagaatcccagctgggcctgagagccttgcggtggtgtttcccggatgctctttctgccctctcagccactttcctttaaattaaatagctctacagtgatgggacaactgaggcccctggtctgagataaaccccaccttttctgtggcaggggccccggcagcgtcctaccaagctccctatcactgtgtcagatcctgagctaagcacattatcaaacaacctgggactgacagaggaagatttgaaaagtgctttattctttccacagcaccaccttcagacacttagtcaaattgttctttcctgccttgaggtcaaccaccgttcagagactcacatgacctctgggaagccaggcatgtccttgcccaactagactcccagaggcctgtcctgtgcccaccagattcttgtctctagatatttttccaggggtgagagagatgcaatgtgaggtcccctgacttcctgaggttaagccctcttgcccccactgagggatttgaggtacatctgtccaggtttgaatcctagtttgagcagtggacaaacctctgtactttagttcccccagctacaaagtattaatagaatttcacatgagaacttacttcatagggttggaatgagagtgaaacaagtgaatacatgaaaggcctttagagcagtggattcttaactttggtgctcacagaatcacctggagggctggtgaaaacacagattgcagggccctgccccagagaacgccctttagttggtgtttctaacaggtctgcaggtgatgttgatgctgcccaactgaaaacccctgtcttagagcaatgcctggcacaagatcagtgctatatgattgacttgttattatttacttgagagaagaaaaaagaatgctacaatatgtttagaatacatgcatgattacatagtacgtttagaagattctgggtagcaactgaactagccgtgcccccactgtgttagaagggctttaaagggttagaagacagtgggggctggagacaagcagggcagcctgcaggttttgcagtatccaggagatcccctggccctccctctgtggctgaatttatgggcaaaacaaacaggagcttggaaggcagataagacttgccttgcccctctctccaagtattttagactcagcatggctctaggtgttacaggaaataatgacacccaagattgggcccagccttgaacgacctagttaacgatttagttaaggagctaaatccatcccacaccaaacaataaggaaatatgggaggtgcttcaggtctgacatgatgctagctacacacacagtaggagatgtccctgggtcttagtgtttggcagtgtgtgtcacactgaccagcatctaaaggttgctccgccgttatcagtacagcacaggagatggtcctctggccctctgcacctgaattttgtgtctggaatgagcagggcagcctgcctccagggcccatgtgaggacaggaagcactgtaggataccacaaagttagggacccgtctgttgtgtgcacagccacacccctggtaggcatccagacagtgtgttgaatgagtgcaccactgagcgaagcactctcagtgtctagctggcagggctcagcatggataactgtcctcactgctgtggttatttttggtaaggactgggctgattaggagaaaccaatggaagatgtaaagagtgatccagacctgagggatggatgggatgaggaggacagaggaagaagggtatttcgggtatggctgagggtgttgggcaagctgggaagcaagaaggagcatggtatggcctggctcagcgaggaggcagaagcctgtggagtgggactggctgggggtgcaggctctacagagccaggtgtggggaagcttcagggtctgtgcatccaacaaaaagcattcatctcccagctcaccccgccccatgtctttctgacacttttggtcatataaaaagcaagagtcaaagagcccaggttgtagtttcttcttgtttctctcccaattgaaaaatcattttgataaagagaatcaagttgggcatagaggaacatttctcaggttctcagatcagtgtgtcttactcattctacccctatatacgtggcttaggcccaggtgctcacacctagctgactctgatatctagggtattagaacggttctgggtaatgaatggttcttgtcttctatttagtttgaatgattttttattctctgagacacagctgtttcaggggtggccttgttctggacttctaggaaacctagaaaccagtctggtctatgcgttcttaggaggaggaatcagaggaaccaggagctccctgcaggaggagaaagaaaggaggttagcaaacctgcggagagagaagaaaaaaccacatcctcatgtgccagctggcaacactcagtacacaaaagtgttgataactttgacttttttctgattactactcataccctaattcccacccctaacacatacaaaatccactttccatgctgccatggggaacccttagtaagacacatacctgactgctctatctgctttccatttctggcttataaaattccagtgccccctcccgccccaaacctgcaaaattgagtagagtttggcataggaggcttttcccaattcggctccaatttaactttccaacttcattcccattcccttccctcctccttctcctgcaggactgtggtggctccctaaacagtttggtgtcctacctgacaaactcctattcatccttcaggaccaggtcagtgccacctccttacccaggactaataagaagagggtacttctgtgataggccacagtttcccaccttccaacctagagggagaaacacaagccaacaaagctcagctcttggttctggccccatctgtgaccacaggaaacccaagccaccctccaaatgccccctcctccagttttgccaagagtctccagaaggtattatctgcatgctcatgtgtgcagctctctagctccttcgtggcatttgtcaatttccttctctacagtgcaggagccggttgccacatccccacacctgctgtcaacaggctctggtgccactgaggccacagcactgtctcctgctgatgcttgctgaaggctatgtcttctttccttcaatcatatgtgtgctggtctggctcacagctctgcactgcagcataactttcaaatggggagcatgagagaatgataatgtgaataggacatgaatagctcccacttaccaagcccttgtgtgcaccaggaatggtgctaaacacttatgtggattctacattctaatcctcatgcttacctaagaagtatgtcttgttattattcccattttacaggtaaggaccacaacaccagaggctcagcaagactaagtggattccctaagttctcacagctggtaagggggcgctgtgagtttaaatctatgtcagtttggctccagagtgtagaatctttaccattaagtggtgctgcctcctgacacagcttgcacaccagctgcaagtgagatggagcaatccaattccttactgggcgattgctgattcccttggcagtctaacagctggaactctctatttcacccacaacagtgactggcacatagtggaagctcaataaatatttaatgagtgaaggaataaatgaataagtagaatctcattctaatctgaccctttcacccctaaatgttgggcctggagagggtcatcatatccttctttagccttcaaactcagatcaataatatggctcagatggggttcttacaaagcaggctgagatgctgatgtccatgaaatggaccttgaatctctctggcctcaatggcaacaataggttcttcactaagttttcccatctgttcacacatggcctcggtcctccatagagccccaccagccattctgggagtcctggaaagatgtgtcacctgtgccagtcgaggtcactgtgtggtgtcctctctcactcttgctcccccacccctgccccgccgatgatgtcttctgcctgcacgacctcctgggctgcctctccctgcccctgctccatcacctcctgcagaaataccatggtttatgttcagggccatgtcctctgactgctgccagacttcaccctgccagagccatgctgtattctcttcagacatggaggggccactaccccactttgtcacacacttagcccactggggctcgactgggtgaagacatgagtgcccatgacttactaggtcctttagaaatcctctgctccggcttcacattgtagcccgtctccacagtgcccagacctgagtttggaactggttggtgtgtgtgtgtatgcatgtgtatacgtgtgtgtgtttatgtgtgtgtgtgaacatgtgtatgcaacaccacactttcctccctcctctcccagcttcccacaccgacatgagactctttcctctcctccccaatgatgctaatcaacccctggatatagacatttgctggtcttggttcctcaccctcctccacttcatcagacaaatccagccacatatggattcattttaaggattatctgggaccacccccactgccatcccctggctacaaacttaagaagatctgctccatggtgcagatgtcaggtgacccagcctgctgaggaatgggggagcacgtattcagctttatcaatgggtctgccatttccagatttaaggcctggatttactgtgaagctgatgagactgaagatttcgaatctccctctcactccccctgccctcaccccttgtacaggaggggacttagtgctcatatgtctttgttaaatttggaaaagtaagccattttaacacaaccagttaagatcactttttctcccgacctttcctccatcacaccttccttccagttaggtgaccttgaagcagccttgggcattttggggatctggctaaaggtcaatagagttgggcatacatgagttcaggtttcttggagtatgttagggttgtttgtcatcatttttatgtatgggttttaaaaaattttttattatattttaaattctgggatacatgtgcaaaacgtgcaggtttgttccataggtatacacacggcatggtggtttctgcacccatccacccatcatctatattaggtatttctcctaatgctatctctcccctagccccccacctcccgacaggccccagtgtgtgatattcccctctctgtgtccatgtattctcatagttcaactcccacttatgagtgagaacatgcagtgtttggttttccgttcttgtgttagtttgctgagagtgatggcttccagcttcatccatgtccctgcaaaggacatgaactcatccttttttatggtacatagtattccatggtgtatatgtgctacattttctttgatgggcatttgggttggttccaagtttttgctattgtgaatagtgctgcaataaacatacgtgtgcatgtgtccttatagtagaatgatttgtaatcctttgggtatataccctgtaatgggattgctgtcctggggcagtaatggcagggatactcctactagccgctaggtggacttgtcccctattgtggtacaaaggtgcaggacaaaggtcatctatcattttcaccatgtcctagggcacctggcatggggagtatgagagtaatggaagggaaggaagacagaataaatgtgtggagccagaagctgtgttgtggaaaattcttcccatgcctatttaaaactatttcccaaaggacggagatcctgctgagtctgatggggtcggggtgggggaagaaggggtggggtgggaagaatgagaggaggtaactcaagctagggcttccccctccacctgtcggactctgcaggacagccatcctggcatccaccacgagctcatcctcaggcagccctcggaaggcttcctcttcctgcaacccatcatctctggacatcttttgggctttttctcctcggatcttcttaatcttcactggttattttagctgtgatgcttcaaaccttgcttcacagcccagccccagatgagatcctgagaccagtttccctctacctcagtcattgctctgtgcccagcctcactcctggagctctgaccaccagtgaggttgaatcttttcctccattactccccgttctctctacagagggtctcgagctgtgctcagaatagacaagactctgttactaaacaaggatcttgttcaacatcttcatttccctcagttctagaaagaggggcccaaaaacttcaccttgttgcctaaggcctgaaagacatggtttttgtgggtaaaggtgtctctaatctcttttgagttggtggtatttgaaacctcttagcatttgaagtcttcatacagacatagagggccatgaggacatgaccatgtccttcctccacaccaataggacaactttccaggtcatttgttaatttcattcccactggataaaaaaaaaaattcaacctgtagttagatgtgatttacatatttactctgttactaattgattgagtggccttaagtaaatcacttctgtcttggtgttcgtgttcattttttcatttatgaaatgaggtttttggattatatgatcattacagtcccccaagctataaattattattttctatgaccttgtgcttgcaaaattctaattaaacagagcttaactactcgtaattgtcacatagctagaatttaactcaccttaactttaaggaaaagtcacaagaaaacaggtttgcattagggaaaggggacgggggaaaaaacccagggtttggaacaatcttttttttttttttttgagatggagtctcgctctgtcgctctggctggagtgcagtgacgcgatcttggctcaccgcaagctctgcctcctgggttcacaccattctcctgcctcagcctcccgagtagctgggaatacaggcacccgccaccacgcccagctaatttttttgtatttttagtagagatggggtttcactgtgttagccaggatggtcttgatctcctgaccttgtgatccacccgcctcggcctcccaaagtgctgggattacaggtgtgagccactgcgcccggcctggaacaatcttagagcaactctagctacatctataatattctatagtcatcattcacatattcaataatctaagaaaggctcagtcatgcttattagaccttaattactgaggtagagaatcaattaaagcattttagaaagattaactgctaaaaggtagacttttttcattgttgttgttatttttgttattttaacagaaaaaaaaaaactgagcttgagattctctgtcctttccagcattgcagttaatccatcagcatcttgttatgtgcagaaaggtttcaaatgtcatcaactcaaagggattagagacacttttctctcattcttgtaaaccatggccatgtagacttaggtaaccaggtgaagtttctgggcctgtctttctagaattgagggagacaaaggtgttgaacaagattcttatttagtaacagagccgtgtctctaaatgtgcacagaccttattccgtcctgtctcttccctcctctctctgccatggctaacaatagtcccacccttcactttctccgttagaaaataaataatcaaagcaacggaggagattcagactatctgaaaataccaaggacatctttgaagtggctgagtacacagccttttgagagagacagagatggcttcaaatacaggctctaccacttactggctccagggtctttacgaaagactaagaacacaagggatgcaggcagcttggaattgtagaaagacagaaatatgcgggggtcatctaggcctgtttacgaaagagacattttggctggggtgaaaggtcttttagggccatctttctgcctttgttgagtcaaagctgtctggctagccaccttcagattcttaggatggttccccaggtgtctgaggaagagcatttcaaataggtatgggaggagagaggggacatgctggctcctgaagatgtcagctccactgttacttaatagaccagtctctggtttatacatcaacccactatgtgtttggctatcaaataccaggccacaagaaactgacctttcctctctggataagtgcagactaactctaattgctggacctgccaagctgaggaccagcatgtggactgcggtaacttcgtcaagctactggttccctgggagccagccagcctgtccctgatgacagtcctctctctcaccaagcttcctaactgtaacagatctcaaaacattttgcaaataagccagtgccatcattgcactttggaatatactacttagccagcacaaacagcttttttctttttttcctttttaccaaatttggtagtctggcttatcgctggctcctgtcctctggcagttgcaacagacgctggtggtttgttgtggagcattggctcttcgggggtgatgatttgtcacttgggcttatgtggcaaaagtggtggattccaagaaacacatgtttaagaaatttaggaaggaacaaggaagtggatatgatcatcagctaattagcttgttaggccaaaaatgccttttggtgctcaccacagcactgtcgccagctgtaaagtagcagtgacctcccttgaggtcattgtgtgaatgacagtgataaatgtctggttttggaaggttaggaatttttctctctttgcttgttcttcttccccccgccccccgcccccaatccaaccctctttggttgtttggaatcctattgaaaatcacaaaccagaaagaaaacagcttccaggatcagtggtgaatatttcaagaatcaggttactgcggcctgtggctcttgagctcaacttgaagacaatccaggttgctttggtgacctcccagtgcattttccctaaaatacccactttctcttggtttaccagcgagcaggaggtggaaacgggcagaagggtcaggctaagtaatgtggcaggatatatatatcccccaccccctacagtgattgggtctagatgaggctcccactgagtcagatgctttggaacaaaaacaagtcttaggagcggctgagtacctgattttgggggaagctgaccaattttgtaggcgggctctcagtgtaccttgaactactgattcagggggtgtgtgaagttaagacactgggtcagcgtaagatcatttatagatgtgcaagatgggcctggagagacccttttccactaccctggtctctactttatggaagtcagccccttctgtgaagtagagaccagggtagtggaaaaggctgaagtaagagtcaaaagccacgctttctctttcttgcttcacttcacgctgaactgcagaactttagacaaatcagtttgcctttctgggccttacttgtctggtaataagataactggatcgatcttttcatgacgcgttttccttctgtgtttagccagactcacctcaaatatccttgtcacaagtgctttcatcattaccctcggtgaatcatataaaacaaattttgcactatgatcaaatgtgatcaaacgttccatttttcaatgtggtatactatatagcaacaatattacgaatttctattaaattgaggaaccgatacactccaaagggaaaaagctagaattgtaaaatgtttcaaagataattttaaatagtgtcacaagtaatgtctaaatatgtattgtgcaaagaggggctactttatcaactttggagattaatttagaatcatttgtatttagcaccttctttaatgctaaagatattgttaatgcacttaaaacaatgtcttctgaagaacattaaacattccttaaaagtcatttacactactatttgcttagatttgcctatgcaccctcaagatacataaattctaaattaatgagatctgagttcatgagatgttatcacatttgctttggaatgtgttcaaccatttggtaactcctgaatcaccctaaactagggaaataaatctgatgcaatctacgagactacatatgaagcagggagttctctacttaacaaatgctagaatatacagagttaaatttaaaccaaaatgagatttcctgagatcttgaatactaatatgtactgcattagccttgagatgggtaaggtccttcataacaaaattgaacacatgccaaatctggtatcttaaagcagtaatgtagactccagccttctgattaaattctttggatattaaaatttggtttgacctaaattcaaagtgactagatatttttttttctcctgtaaatttcagagaactccataccaaggcagaggaactacatctaaatttcccttttaaagacactcataaaaatgcactcggtgcaaaaagtttccacccaagaaaatgaacaaaaacaagctggattcaaatgggaacaacaaaaataaaactagaaaattctgtgattagactcaacatggaaatatgttctacataatttcagtaattgtgatcaaataaagaacagaaatggcaaagtaattccatttttgcaggagctggttttcagtttcttccccctgcactcattagcatcataaaatgttagtgctggaagggtcattagtggccactcattccaggccccctttatagaggaagaggcctagagaggcagtggagttggccagtgtcagggagccaattagtggtagaaagaggactagaacccaactcttcctgagctaccacattgcatagcagaatgtctaatagatccttgctagacatttgtgggattgaataaactgatgtcctttgggtttttaactgggaaataaatcaatcaaaggccatctattctttttcatgtgtgttttttctcaagacatcttttctccatctgattccctgaactcaataaaagatttgtagagaagggggttgaggtggggccattgagagaagatatttttctccacactgaagtttgtactagtgggtggagggtgagggagacagataaagaaaaaatggctactcaaatgatatgattattaaacactgagttactggaacaaattttcaagtatattttaataggtttggtagctaggtatgcattctcctatttttgagggaattaaaagttattcctgtgatgaacagagtaggcactcactgactgaatgaatgaataaatctgtgaagggaagtgcattatggttttatccatgatatcttgttcaagtcttctcagctttcattcccattctctaaatggagagactgaggcttagagaacataatgactggctcaaggtgttaagtaacttctttttttttctattatattttattattattatactttaagttttagggtacatgtgcacaatatgcaggttagttacatatgtatacatgtgccatgctggtgtgctgcacccattaactcgtcatttagcattaggtatatgttctaatactatccctcccccctccccccaccccacaacagtccccagagtgtgttgttccccttcctgtgtccatgtgttctcattgttcaattcccacctatgagtgggaacatgtggtgtttggttttttgtccttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgcgtctttatagcagcatgatttatagtcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatggtgagcattttttcatgtgttttttggctgcataaatgtcttcttttgagaagtgtctgttcatgtccttcgcccactttttgatgggattgtttgtttttttcttgtaaatttgtttgagttcattgtggattctggatattagccctttgtgagatgagtaggttgcaaaaattttctcccattttgtaggttgcctgttcactctgatggtagtttcttttgctgtgcagaagctctttagtttaatgagatcccatttgtcaattttggcttttgttgccattgcttttggtgttttagacatgaaatccttgcccatgcctatgtcctgaatggtaatgcctaggttttcttctagggtttttatggttttaggtctgatgtttaagtctttaatccatcttgaattaatttttgtataaggagtaaggaagggatccagtttcagctttctacatatggctagccagttttcccagcaccatttattaaacagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtctagtttgaagtcaggtagtgtgatgcctccagctttgttcttttggcttaggattgacgtggggatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcttcttttatttcattgagcaatggtttgtacttctccttgaagaggtccttcgcgtcccttgtaagttggattcctaggtattttattgtctttgaagcaattgtgaatgggagttcactcatgatttggctctctgtttgtctgttattggtgtataagaatgcttgtgatttttgtacattgattttgtatctgagactttgctgaagttgcttatcagcttaaggagattttgggctgagaaaatggggttttctagatatacaatcatgtcatctgcaaacagggacaatttgacttcctcttttcctaattgaataccctttaattccttctcctgcctaattgccctggccagaacttccaacactatgttgaataggagtgttgggagaggttatccttgtcttgtgccagttttcaaagggaatgcttccagtttttgcccattcagtatgatattggctgtgggtttgtcatagatagctcttattattttgagatatgtcccatcaatacctaatttattgagagtttttagcatgaagtgttgttgaattttgtcaaaggcgttttctgcatctattgagataatcatgtggtttttgtctttggttctgtttatatgctggattacatttattggtttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttggttgtgtctctgccaggctttggtatcaggatgatgctggcctcataaaatgagttagggaggattccctctttttctattgattggaaaagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccattttttctagatgttctagcttatttgcgtagaggtgtttgtagtattctctgatggtagtttgtatttctgtgggatcggtggtgatatcccttttatcattttttattgcgtctatttgattctcctctctttttttctttattagtcttgctagcggtctatcaattttgttgatcctttcaaaaaaccagctcctggtgttaagtaacttctttgcatacatcgtattttcccctctgctttctagtgtaagaagttattttcctatcaacttcttgttttttaatgaaaatttttaattgcagaaaaaggggaaaagataagcttctggtgcattcctgaaaccagagatgaaaaataaaaataaaaatggctttgaggttggcggctgccaaatgtcattgaacaaagtaagttacatgctcatattggagcaagcagaggggggtgaaagtggcttaaatgctttgtgatttgcaactgccttactcattcctgtttccaatttaatggcacactgtgcgtcaacagaatcctacattcaaagagattctgtggtgtctttatataatgagattgatatcaagttcctgggttcccttctccgaagaatcctgcataactccgtcagcatgacctcttccaatgagaggagaagagcagctttatttatttccatgtctctggcgtgtgtctcaaggaattacatcacctctcactgagtaattcagctcatagaccaggttaggaagcaggaccagcatctccctttcctgaatcccaccccatctccaaaatgtgctttttatggagtaaatgattcgcttattaggtaaagtaaacagaaaaacaatgtcaagtttaaatggagcagtctttgattcagagtgacactgagcaaacagccaggctggacctatccggccctctggggacacggacgtgcccacataagaatgacccctattagcaccagtggggaagggcttgcagtgtgataagtatgctcctctgaagcctgagccttccagccctggaaagcagaaaggctgaggcagggggatgggaaaggcatctgactacagcatgacttcactttttgaaactctgaaaatcatagtctcttacagagagctggtatcttccaggtgacctctgtctttctaaccacaaggaaactgaggctctgggaggcttaaaggcttggctaaggtttcagaataattagcatttgaatcaagtcttgtacccaggttttcttgttatcatgagttggggggtaaatgtttctccttcctggaattccaagaaaaaccatccatgagagcaagaaacgtatctgtcttgttcaccaaaatgctgggcacatagcagatgcttgagaaatatttaatgtatgaaagaaagaaatgcagatctcaatactcatcaggcccaaagataaagccaaaccagaacaccagattatacccagcttgagccctgagcaggtttccaggatgcaagttggaaattctattctgggcctggactatgcatacaccagaaagaatctagaagcaaaatgttgtgttgatcaagtggaaaagtcagccacctccctctagcttatagtattatgaagatcaaatgagtttacagttaatatctagtggagagtgagtcctcaatagttgctagaggtggtgatgatgataatgaaaatgaactttgtgctataccagatccaaaccctcagcttgaagttccttccaccttttaacagcttgtctgattcaaccatagccatttttaaataactagaacaagcacaaatatattgttctttaaaaagagagaaagaaagaaaaaagatgttgcaatcccactgctggctttcttatattttgtggtgaatgtaagtaaacaaggggaggtgagaagattcagaggatgtttcagaaggatttgcaaacagaatgaagtcaaagcatgtgacatatgagctacacatgtagctctttccacatcattccatttcacgtgatgaccagattagctttcctaaacatagtgttgatcatgtcacccccctgctcacaagtcttcaatggctctccatcacctctgcagaagaatgcaaattcatctgcttggtgtttgcaattgtcttcggtcttccctttactagtccccgtggtctgcatggagcctgtgctgtagccaagatccacttgccattgcctgaacacctcttgcaacgtccaccttcaagcatctgtccctgcaaccatctttatttctaaaatctttcccatgcttccatttctagcttgcctctaaaaccattagaaagggccaggtgcagtggctcatgcttgtaatcccagcactctgggaggccgaggtgggcggatcatgaggtcaggagattgagaccatcctggctaacacggtgaaaccctgtctctactaaaaaatacaaataattagcctggcgtggtggcaggcgcctgtagtcccagctacttgggaggctaaggcaggataatggtgtgaacctgggaggtggagcttgcagtgagctgagatcacgccactgcactccagcctgggcgacagagcgagactctgtctcaaaacaaacaaacaaacaaacaaaaaatcaaacaacaacaacaacaacaaaaccatacaaagaacttcccttcttctgaattttgaaagtgttttgctttgtttttgtatgtttatgtactactgccttgatttgtgatgtttgaggttatctttcacaccaagttataaattacagcttaggaaccattttttatccatctttttactctccttcgtgtttttcaatggtaggtggttaatattttcttattgaagaaatgatggaatgaacggtggattggacaagaagctccagcttctcactgattgaggaaactataaatacacatgttaacagcgagtgttctagctgctcccaccatgccaagggctgtgcagatttggcattttctccactgcactcaggaatgtggaagagtctgtgcttccaggtatagcaccaataagagaaggaaggcaatgtagggtatttgaagctctgtgtctgctgagcctggtcttcctagatattctgccccagcccctggggccctccaagtactttcctcagattgagctcattggctttaaagaccaaaatgcccaaggccctcccagcaaggggctctttctattcatggtcaaacaactgggcagccatagtaatggctctgcttgtgtatatatgtgtgttcgtgtgggaaagatgtgtggaagttgtgatattttagctgaaacctagctatgtggtaaagggtagggcatgggcatggaagcaggatggtaccagacatgtttaagctcagtagtatcctaatttggctggagcttcaaatggaagaagagtggaaatgtgaaattcaagagtgaggtcacatcagagatgacttagaagccaggataggggaaatggcaggagagttgagactagggatggcaaacaggtttccaactcttgctgtagggcttaactcctctgagttctggtttctttttttataaagtggagatatggtacttgccttataaaatcatcatgaagattaaattatatggtgcatgtaaattcactttttcaggatgagtattagatgaattttgcaaattattgatcctatttttgaaaagggtaaaaagatagttgctaactgcagagcaaacaatgtgatagggccctttggtgagattctagatcaaactgttgaaaaattggtttgcaagcatgaaataaatttccagtaatcaccaagagccagcatgggttccctgaaaactgttcgtgacagcacaatattacgctcttttttgtgagagtagtttgtctcatccagaaaatgtaaccgaagtagagcgcccggattccaatgaggcaatttgcaagattcttcttcacaacaggctgatgaacaagatagaaaagtacaagcagaagggcaatgcatttgactggttttaaaacaagttgcatattcatatccccaaagtaatgattagtgaaatcatgtcaatctgcagatgatttctaagtgacaggctacttatctttgtcttgttcaatcttttaaaaaaaagaacttagaggaataatcgaaggtctgcctactgaatatgcaaatggtgaagagcttggaaggaaaacaaatgttaggtaatagaatcaggattttaaaaactctattatttagagattgctacagtatttaggttttgacaataaacactttatttcacgatgagtcttcagaacactgttatccatgcatccaaatcacaaacatactctcctctttctcttggcttcccaaacttctatgaatattctgttcccctggcactgaaccagcaccataggaatggaacaaagacagagccctccttctgaaagaccaagctgtaaaattagcaaaggaataaaaaacagctggcgaaatgtgatagttgttattccgagcccatgaacctgaaaagatagtttattttagaagacaaacaaaatctgccttctgtttgatctgggatagcatccaccgtcaggagccgtcgactcgcatttagttactctggaggtttgggacaagcagtacaggcgttataaacaacgaaaagaaaggatcagtttccatcataatttgacagtaaacagtactaatttgactctgcagctgtttattgatatccaaaagaaagagttgcaattcaatagagagaacagtagccagtgtgctggggcagaattgttcgtaagatggcaggagccaggctgtcttgaatctctcgatgttagtaagaacacaatgtaaattgccacacaatgtggttttcatctggcagcagatccagcaatgggagcctatagtttttagcctccagagagggttctctgtagtggcttcatcttgatttatcttagtaactgccaatggattccctgtcaatcatttaatattttacagaaaaacaggtctggcccaaggcaaaattcactcactcactcactgactcgttttacgcgtacaatgtttattaagtgcttactatgtgccaaatgctgagctgtgtattgaagagaaaaatgatgcatagcgttcataccactgtgatcttcactttctagctatagagaaatctgcagactgataatgatgatacaataagataagcacaataatagacaggtactctggttatcaaagaatctggttagttgagttcccatgtgtatatcatccatgaactggtcatacagaactaggttaaatagtatcatagactagattcaaaagctgtggcccacattatttatttatttatgacattttaggtgattttaacaagaactaatataccagggaacttgataagtattttccatgcattatgcccattactcctcacaaccgcattataaggtaggtactatcgtcatcattcacttggccaataaacaagctatggcatggcataaaggttgaatttcttgcctgtggccatgaaactagtgagtggagaagccaggggtagaatcccagttcagtggactccctgtcccatgctttttataataatgcttctagttaaggtacttagaagtcgtgaatctaggagctcatcatggacatcaattatcattgtcatatatttttgaaaaagcataggttttgccaatgaatacaacattattctactaatttattacaatttactctcaaatttctccatataatatgaaattgccactttagtgatgctcagggccttttgcctaggataaacagaatattgggcttcagttctttaaaacttacttgttgggcacttactatatgtcaggagcaagcatgtgctctcccattactgggagtcacaagtccagtcaagatgttcctgtgacattatcctgattccctaccaggaacagttgtctgctttcccaatccaaaatttagaacaaacacaatcccacaacattttaaataatttccaagacatttaccattttctgtcaaatcagagagaagaagtaagagtggacagctgttagaagagaaaaccctgtcccatgttcagtttagtaagaatatgcacttttacaacttatattttaatttatcttcctttcagatgcaattgaatcttcatcattaggtcatatctggcctggccaaataaagcattctatttagaaaatggaacactttgttcagccagcatctctccatttcacttaaaaaaaaatagacgcagtggacttgtgacttccaaattatttcatgcagttggtttgcccatgttctgatgcacaatagatgtgagtgagctttggaaatcctgagggcaaaggagaatacacgtgatttggtagagtggcagaattttctccttatatgttccttacgtgtatgtgtgtatatatacatatgcatgtacacacacaaataacacacatatacaacacatatatatgctatatatagcatatataacacatattatgttgtatatgtatacacacatgtatgtagatataacatgacatgcatctataacatatataatatacatatgtgtatattaacatatataacatatatacatatataacatatctattatatgtatttaatttctttggtacattcatcatttgttaaacacacaaaaaatgagggaagtatagttctaaatatcattaaaggaaaataaactgtgaagctcagttaggcttcttcatgttataccttgattctatccccatcactgatctatgtcttgttacccgagtgccacaactctctctgacttttcttggtaatttgttaatatcctcccacttaaggagtgagtttggagcattcaatacaaataatagcttatatataactatatgtgtgtcatatatgtattatgtgtcggcactttacagcagcagaccacacagtagtgtatgtattaggatgctctcagtggcaagcaacacagtatcctgacttcactgcctttagcaaagaatacatttactatttcatgcggcagttccagagatacagcacattcagggatggttaattaagtgaatcaataatattatcgaagacccaagatctttccatctctctgctctgccatcctcagagaggtggcattatgctcaagcatgtcccctcacggtagcaaaatgtctgcagtaacaggaccagtatggtcatctagatatggctgtggccaggggaagaagataccacttctttttatgcctcctcgtaaaagcaaggaaaccttttgtccaacccctcaaagacttcccctcacatctcagtggtcagaattgcattacaggcccttctttccaccagccactagcagagggaaaaggaaccaccattatgagcttacaccaaccagaacacacctcctagagttcatgaccatgtggaagagatagatacctgaataaaattgaggtttgtttatcaagaagttggagtgaatggcttttatgtaggcaatcaacagtgtctgttacaagtggtcatgcctggcctgtctaaccttcaaataatcttgtatagaaggcaagtcaggcattacaacccccaagaagcagaagagaaaagcaaacattttagttgtttgtgcaaggccacctggaattaagcagcaaagtgaagatttcaaccaaagtcttcagtctcatattcaacgttctttgaattatctgtctcctggtcttggcatagtcagtgacttttcatcactttagtgcttgctatctttcctggcgcctgaactcagctaagatttgccttcttccaatgatggatgtgtagctgacacttagggagcacttactatgcactgtgctaaacactttacacaattaatctcacaaaaccccaaatcacacaactagtgtgaggaattgggttcaatctggtttaatcaagtctagaaaccatattcctattactacgtagtgggtgtactgtctgttgtcagggatgcaatgggcaggcatgaagttaattcaacattgcacaaaccaaggagtgctttcagatggaaattgatttacaacagtagatatgtgcctttgtggtagaagaaacttggtattcaatacagttaccctcggttacaggctattagaagctatggcacaaaggctgaatttctcacctgtggctgtgcaaccagtgactgcagaagccaggagtagaatcccagttcagtgggattgaaaaaaaatcccaactgagcctctgttttcttatttgcaaaataaggataaaagtaatttctgcttcacagccttgttgttgcaaagattaagaaagactatatgaagaaacactctgtaaattgcagactattaaaatgattattaataatttttatgattattggcatcatctgctttcagagatcagggtgttccatgcctgtgactcattttctctgccctctaagaaaggcagggattaagaaacaagaaactgtgaagtgatatcaacagttctgcagataggtgaaggctgtcataggcttaattctgccctgggctgggcatggctattcagtcccgataatccaccccccccgcccaggatgacttcctcacctctccttctattcctcactcctctcaccttttgccctggagctgtttagtgctctcctctatcctgtggtttttctctaggtggcagggaagggtaagattgtatgtaacactagcaaaatcagagaatgtgcataaatcaccatgtggataaactccggtatagggcacaggctgctctatgtgagctgagatgctcctgagagctgattttacatacgatgcagcagacatggagcatcaccctcgaacagcatgacatagacctgccagatgctacagctgggagagggagagaccctggcaatcacctaaacccttctgttccagatgttaatggatgtgattaagaaagagaattcatactcaaaagtgtctggcaagcacagggctaaacacagttaaacaagtttctttatttatggttggatttggggagtctttaataggctaacatgtattatggatgtctaagaagggatttcccaggatttacttgataataaaataattttttcatgaagcatctgatgaaacccattttccatagaacactgattaaattcagtcatattttatatttggggaaactgaggttcacagaggtgaactgagttgctcaagctagtggaagaggaaggctcccagttcatcatgtcctatataggcagttctcagtctttaccgtccatcaacataccctggagagcttgttgaaacagatttctgggtcccatccccagagtttctgattcagtaggtctagggaggggcctggaaacttgcacctgtagcaaattttggggtgttgctgatgctgctggtctgtggctcacactttgagaacccctgccttatagcacctgactcttattagatattatggcagaaaacagttgaatcgggtttcttctatatggagaggtgtgactgcctggaagcagaagaaacatgaatagatagagtaagcaggtgccctcatgatgggatttaaggagctctgggaggccagctcagccttccaaactcttctacccttcctgaaggttttccttccctttgtcaccttacctggaaccctacccaatggagattcatcatggttcttgctttccttgtttttatcttgttgcgttttacagtgtaaatctcctgggagagttgaaaaagatcatcagtcactcacacttgagtgagacttagttacatcagatttccctttgtacctggctgagaatactgtcaacagagaaagagatttttgactgggttggggaaattgcacttatgtttggaggatgaaaggggactttcaaatgggttgctgggtgcctggtgagtgagcgtgacaggagatggcatgctgctttgggttgagctgcgctttcacgctgtctcgtaagtatcactagctactgaactaggaaggaggggaggatgcagattttcctgttggatcccaggaggactttcctcattcccctatgggaatctggggtagtggggtagtggggcagatacaaatgactcccagggtccctgttgactagggaagctcctttgggtgacaaaatgccaggatctgatgttgtctgagtgctgggtggtctgtccctgtgctgtgccctgtgctcatgggaacatctgccagcttctttgctgaattctgtttactaaagagctgttggtttattccctgggactgtagcaaaagctgctgcttcctctttctgtctccctctggttttctttttctctttttcctcttgtcagcctctctgtgttttgccctgtttccagtcacagtctctctatggaggcagatgggaagaaacttctctggacaggagatttaacattttacatattctgcggcagagatggagcatcacccccaaacagcacgacatagacttgccagacgccacagcacctggactacaactgtgcccatttccaggggtgccatttgcatagagttgcatcaaaatgttaccctgcccaagtcatgatacttgggtggctgtggccagtgccttccctaatctctgcctttaactaatgaggaagaatgaggatgggatgagagtagaggtgggatgagaaagagtagagacccccttccgcagacccaataccaggaaaaattgcaattccctttcaatttcttctcagctgccccagggtaacaggtggccacccttaagatcaacctcaagtagcataaggatgggaaattcagacccctggaatgctgactgggaatatactctgggtccaagatttggggctgcccatagctttcagagtactcagctcactctatatctaggacagtgatatctggagggcaattgacatctgctaccccagttactgaatcctttaaagaagagttttaaggctgtcttctcctggtactcctgtcttttgtttctaaagtacagggtggtggacagcaaggactaacagccgaggagaagtgtggaaatcatttactacaagtctcccagaagaatgcagaatttcggatcaaagttagaatggacctgtcaggcaatatttatccttccctttctgagttctgatgactgacattgttctgttttcattattggccctcagaagcaattgttttaaaaaaatattgtctagacttgaaattgagtgaatatgacattaattacagaggctttcctctgaatgtctctttgccagctgtgttctctgtgcctgagctgctggtggctcccgggagatgtgcatggtgaagaagggaatggctggtgtcagagacctgctgtatgaaggttctggactctgccttgaacacaggtcccaggtcctcacatttcaccctcacaacaaccctataaagttggttcaattttccctgttttacagctgcagaaacccaggcttgggaaacttagatactatgctcaagttcagacccaggtcaacctagttctgagatgcgtgttctttccatctaccaggtagcaaggtagcttggagtgagacaggctccatttagtaatggattcacttacattactaattcatagtacacatctttaaggcagtttttcaaatgtgaatccctccattactaggccacaacctccatatagtgggttatgatggccagcattaaaaaaaaaaaaaaaaaaaaactaagaaagaaaccagcatgtgcaagtatgtaagtagtacaggttgtgtgggtctaaaccttacgtgattcagagggccctatttatgaaaaaggatatataattatggtactttttttagaatgaaaataaaatcacaaaaaatcaggagttttaaaaatctgaccacaaaatccagacaacagcatactatttttattaattaacagtttgacacactctatggtactagctatcctacatttgttggctgaatactttgatcatatcttcatacaataacaatgttgtaatgttttctatagaaagataatttgatctttaccttagcatcattgattgagacttttacagtcattggtagaaaagtttcagtatcacaacttgcattaatagtgtcattcaacattttaagactgttgtcagatttgggaaaatctatcaagtttccttcatacatgaatgtgagggcttggaagaattttccacagactagcttctggatttacacatttcaaaacctgtttctcctccactaccatgtatttttcagcgatgggtatcccagaacatgttcacatagcgctaagaccactaagcctgaacttttgcatcgtaacacttaagggtcagcatggtggtcaatggaaatattcccacaagtcattcctatcttgggaggtactagcagtaacttaaccatacaaagaagagactgtgaaatgtctttctctctgtctatttctccagatcccactacacccaggctacaaatatccccaatttcccatctcaacttctgtttagttggctcctcgaaattcccaagggcatcctagcactacccaacacatggaaaagactcattggggaaaaactggaatggaaagagacaacagtctccggatcttattttttcaaatgattcaaaaacagataactatatgaacacctcatatgggcccttcccaaggccttgtgcatgtgagtgtccctgaagcttagatttcactagctttgtcatgtatgtgcatgctgggagcctttctactaaggggtaagacagaattactgatgaaaacatgtttttttccctcagatgtgcaagggtgacagcaggattgtgaaccagagctttggagtttataaaatgccaatcttaatgctccaaagctggagctctttctagttcaggagcaagcaaaggatccttttctgtaaaggatcagatagcaaatatttcatgctttgtggccacatggtctcaagtgcaatcactcacctctacctttgtattgcaaaagcagccctagagaatacgtaaataggtagtgtagctatattccaatataacattacttagaaaaacaggggtagttggatggctcctgttctagtagatctcccttatgatgaaagttccctgtattgaggatgggaacgtcatcatggagagggtgtgtggcttccattgctgccatctgaggcagtcattgctggctctcaccatcttttggtgactttggagcaggagggttttaaaggagaaaagagagatggcttgtgagatgaacaaggtcaaggaatttttaagtgcacagattttgtttctttctcccat

SEQ ID NO: 587 - DNA, 68532 bp, Homo sapiens
accctcctttctctctggctgcccctaacatttttttcttcatttcaaccttggtgaatctgatgattatttgtcttggggttgctctcctagaggagtatctttgtggtgttctctgtatttcctgaatttgaatgttggcctttcttgctaggttgggaaggtatcctgatgagtgttttccaacttggttccattctcccgtcaatttcaggcacaccaataaagcgttagtttggtcttttcacatggtcccatatttcttggaggctttgtttcttcctttttattcttttttctctaatcttgtcttcacgctttatttcattacgttgatcttcaatctctgatatcctttccactgcctgattgatttggctactgatacttgtgtatgcttcacgaagttctagtgctgtttctcagctccatcaggtcatttatgttcttctccaaactggttattccagtcagcaattcctctaaccttttatcaaggttcttagttcccttgcattgggttaaaacatgctcctttagcttggaggaatttgttattatccaccttctgaagcctactcctgtcaattcatcaaactcattctccatccagttttgttcccttgctggcgaggaattctgatcctttggaggataagaggcattctggtttttggaattttcagcctttttgcattggttcttcctcatctttgtggatttatctacctttggtctttgcttttggtgacctttggatggagtttttatgtggttgtcctttttgtttatgttgatgcttttgctttctgtttgttcattttgcttttaacagtgagacccctcttctgcaggtctgctggagtttgctggaggtccactccagaacttgtttgcctgggtatcaccagctgaggctgcagaacagcaaaaattgctgccccctccttcctctcgaagctttgtcccagaggggcacccaccagataccagttggagctctcctgtatgaggtgtctgtcgacccctgctgggaagtgtctcccagtcaggaggcacgggggtcagggacccacttgaggaggcagtctgtctcttagcagagcttgagtgctgtgctgggaggtccactgctctcttcagagctgtcaggcaggaacacttatgtctgctgaagctgcacctattgctgcccctttccccaggtgctctgtcccagggagatgggagttttatctataagccactgactgaggctgctgcccttctttgagagatggcctgccctgagagagggaatctagagaggcaatctggctacagtggctttgctgtgctgtggtggactctacctagtccaaacttcctggcagctttgtttacactgtgaagggaaaactgcctacctaaacctcagtaatggcagacacccctcctcccaccaagctggagcatccaggtcaacttcagactgctgtgctggcagtgagtacttcaagccagtggatcttagcttgctgggcttcatggcgttgtgatctgctgagcaagaccgcttggcttcctggcttcagctccctttctgggggagtgaatggttttgtcttgctggcattccaggcgccactggggtatgaaaaaaaaactcctgcagctagctcagtgtctgcccaaatggctgcccagttttgtgcttgaaacccagggccctggtggtgtaggcacccaagggaatctcctggtctatggattgtgaagactgtgggaaaagtgtagtatatgggccagagtgcaccatacatcatggcatagtccctcatggcttcccttggctagaggagggagttccctggctccttgtgcttcccaggtgaggcaacacctcaccctgtttctgctcgctctctgtgggctgcacccactgcctaaccagtcccaaagagatgaaccgggtactcagttggaaatgcagaaaccacctgccttctgcattggtcttgctgggagctgcagactggagctgttcctattcggccatcttgcctgggaatctaactgtcttatattatagtttgggtttctcaggggcaaatgccatgcacttactcatatcttcaggctgtttttctgcctaaaacttagtaagttcagaattaactggaaagcaaacacctgcacagtagatatactctgctgcgggtgctcattcaccaccaccctctctttcccttatcccttggagacttaccctctgctaggaaaatgtcagtgacttagtcaatggattcagtgtcttcacagagcagactgaggggagccaaagcaggctaaggaaacaatggtcggcattgtttttccaagtctttctccaatccctccgctggcatggaaaccttccaggcctctctccaatcagggccacaccctcaccagtgctatggaaatccttctgcgcagcaccaaggtaatgaaaccagtaaaaacagtgttcttttcccattggctaagctggaataattcctcacccttagcaaatgggcaagtggaaattctagtagggaatttagaacacaggtctacacactggaaaccctcaatggagtctaaggttctttatatacatatacattgtatacataaaagagtaaaagaaaagaaatcagctgaatccagagagattgttttattttgttagcataataccaaaagcttttctcacttttaaatttgtggttttcaaagtcttaaaaagaatatgaatatccttgtgtgtgtcgttgccctctactggataagctgggtaatattgtcactagttgtccaaacatattaataatatactgaacaacatcttatacttggctagcattttgtctttttatttttcaaaatgattatacatgtagaattttaatttacccttttcataatgctataaaataactaagctatttttattcccattttacagatgaaaaactgaggcagaggtacattattcactcaatatacatactttaatgaagctgtatataaagaactacgctaagccatttacaaaggtgaataagatgatctatactctctgggagcttaatttgttacagataagatatatacccaaatatctataatgaaaataaaattgtgatataggaataaattaaactaagaattattgattgtagaaggagcttatacatgttactttagcctcacagtaacttttttggtatatgtcatgtgccttgttttacaaatgacaaaattgaggttggatgtttctaagtcattgttcagatgccccacagagaacaatgctataggaaaggagaagaggaagaatttacaactggtaaaaatcaagaaaggcgtcataaaggtggtggtgtttggcctagggcttaaaggatgggcaggggctgggtgcggtggttcatgcctgtaatcccagcactttgggagtccgatgtgggtagatcacttgaggccaggatttcgagaccagcctggccaacatgctgaaaccccctctctactaaaaatacaaaaaattagcagggcgtggtagtgtacacctgtattcccagctactcaggaggctgaggcaggataatcacttgaacccaggaggtggaggttgcagtcggcagagatcgcaccactacacttcagtctgggtgacagagcaagactccatctcacaaaaaagaaaaaaaaagggcaaaagaaggcaaatgtcaaaaggaagctttgctcatgatgttggcaaagtgagaggctcacttggggcatgacaggtcctgcagagagggtggagcttgggctatagggaaggaattattcttggtacagaggatgtatccaaaagaagtcttgggaacaagcaaaaaagtcagaggtggtccacatcttctccactgtgcagtgaggacagggctcttgagtaagggtctcgcctttgggtggtctctgtgctgacaggaggcactgatgctggcctgtttgtgcagtgaggctgcccgttttgtggcctggtttctgttgcttatggatatggtcataggtcaatgggaggttggtgtgagaagcctgagcaggctatggcagcctgtgctcctgagagtcagtaaagagtgccgcataacaaggaaaattctgaaaatcattcactttcacattagaggttgctgagctgtggcacctcctctttcctttaacaatctggaccaacggcctaaagagcagaatgtgaaaaaaataaaataaaattgaagacactgtaacgaatgaaacaggactctctttgtcctttaaacgagaggctaagcctcatttagtacttgggtgatttgcctagagttttccttttctgcccaacaatttttcaagccttccatagtcaaccattaccaccttccaggtattctgttcctggtggtttaacagagaatctcagggtcagaataaatgacagggatcacagcgagttctcacagcttacaaggccatggccttcctgccagaggtctaaaggggctggagacaggggctagaagagaaagggaaggaacagaaaaagccaagacagttaaaggaatggatgacaaaggaaacagtgagttggacatttttttcctctgaatcttttctgtcatgactcctttaagccactgagaaagaaatacagagaaaaagacccaaaaatagatagataaatatatagatagttgcagagacagatgaacaaacacacagaaaaaaaatgagctataagtaatcatgacattatcatgtatttttcttaaaaaagggccacttctattgactcagtcttgattctcaaataacaaaactgaactagtacagtacatttagttctttattctatgcatatttactgaatatcttttacacacttccatgtacttatccactaagaatgtattaagtacctaccaggtaccaggaactatgctaggagtgggaaatacaaaggtaaataaacaaagtctcttcccttacttagctgtgagcctttgcctcaaggtgtgctgaacccatgggatatttaacaaatgttggattgagttgcactgttattgcctcatcttcagcagggttaggacctgggagcaccagtttcaccacttctccggcattaactaagacaatgcataaccacaactcagatgatatacgtgatcctttgtccttcttgttaggatctatctctaagctttgagtttgggagaaggaaacatgccattggcataatagactttagggcagaagagtccaggttcttgcctctctggctgagccacaggcttttcttatgggaaactcaccaccttcattagcaacactactctgtcttcattatttgccgggcagactcatctggtgaatgccactgaaatgagattcgttttttttttctttttaattattgacacactaagcttcctctccctaccccacctgatgcatacatatttggaaagaggggaagactgagtgagctgtgacatcgaggtgggaagcaattgacagctgcactgtagcttcataacatcaggaaaagcaaactgaaatggatggggttgtgtttatcctttaaagtagaaacataaacttagagtaacagttctttccttttggtgtactttgttgacagttttgtcttattttcatgtaagtggacctcattcttcatgttggcttttatctttatatttacgcaagatgtctaagaagtgtaaggttccagggaggtcacaaaatggggcactttcctatggtttgtgcaatttgtcaaaaaaaatatggatgaataagagtttgaaaatgatataaagctaaagccagtctgtcaagaatttttttctcattttaaaaatccattgaaaattttcagaatttttcacatgactgcaccctataccaagactcatctcaaaattatctatttaattaatgcttcccagattttggatctcaagcgccatttaaaagaaagaaagtcaaaacaatacatgaggaactgacatgaagtaccaattttaggtttgcttttctagaaaataaaagctaaaaaagtaacagcagctaccatcaactgccaccattattttccaaatgacctttgacatcacaaaaggaagaagggaacaacttcatacaaatggacgatcccttcaatttaatcatttaggttttttaaaaactcacaacattggcttatgtttttcattttgcaacacaccaacgacaggttctcacagaccactgagggagcagcctgtggtaactcctgcccggcattacaagttccagtgatctagaagaaggaagtctaccatggagatcaagtccacacaggccttcctagacagaattcatactctaaccatggggaaatcttggatgttactccaagccacagtttcctcatttgtaaaatggagttgctgttatttaccctgggaactactatgtgtgatcaatcagttagtgtactgaaagcaacaagcagagggccttgtcacaggctaccacaaagtaattttctttgtctccctctcttcttaacaataaggcctgaaccttactcttttcattccctagaacaccttgcagtgagctttgtagttaggaagtagtcaatgaagatgtactgcattcaatttgtatgaataggactcataatgtcgtgtttgttatgctttgtttatagtaaatcaccttattaaatttataataaatcacttacttagtaattactccttgtcttgtctcacttacaaagtctatgtaacttttggatttagggatgatatcattcatttttctactatcaccttcctcccaagtacctggcacagtacaggttatatcctaaaggctgtataaatacttgataattagtcactgattaaaggacacaatctgtccctttgggtgcactgaaaagtgtgtgtgtgtgtgtgtgtgtgtgtgtgtgtgtatgtgtgtgtctccatgcatccattcttatgggccttttttttttcagatatttcagtccaacttggaacttcggtaataattctgagtttacagacattcagcaagtatgatcagattgcacttttggaaaaatctatttcaagtgtgatagcttgtgtgcctagggcaagcattctttcttttcctactaataactcaacaggttcagcaggcaatagcactgcttacaggttcttcattcttcacaggtgaggacagtattaccttgtataggcaactacattttacttagtggtgatctgattaccttgatcttaaacattttaactttgcactatccatgcccacagagagttgggcaaaatgagaagggcctgtggaaaatacacatccaattttatattgcagttgtattggcaattgcaacttaaccagctttactgctacttctagagggaagtgaaattacatgcactaataagatttgtggagaaatggatatgatacataatacaagagcattccttgatgaaacagctaatactaagtacatatatggaaatctaataaatacattttttactaaggataattttttcaatactcaataacagaatcactgggaaggaccatctagggagtgtatgctgtgttcctacatctttctgaattaaaatggtatttttctctttaatgtgtctttggtgaaggttcattgagactgggatgtgaggaaagaaaggacactcaaaatattttttagatcctttgagacttagtgtcttcgcagtgacttggatctaaccatatcaaagcttaggaacttctcaggaattaattccatgatactggtaaactgaacatgattactaagatctgtgttttctttttatcttattggatatcatagtttgattaaaatattttgaagaaacaactccagtcatttatagcactggtgttgaatcatgttgagtttctgaaagcatcttctgtgacccaaatgaagagtaactaagctttctattatccagcttattgttgaacaatatttactgagtgtttgctttgtgttcagtgcagcttgatgcagtgttcctaatctcaatgaattatccctggtgtcaattcttgcttagcatataagagtatcaaaatacaagtacaaaagtaagtagatatagatatagatataaatggaagcaccaaattaattatggctaatttctatcaaactcttactcagctctttttttttcttccctacccctcagctcttattggaactcaatggctttttagggggaagcagacagtttgccttttttcagaaatgatagacatgccctgacccactctaatttgctattaacaatttgttatgcagctctcatctttgaatttatctaaacccttcctgtgcctatttttactttcagttcatataaataattgccataataaattccacatgttaacttatttgcagttaaaagcttcctttcaaacttcagcaatgtttccctatatttgctatcacaggatagagtaaaaactaacatctctaatcattatccctacttcacttccatcactttcaaattgtagctttataatctttaaaattttcttggcattgaaaacaataacaacaataacaacattttatagaaacgattcattgaaagacaactttatctaaattgttcaattcagccaacacttatagagttgatgctggtggccaggcacggggatgcaaagtagaacaaaatgtagctcctgccttccaggagccctcgatgagccagacagacaaagtataaatggattagcataacacaaatacaactgagttgtgtaaaatgttatggatggcaacacagttgggagagaaattgctcctgagagacagaaatcagtgaaagattcagaattgaggagatacttgagtcttaaagagagagaagccttgtctcaaagataagtagtgacaagcaattaatacggggttaaggacatggggtttgcagtcaaacagagctgtatttgactcatatttctgctatttcatagatgtgtaaccttgggaaaattgctttatgttctaaaactaaggtttcctttgaagtgcaatgaagataatgatggtgcactcctagttttgttgtgagaatcacctgctatatgtgtgcatggtttgaatgtatgtgttcctccgaaattcatacgttggaacctaatacccagtgtacaacattaagaggctggggagcttttgggaagcgattagatcttgaggactctggcctcatgaatggatttgtgcccttataaaagaggttgaagggagcacctgaatgccttttcacctcttccacaatgtgaggaaggaacggcacacccttaccaaacactgaatcttctggcaccttgatcttggactttccagccaccagacctgtgagaaataaatttctattatttataaattacccagcctattctcttatagcagcaggaatatactaaaattgtatttgaaacctttagcatagttcctgctacatttaagcatttatgagataactaccatcatcatcatcatcatcataaccatcatcattttgactattcagatagagatccaagttctgatttcatccaaagtccttagagtggcattcagttgtcttttctcctttcatggttcctaatgaaaagtatctggagcctcaactttgtgaatggtcttcatgagtatttactggaggctgggggctggggctcaggagacactgagagaaacacaaagatgtcacagagcatactacttaaagtgtgggccatgaactctatatttgaatcaccaagggcacttgttaaaattcagatttgtagaccaaccctgtctacatacttaataagagtctttgggatgacactccagaatctcttttataagctccttaggtcaattcacatacataccagcatatgaacatactttcctatgttgacttagctccagtttgctcaggatcttttgtttactagaggtttctccaaagccctggagttcttctttctttacagctcctcacctcaacttcctgccagaatcatttataatgtgatgcagttcccttgcgtactctcttaccctcaactacaggttactcttagtgagacttcaaattgttatgtagtagatactttgccttatcttcctgattaggcatcatctagcttgatccacatctatttgtaatatatctatcactcatgtattagatattatagatttctaatatttctgtctctatctctgacagctcacacacgcacacttctttttgggcaaaactctataaactcacactgactccgtatcagtgagaaattcctgtgtgtttcttgttgtacaaatctttatctgcaacatgattttgtccaagttcctttctataaaaatgattttctgttctattagttctgttctagactattagtccatttttcattgctataaaggagtacttgagacttggtaatctagaaagaaaataggctgactgtcatagttttaccctaagaagaatagcgggacatggatatgcatgtagaaaggctgcatagatatcaattgcaacagtcttgtacttcaccttttctgtcttagggaccatttattggctacagaattaaataattatgccctaactcttttgtatatgtaagaattttacaactgtttggtggcttcttaaactgagaggtttcaatctttccaggaatagtagataaagatatgcagaataactagctgaaaaatcaaagatcctgactttaaatttgatgccttaaaaggtgaagccgagaagtatagtaaaagagaacttaaatcagggtcaagagactagggttgaagtatggctccaactctaattagctataagaatagatcaaattcactttgtatttcaggtcttcagagtatcaatgtcagggattgaatcagagggcttctaatgttctttccagctttaccattctatgtccacataagtttataattcctccctatttagaactcactgggccgtcaatatcatggtactgtaattgaaggacaaattcttgatatgcaccttgaaattaatatttgtgattatatatagtgttaattatgatttttttaaaaattaagaatgttagatttaacagtttatttgagaaaataacaattcatgaatcaggcagcactcagaaacagaagaggctcagagatcttttcccagtaatggtaacagttggctttttttttttttttttttttttgagatggagtctcaccctgttgcccaggctgcagtgcagtggcacaatggcacaatcttggttcactacaacctctgctgggttccagtgattctcctgcctcagcctcctgagtggctgggagtacaggtgcccaccaccatacctggctaatttttgtatttttagtagagatggggtttcaacatattggacaggctggtctcgaactcctgaccctgtgatccgcccatctcagcctcccaaagtgctgggattataggcatgagccactgtgcccagccaacagtgagcttttataaactgaacatgaaagcaaaatagagaaatcacctaattgtctatagctaggcatctgccttacttgggcatggtgtgatgagttggctgcatatgattgattgaaaaccaggctatttgttacaaaaatataatagtcctaagtcaggttttattttgtttacttaccaagttagattgtggtttgttaggtaggaatttaaagtatgaggacaggctcagactaatggtctcctgcttatttaatgataaatacaatattttttatggtatttatatattactttatagtttttacattttatgttccccatttttataataaaaacaactctttgagacatgttttacagaattattgtctatttttcaaacagaaaaactgaagctaagaaagttagatgattcactccatgccacactgctaatacatgacagagatagaacttaatctagtaaactttgctccatgccacatagctgctcagatttgaatagagaagataatgtttctgcaagcataaagtaggcttaacaactgtgaagccaaaacttcaccccaagaagcaccacaatgaactatagtatctaatgaagttaacaaaactacaacaatccgtggctctcaagaagatgggcagatctgttcaggttgctagtttataagataaaagtgaaaagatctaatatttgtatacaacattgtagttttcaaaagacatgcaagtgtagtaatatttagagtgtttttttaagactcaagcaaattattataggctgaaaccaaagctcagatagatgccactagatagagagattccaggttttttgattcccagactctagtcccactccaccacatggggtgacccaccgtcccagtttgcctgagactgacaaatttcccaggacataaaatcttcagtgctaactctgtgaaattcccaggaaaactgagataagtggataaccctaccaccacatttttaaagttgacacataatggcacagttctcattttacaccaggcaatcaatggttaagtcgacaggtctctgagatcactaagtgacccatcttgttatcaagatgaaacaggaataataatgataattgtgtaaccaagatcttgattatgatactaatcaaaacatttgccataacaatgtcaattatcattaaatagcatttccttacttataatgtgggaaccaagccaacaatataataaaccacccacgatggagtgaggagatgttgtctttgttctggaaaaggaccacataaaacaaactctagaaaattatttataaactgatgtgataatttgtgtgtgttttttaaaattgttaggtcctttaagtgcacttttttaaattccaaaacagaaaatgtcactcacccagaacagaaattgactttaaaatgtagccatttgaagacacggtactctctcctgtcataaatagaaaacaacttcctagagtttttatttctgttacttcttttgtgacactttatatagttatcaaatgctttgaaactaccctcagactatagatgtattttgcttttgtagtctctcaattctaatatcattgatgagtttattatagtactgagctctttttaatccctgtcaacttagattaagtcaaattagttctcatttcaatattgacaaagatcttgtttgacagcaagagtgacctctggtttcctcccagggacatcttgtctacagaataaatcgtcaactttttcttagaggatggcttagacatcttaggtgtttctccttaaagagagtcagagaacacgagggaaagggctgaaaatcatggctcaggacgtctaagttagacacaaggagggactacctggtttaatgtttgggaaatcctgggatttattcctaacttatgccaaagagtttccttacatggaaatactgagtgaaatgtatttaaaaaaaacaggtagatttgagaatagttctgaccaaagttgtagtgaatcataaaagtttgattggaaggcaagcagtgaagtgtgggataagagattcatgggaagaagggagcggtcacatttgaaaaggttatgctgtcatgcatctctagatttgaatgtgtttgaatctacattcaaagctgagtagcatctcaaaccagcttctttcagtcaggctgctgaatttctaaacttttaaattgtttatatgagagttttttttctgttttcttaataaaatatgggagtgaaaagaatgatggacattattaataactagttgcatgccctcatttttttagacaaggatacttaggctcaaagctgtcaaatgattgactctactggggatttgcagaggagttctgaatccaggctccttgtctccttttaccatgcctttacattgatcatctcttctgatcccatttattacatctaagaggtgttttcccctcactgtgtggcagtcttactaactatacaaataatcacagcaggttggtggactaaaacaagttacatcatctgtcccatagagtttgtattctaggttggaggccctggtagtgctctgagtctctagtctaccaagtttttgatgttcttgatgctgatatctcctcatttcacttgtgctcagagtgaggggaccacttcgttctgcagagttattaggaaataaaatgtgtatccccaaataggaagcacacaaaggctatgaagcaaactgtgtgaatagacacaaagtgtgctacaacataataaaattgattttgaaaagagatataacagaaggtagatgttcaaatgaatattattctgtgtatccagtcaaatgttgtttgcatagtgttggggtcccactttaaaaggcaccatcagtttcagtttcttgaggcataagggctatcagtttgagaattataatcacatctaaatttaaacaaaagaaaattgctaccaagaaggatcatccatctttctgcagatttctgccctgctcatttctatcctgttacatgctgtgagcaaaatatttttgcttaattcaatcaaattgaatgtaatagatgaagagttgatgccagacaactcttcactattactcaaagttaaatgttttcacggagagtacatgtgaactactgaaaagaatgcatggtctaaaaacattcacagagaggaatgacaaatgcatttgcaataattgggaagcattttttgaatgtttgcatcacttcagagtgacagatttgaaaggtaacattttttggttctggtgtatttgttgaaacctcaaattgtatttgcatgataattttcaaattgtttatgttgaaatatgacaggtttgtcaagagagttagaaaatatgttaacatttcaatcttaccaggctctgacaattatagcagtgactttaaattaaaggtttgattacataatcttgtttttacttgtttaaaaaatatacaataaaattggtctttgatctgagatcaggaattatagactctagttggtcgaatatccacattttggaatgtaattatattcaatcatcctgtctagattcagatatttttaatggctgggatggatgtatttgattaaaataacactcagataaattaactacttcttaatttgtagtttgttagacagaaatcactcagcctccagagtttattcaagtgtttctcaaaaggcgtgtgtaggcactagagaaagatacattttgtgtgtgtgcagagttgcagtgagccctggccacacactaaaaaccagaaggactcaggcaaaagtgtgataaacgaaaatgctccacacatttccaaacatttattggtggcaggagaggaggtactgactgttgttgaaaacttctgatcagataaaaataatataaattgtgaaaagataaagtagagattattagtagttgtggggcctggagcaaattatttatccctggacctcagtttcttcatttgtgtaaaaaggttaaaaataaggaacctcataacattattattaatgtgatgataactaatgtgataatgcatataaaattcctggtgaatcttctcataaataataggcaaagagtatataattaattaattgctattgcttctttcttttcctaattttaaattttcttttcaaagaaaagactagacttcattgctgggcaagcagggctgttgtggcagatgcatctggacatgaaacaaagggcctcagaaagtgggattggggatgtagctgttctagaaatggaatatcctcctaaagcagatttgagaatttcacttggttgcaacttacatgcatagttcacttactgaacatttaattctcacttgaaaagtaagtttttcatgatgtccagcaaaaagtttcctatgaagaggttttatctgttgcagactggttgtgaccagcagtaacctctgaggagctgatatgaccctcagatttagatatttcaaacagctcttcctgatagaaagaaaaaattagactgagtagttactggtcatttttctgaaaatttggcttctagagaagcagcaaccttaggtaggtgtctttgcaaactctcatgcatgttagttatttgtcagttttaagtgttataaatgctagattatcttatctaattcttcaattctgtgtgtttttctaaaacacaatatcatgtactagaaatattggaagcattttttccccaatagtgtttagcttgttttaacttcttaaacctgaaacagtttcccagagattccaaagtgcatcaaataccagtgtctggttcttcattgcctcttcgaatatacctacataaaaaggtcaaaatgttctcagctgtcagtgtctccttcaaaatggaagcagcccagagaagaaactgttcgctacaggattcattgtttccaagattcaataaacacttattgaaaatccacttgtgctagggcaaggtcaggaaaaccaggaccagtcacatggacaagctagtgaaatagattaagagtaatagtagtaaaaatgactctagtaataatgtttattgactcaaatgttctaggcagtttttctgagcacatgaaagtattaaccaatttagctctcccattaattctatgagggggttatcattattgtttctgctttacagataagggattgagcctcatggaattatattaataacttattttgtgtcaggccaaacaatcatttaatgatggagacaggatttgaaaccaggcaacttggttcaagactttagcccacagaagggcatgatttgctgtctagagaaccagagagggaggttccacagaagagataccaaaagataaatgggtgtcctccgggcaggtaagaaagaaaatggtattctaggcagagggaacagaatttaaacaggcttacaaaacacaacacgaagtatactgtggcactcagtgccaactcagaaggataatttgagaaagtttaatacaggaactggtttaatagaatgggtgaaatttcaggaaaccaacaatgggtgatacaatgcccctaggggctagtaatagcagggagttattatcacctcaaggcctaaaaggagcctttagtagaggaatgtagctgacacacagcaacctagcatggggggagcagggaatacatccccagattcactgcccactccccaactctaagcttctacctgtgctgtccactggctgaaaccagctggaaacctgaaggccaatgaatccctgaatgctgtccataagggtcagcctccctgggtgaagagccgggtaagtattgtgcacagtggatctggacaggcaaatggacaacctccggaatacaaaaccaataagttatgaaaaagttttggcaaatttttgaattgttttggacaacttaacttttgagtaatttccaaaggccaagtgcattgactgacagtagaaaacctatgtctttccctggagaaagatcataaaaccatagttagttatgtttgatggaaatctgttcccagatgtttctgaaatatgatcccatacaaatacagtagtaacttaatactagctcacactgaggaggttcgaaagcaaacttttctcaattgcccttaacttaattaatattttcataattagccaggagacttcctgagtgaagatgagatagatgaatactttcagctattagtgaattatctgggcacagaaacagccctgtgtttctttcaggcagaaaaataaaataatttactttcatctgcttctaattcaaaagtagacagagtgaatttgattcaatatcataaaaaaatcacctttggctgagatcatgcatggaaaaattcaaccccaaaggacagaatgttggaacaaaatatgcaagcaaaaaagtgggctgaataaaaaggaagaaagaatattccagttgaaatctacaaataatatgagcttacctattaatgttcacttctgcaaataatctaagaagatgattacagtgctaccaccaaggaagatggaagacctacccctatggacaagctgttcagagcttgggtaattgaactactgaataataaatataatagctaacatttgtatttgtccagacaatgtaaaaagcacactctctctaaaaggtaagttattattagcttcaatttatgtataaggaaattgaggtttatagagattaaatgagtttttcaggattccatatccaataagtgatattgttgaaccatggactcaggtctttttgactctacaggcgagcacatttatttaagaaagggagaataaatgtcagggtaacactacaataggcatactgatcttcagtgatgtaaattaattgattcagatatccagtaaacttgaaaagacagctgatgacttaccacttctgtggtggatatacagtgtctttcttcattttgtttctaagctttatgcatttcctgagtagaaatcagaaccactggtagactgtaaaactgctaagataaccaaagctaggccaaaagcacagcatttttttaatgtgggatatatgagcaaccgtgattagcccaaggctgaccttgacttcagtagtgattcacagagaaagtttcttagagaaaggtgcctcaggaactttgtgcagtgagacctacgcttgtcttgtaagctaacaaggttcgtagtattccctggtatgcctatttctcataaaatggtgatcaatcaacaactagaggtgaaaatatgtactaagcctagtagacttggggtcaatcaattaatacggttaaaaatatgtattaaatcaattaaaatctcagactaaaccatctcttgaggttaaggtattttcatttattcctcttgtctaaaactaggaatcccatatatcttctattctgggattaggtaaatctgtcttgagcttataaaaagccctcacaacataatagttattgagttattgactacatgtggtaaatgtttccatgttcacccaatccatatttttatggctaattgaccctaatcagttccccattcagattttatatttatatacagtattaaagaacacttattaatatatgaagtattcttgtgtcaggaaagtagtgtattaagtccatccttcttttcttcttctttgctctgatatattatatatatatatacatatatctgatatgtatatacaaatatatatatattagaatagaaaatgtctaattctttgggacataaatgtatatatacacacatacgtgtgtgagtgtgtatgaatgtgtgtgtaggagaatgtgtgtgtgtatgtgagtttgtgtgattcctattggtcatggcatgcagagataaaaggctaggcagcactctgaggcagtggggctgcagtatataattatgtaccccactcatgacaaaataacctagaggggcaaagggatggtctacaaaagaaccaccctcaccaggaatgctggcaggagaggcagggagtgtcttctctttgctttttatagcaggttatactcctagtatcttgcaggtacatgcattgaggcaaatccctcaggcctgtctggggagtgtgaggcaatctagaattcgaggggaccatttggccctgacatcaggcctcctggtctgctttggtgttgcctcgttattctactgaatccttcaagaatttgtaaaaacagaagcattgtctccaaaggaacacacactaaagtgtacattatgctacctatgagggaaagatgaatccattgtttgtatataaacgtgagctgattttcaggatgatccatggtgtctcatgcgtgggagcttgggagttgggtagaatccttgtctgagggttggaggctctcttgaaggaggcacacagagactactgagggagctaagcctggaattgtgcaagccttcatatgaaggaaaaaggagagtattccttgtctattcttgtagacaaggaatggggagtcagggtttgccattgtatgtttagaaaatagaaagaggatgaattaataaaagagtcagggatgagaccaggcaaaaaggagcttcccaaagaactactgaacctctttttctatttcccagttttacttttgttcagtcctgtctgtaagggcagtatggcctctttggtaatttatgactacaagtgtgtttctttatttaatgttttttagtaaaaggaggttgagcgttaagagatatgaactcaaatactatttctctctaactttgggactttccatttgatcactccctcagcttgcaccttttaaaattatgattaacatctgccctatctcagtattgaaaggcaaaaaaatgtgaagtgactttgaaaagtataaagcgttatatgggtgtaagagtaagtatgatttcaaaattttccttcaaattctcttaagatttttgtaagactagttgatcactatacacatattctatttgtacaaaatttgctgtgttgactgcatatatgtgtacgtatgaacacaaacaaacatatgcacttagtttcctctttctccttattttaaaaatcattattatcgtttgataggaaaaagacagaaaaacattttataagagtttaagcaacagaaatataggaaaagataatatatgaaaataaactagacaacgaacatttttataagtaactttaaaatctaaagcacttataagttatttgcttttgaggttttttaaacgaaccatctaagaaagttaacttttttcacttaatttcctacagtgggtctccataggaaataattggaacaatctatggaacactttttttctgtagcttctaagctcttttgtaaagtcagtagcaaaactgcctcaccaacaaaatatgaataaccatttccgtttcactcctataatctgttatttactccagagtcaatgtattatcaaatgtggaatcagcagttctcttatatgtaattataatggcaatgatttaacccagctcatcttattttcaagctgtcgactctcagggatatggtaccggtgtatgatgagcattttagagtagttccctcagaaatgagagactcatgcaaaatataatcgatgcaaggaatttttcttttaaaaagttaagacaaataaaaacatgaacatgaactttaaaaaagaatttacttaaaatatataatctagtataaatttaatgtatggggttgtgaaaataataatacacttttagagatgaagtattcaaacaagaaagcaaggatgtaaagaatgataggacagatggagtaaggaaagtaggcattacagaaatgtagaaactaggcaaaggctgagatactcctgtagtgtagaatgtaaggctaagtgtgtatttatgtatacttgtattgtattgcataattaggagctgggactctcaattaaatagcactgtgacctgagtaataagagtgtttatttaactggttaagtttattggatttaaatattcatgaactgacacaacttgattatgacaccttctttacaattgtgatacagagttatctacacatacttaaaggatggatgaattattcatgtctgggcagccccactgttgagtgtctggctgcttgatagatatgagtactccagccagttggcccaatacataaacagcatttaaagtcaacaggacccttacctggtccatgtgctaatattgcatggcagatacctgctgatgcagcattattctccctcatcaattagaatagaaaacgtctaattctttgggacataaaagatgcccaaaagaaacttggcatccttctctgctatccacaggtacaatttcctgttcagaaaggcaagtgttggtaattcataattcctcttcatggtactgatattttcccattctcccctactggatcttgggggttagaaggtgacattaaaacttgtgtgtatcctatacttaccttgcctaactgtgtacagtcttagttattcagaggaaagataatctgtttctaaatccatctctggactagaaagttaatgcatactctgctaaagcatatttgtcaatttattacactgtggaaattcaaccactgctttaggatattaaaggtaacactatgctctgctatcactattcaatattggggatactatggtaagaagttggatggtgtattgcagctggcctttaacataagatttaggttctgctatttagtgtttatttatttggcaattcacttaatctatccaggattgtggactcaataatattctcatttcaaggatatgggaattataataatacctatataatgagttctcttggaaatctatgaagcattaacaaatctgctttattagctctgaagcctcacaaggcaacagaaatcattctaaaatgtccccagatggtcatgttgcatcctttagtgtggaatatgttagtcaagttttgcacattacagaagttttcatgcatcacaaaatcaaaatgtttatagcttcactcctcttgtgttatttattttcagaggtttcttagatccattcagttttttaaccataattttaacagccttcaaaaaacaaacattaaaatatcatgttccatgatcaagctatgaatgtctctggtgcttacatatcaagatgtcccagcagcagcacataataggtgctcagtaaataaattataaagaaattttgggaagagggtaatcagagcatgtgtccttgattctttctccctcctatggtcatcatgaggcatcactaaagaaagtgtgtttggtaccctggaggctgggcctgagcatttgggttctaaggaaatagacggttcagcatttgagttttaggtaggcagaagctaggattccagtcctagagaggagaccttttttgtccctgaagaccaaggagaagtctagaattctgtaccttcccgagtgtttagttgataagatgccctccagcaaataaatgttccatcatcctagggagacttgccagtccaggtgaccttggagggaatggggagcagcaatgtgagtgggttgagttgcttccagcctctgagattaggagagggctgccacacattcctaggaggtccaggagcagaaagcctcagcagagggttaactaccaatttgttctctgattgtccataaagatagaggttgtattgtctttcccaatgttctgatttttcactgtttgatttgacttctcgaggcatatataccataatgagacaaagacaaattacaattaagggcattaacaatctgatagaagacttatctgattgtctggaatggcagcccctccattgaaacacaaacaatggaaatgtcaatcgagaaattttatttaaaaaattgaactcttaagtgagtaaattggaatatacacacacaaaatgcttctgtttagaatttaggaaacatagtccatggctttcaaaatccaaaaggtgattttaaaaagaagacagaacttgttgaaaacgggtgtggtaagctggcagatcaatggaagaaaaagctcaggccacaaacaggcaaagatatggaattcatgagaaaaggtgagagactgagagggcaggttcagcactcacatgcaaataatgagttccaaagagagataaagaatagagagaggaagagcaatacttatgtggatgataaaagaaaattttactaatgtcaagagggacttaaatgaacagattgactgagtcaacttaatcttaggcagaattaataaaagacactatttcgggatattcctgaatctatggaaaagagcatgtgtcataagcttccacccagaagaacaagtcacttacaaagaaaagatcagactagcatcagatttctcacttataatcttgaaagccttaagatcacaaaatgatagtgactacttagaacagaaggagaccaacatagacaagatgacatttatctgaggaaaaattcaagaaaatattttaaataatcaataaatgattcatagtagcaaggcataaatgaagaatactaataatattggcaagcaagaggttatgtaattcataagttaatataaatggctgggaaatgttgaaacaacttggtaatgtatttgttagataatggtttttgaaacagaagaggcattatatgaggggagaaaataaaactaatagcctggaaccaaagtttagcttagtaaaatctaagagttgggatataggaaaatgactccaaaagtaatattctgtcttgctgggctgcagtaaaataaggaagagtaagaagactaactctcatattgaaatacaatcataatagttaatataataattatattaattatgttaggaatagaagagtcataactaatcacaataaaaattatagtagaacttccaaattattaagaagaaaaaagggaatgaacaaaaagttgattaagctgaaaaatatacgaaagggtaaaagaaaaaaaaacatagtgcatactaaacatatcatgaaaagggtaaattcactcatttagttattccactaaaaatgaatgggatgaaatcctcttccaccatacaggaggcatgaatagtggtcatgtaatattgatattaagctactaacatgaagacaaggaaatattttgttaaattaattaacttatatgtgcaatttcctggatttatctccctaggttagttaatatatacactatgccatgcaaccccttttgtgagtgtagctatttctattgtgtgccttctcagtagggagtagtccctgtgtcagacctttggagtagacttcgctctccaaaaacagcccacaggtgggattttgggcaatgggacacagggaccacacttgaatttggtgtcaagtaggccaagatcccaaagctatctgtgccctacacttgccttatagttttatacaagtgacttcacctcagtgagattctgttttctcatctgatgtcacaaatgcttacagtcgttgtgataattgcacttgttgatgcatatggaatattttggaaatttctggacatagcaggaagtcagtgaatagcagctattttattattttcttccttttctggtctgcgagactcagctaatatgccttcacaaacaaaattcacagatttgggtaagccacatcattaagacttgacacagccaggaagagtgtggaaagaaaggaacacacatactctagagatctccccaaaccttagagtacagcaaaaggtgcacctgccagaacaatgtatttcatgccaaattgcatatgttcaaatgcaaaatttcaaattcagcagtgtctattcaaacccgctttaatgttcttctgaacattcttgtttggtagtcaactgtgctccattttcaagtatagcgatgacaataatttgtatgtcatagttacaatattccctgaatgcgattactcatcatgatcattgaatagtttacccttttctctcttcccctttgctgtgacttttaaatttttcattttgtatatatgttttaaaactgtgttttagaagttcatctactaacagtagatttttgttatgcataatattctattaaaaaggggatctcaaaggcaaataaaacatactccttgatcttacaaaactcaggctatgatgagaacacaagcaaagaaacaaatttattacagaagatgctaagatagggagaaactcgggtgctaggagagcatgaatgagaagtctttaactcagactggagaattagcaagggagtcatctgtgagtctagtcttgaaagagtgttagatttagaaagatggagtggggtggagtggagtagagagattggaaggctgaaaaagatggcaaaggaataatgaaagcaaaaggccaacacttatcgataggtctgttgagtgcttgtgaatgttgattttaaaaaataataaaagactccttactggatgcttctggcattgactattccaaaggcccaggactcatggatctttcactattttttaaccagaagaatctgtgattctgatttcatttgacaaagttcctggggtttttgcttatttggggacatgttcccctgaaggaagaaaatttaggaccttaggggtggggagaaacaagtagttttgaaagcatcacatttgttattttcccaaatgacaatcattaccatagactgagttctcacaaatgcatcccctctctgtcttcgaagtcgatcactaaagagatccacatcttctagttctacatatcacctttttaggagaccaaagacctctgcttcatttttcctggatccatttatcttggccagttttcagtttttaaaccctccactctagtggcaccatggagttttcccagttggctgaaagtctttagtgttggggcttgactttcaatttatctatgcttacattttgttttcatttgtcacatgatctctggccaaaatccctacattcctatgtcatgagaaagctcactcatggtcacaataatagattttaggcttttaaatcaactgtcaggaccagaaggttcaaaattgatatacaattagaatacttattggccaataaaggtcttctcctcttatcttgaggtgtcaaagctggtatatttaagactacaaattaaaaatttggagggaagaaggaaaataaaaataaattttattatactggtaattttatgaaaagtctacaagcttttatgcagaataatgtgactttcgtgcacagaaaatattcattaaaatgtgtgtgtgcacacatacacacatgcacactacaaaacaacaaaaggattaaccttttctgggataaggcaacaaagtacacaagcatcatatgggctatgcaaaccatgcaaattatttaaacattttttggtgtttttaaagctacaaattataatctcaatagatatcgaaattaattatgtagctcttctagctttcctctctttgtggaaagaacctacacctcttctttctctgatgtgcttcaacaattgttcacatgccctgaagtgtcagatgtcatcatctaaaacatttttgcatcagactgaagtcagtttgatcacagtttgggatcatagttgttttggtagggtgtgctcccctgtaatttctttcacctctttaatatgactgcagttatgtgcagggcttacccattagtgtggtctcctgaaaagttctgggagcaggtttgttaaatcttttgctttcctatgggatgcaattggataaaatgggagatttattccttcattcgtcctgggtacagaaaataaaaggcaggagcactgaagttctaatgctaaggcccacattttttctttctatatacttctgcttcacctgattttacatcttctagcatttatatacgttcctaggaaaaccttgttgtttaccttctgagcaatggtcagtcagtaaaatctttaacctggaggcagactaagctgtccctaaatgatcagggcagctccccacagcactgaggagtgcaggtggccgtttcagctgacaaaaattttcataggccttacaggtaattataactttatagattgacactagacctataaaatgatgctgaatcctaaataatagaggagaagaaggaggaaatgtcttaagtaagtctagattgttaccaacttggtgtcaacccttctcaaattcggagtcttggcagctttgaaattcatagtggtgggtggagatgatgctgatggtgctgtattgatcaataacaatacaagattttatctgggaaatgcttcttattaaaagaaggagtgttctgggaaatgaagaaatttccaaagacctcctggtttgtcaaataaataaatgaatgaataaataactgaataagaaaaaatccaggttgaagggcaattcagtcaagttaccctaatgtagcctgtatttttttctattcaaatgtgtttgccccgaagctaaacagccagctgtgttctgctgggtgatgtatgaagcagaaagaacactgtctaatttttatatccagttgagcctgaagtaccttgagatgggaagagaggtggctcatctcactcccactcaggaattattattcatgcaagaatcactcctcagttatctggtagccctccctaattccattaacccctcaaccactgggtagtaaacagggggaaattgtgatctaattaaaattaattggttgcatgacaattaagaaggagtttttgggttttgttttatttggaggggtggttgtgttttatttatttggtatttcctttttagggagggataaatattctctagctctcttttcatacatttatttcacgtttaatttgttttagaatagtcacctgtattggggttaagtgcttatgtaaatgaggaagtgtagcagagtacttatttagctatctccttaggtagaaatcctcattggaagaccccttcacctgggcgatttagctcaaacaacaaccctttggcttttatgggattctgagaaattgttggttagacttttgcttcctcactcaccccacaaaacacttacatagaaccatttagaaatgatctcagaaacaaaatcaagtgcacacagaattaaataaagggctccttgcttttgacaaagaccaaacagagagtaggctgctgagttggatatagataattattaattaacattatatttacatgactgtggagtcaattgaaataatgtttacagtgtgttttcgtagcatttatagagttaaaaaggagactgaggccataccaatatagtgaagaaaattgagattccagcagtgattctagtgcacttagtctactaagccaaaaaaaaaaaaaaaatagggttgcagtatgtttgatccaattgtgaggtaaggtattgaagattgcatgcaatacttaataggtactaaaaaaagtctgtaaatttcatagccatctgtagataagaacttgtagaaactcagatgttaaaagaaaagtgacatatggatcttaaaaaaacactgctgcattctagttcaccagctaccaggtactcccaagccatgccttcccctgtgttagggaggtgaatggcaaggaggaaaagcttgccatggcccagctttgttagggatgctatacaccacttactgcttccagagagaagcaataagtaataacagattcctcaagcacagtcacagttccaaataaactgtgtttggtgcatcaggaaacagaatgacactctattggttgagagcatgaattctggagacagactgactggattcagttctatccctgtgtgaccttgggtcaatagcgtaacttctctgtgccccagtttcactatctataaaatcatgatataataagacctacctcatacataaccatgtgaattaaatgagttagtatttgtaaggagcttaagatagagcttgacacatagtagtgttattttttaaactttttattttgaaataagtaatgctctctgatgagctgggtatatattatttttgttattgtgttgctgagtttaagtcaatgccttacactaagtgaaatccctttagcttaagtctcatctcatttgtgaagaagttcctggccattttatccctccctcaatgattccccatatatctgaactgaaaaggggaattaatatttgctgagcactcacaacgtgcttgaaattttacgtgtcaccttctatttctcacaataaccccgcaaagtgggtatgattacttccactcgacagatgagaagacagaaaaaagtaacttcacctcttctcttagacttaatttgagcatatataaaatgaggacaatgatactttcccctcagaacattcaatgaaaatgacttataaaccataaaattatatgactttatagttctgagagagaaatattactgttttgtatcacaagttagtttagctttctggattgtctctgatttaaagaagccaatagtccctacttacagacggtgcatataatgcgtagtagaagcccttagggaccccgtagttggtcagtgcaggtcagagtatagttccccgaaatttccatggcattcctcttcagcagcttcctcctccacagagatatggctgcctagtggcttctctgtgtggtcataagaggagtcaaaggactttggcccccggcaaagaaagtggaaatgaaatggagtggggtgcggtgatcataaattctgtcccctcaatatttctggtcctccttagcattgggttaaattagcacctgcatgcttgaggtcaggtgtggtcatatgacttgctttggactgtgaaaaccgatacacatcacaacccatgaaggtcttatagatgagcaagattctataagccttgttgttttaggccattcactttggggtatttgtaacaatagcataacctaacctatcctgactaacacaagtggaaaatgtgtcccttgatatgatgtatttggaagttctatagtattaaaataaggcagttgcttttgagatctgtcagttgagcttggggaagttgttggggacataggaaaagaggagagagaagatagtgaatagaaggatctaagtcacccaggttttaagtggctaccctagcttgagattaggtgcctggttctttggcaggcatttgtctttgatacagagctgggcgtttttcctatagaggtcacctgctctcctgattttgccaccttctattaatagcacagtaattcatttgggaaaataaaaggcaaatggcaggtggtgagaacatattgaaaaacgtgacacactagagtagagatatagagtagaattggtttaaatcactgttgccaaaaggtgaacctcagtagtcttgcagaacacctgagaatgtccaacgaaccaaagttatttaagagagaccactgaaagtctgttgcctgccattttctccagtaatattagacttagccaaacctttaaatagatagttgagtttaaaagaagagagagagaaaaagaaagacagaaagatgaaagaaagaaagaaaaaagaaagaaagaagaaagaaagaaagagaaagaaagaaagaaagagagaaagaaagaaagagagaaagaaagaaaaaagaaagaaagaaagaaagaaagaaagaaagaaagaaagaaaagaaagaaagaaagaaagaaagaaagaaagaaagaaagaaaagaaagaaagaaagaaagaaagaaagaaagaaagaaagaaagaaagaaagaaagaaagaaagggagaaaggaagaggggagggagggaaggaaggaaggggagagggagggagggagggggcggggagagagagagagagagagaatgaaaatccccctggtgtcagaaacataaaataaataacttaaagccaggtacaaatctcatgaactggtactgtcaatgcccagagagatacccgattggatataggctttagagtctaaggaattgggttgaatacccaaataaagtgaagagatgtggccttaggcctgtgataggtagggaatttgaacttacataaggacagacccttaaatgatagaactagaaagattcttcccactggcacaaggaagtgacctggatgcatttttctgccctgggctacgaatggacaaaaagtctcccatgaaaaactgaaaacaccaggcttgcctgcacaagctgtgggcatgggctataattttcactacctgcacactacaagacattcccccaggggataaattaatgtagaattgaggctagacaaggacattcctagagtgccagcaggaaacataggcaagtgttctctgtggcaaaactcccacagtgtccagcttcctgtgagaaaatagtaacgtgctaagctgagctcacaataaaaattgtaatccatgtaagggaatgaagagaccttaaatacatctattttaagtaagtaaaatagcatgaaagccatgaaggaaaagaacccattataaatcagaataggcatattgggaaaaggtccaaacagaacttctagaaataaaaaaaaaagttattgaaattttgtaaaacctaatttggtgtaataaacacctggtttagacttagataaagcattagtgaataaaaagacttttttttgttttgttttgtttttctgagacagagtctcgctttgtcaccaggctggagtgcagtggtgcgatctctgctcactgcaacctctgcctcctgggttcaagtaattctcctgcctcagcctccagagtagctgggactacaggtgtgcaccaccacgcccagctaatttttgtatttttagtagagacaggatttcaccatattggccaggatggtcttgatctcttgacctcgtgatctgtctgccttggcctcccaaagtgctgggattacaagcgtgagccactgcacctggtcgagttttttttatgtgggtgcgaaggacattaaatccagacagaaagagtgggatgcaagaagccatggtgaacagggagctggcaagctgttggtaaatctatataagcatagtctgtggggaaggggtgaggcagactgaggtcttgcctggtgtgtgggactggtggacagaaggagccctgacacaagagagcatgaggtgagcctccacctcaccaagaagagggtttgagcagagagggctggggaagggatgcttagttatccccaggggactgccgtaaattttcaagaggtttttaattttgaagttcaatttttaagcctagttatataataaacaccgggatactcatttgctgaaagtctcagtactcgggcttctgatccccttcttcttcttccttttttgttgttgttgttgttgttgttgttgttgagacagcttagtttggggaacagacccatgttacattttctgctttggatcttggaccagtaagacctgtgagtggctaacaaagaaaacggttgatacaacatcacacatcccatctcggtgcatcaccaccctggccagtcttagcctctagtaacttttggagcttaggttcctggtattttacctgcttggtttgggccatgtgcttgcccaaacctggcttctgactggttcactcctaccctggtttctgtctccttcgacttaactgccctgtgcacccaccctaacttactccagccctttcctcctcaaatccatcactgtaatcttggtccattcccatttgttgcatttctactcctgagtggtcactcccaccctacaaggctcaatgataacatttgaaactcttttcatatttatctccctgccacaagtcctttcctccttcctgttggtttaagggctgtagtttgattcagggtgcttcagaattccatggaggggcggttaaaacagattgatgtgccacatctcagagttcctgattcactcaattggaggtggggcctaagaatttgtatcattcacaagttcccgggtattactgatgctgctggtctcagggtcgcagattgacaatcactgggagtccctatcctgtgaagaaaaccacattttctctcctatcttcttagattattcttgattgtgctgtctttgcattttgttcccaccattattatggtgtagacaatattgtattatattatattatgttatattatattatattatattatattataattaaattatgttatatgggaattatttgcctatacatttattcaggtgaaagtcctttatctaggcataatccagatatcttaagagactgaatcacctcttttagtttctgttcaaaccattttgaacctaatatcttgttgtctccttgacataaagagacaactggcatgggagagttaaaagtctaagttctatccttaaagtagactagggcactggaaggctgaagcttgagaccttggcaacaggtatttgctcttctgcagcttcctgcaaggttgccatctgcatttatttgtagctagctcttcacgcttacaatatgtttgacagtacactagatgctctgaacatcttgtttgtctatataagaattgcatgggaggaagacacagagagctcaaggaacctacctaaagatctcacagatgataagtcacagagttggttttcaaagcccggtcaaaataaactcaatgctcatgctcttgggcatggtgttgttttgccttaccacagtttatttcatagagctgtattgggaagggccaccccatgtggatgtgatattgcctgcatgtactggctacatggaacattcctgagaggatgagttcttcttagcattagggttcagggatgaggaattgagatggatactggactaatgcatcctactttacctagaagagtacacagcttgtgatttgaagtagatgatggggcaaatcatacccattatctattaatctcttggtgagaaaaaaattatttataatatggtatttttctataatactgcataatattggtatctagtatattccaggaaatgagtggtttctgcagttgataatgaagaaatgttaacgcacattaatcaccctgaattttctttggtgaaaacatcctccataatgttgcttccaaaggaatccattgctatatcttccttgacctgtttttattgctaatagtaaagcacctggaggtcctactcccacccagtgtgtacaattgctaaataatttataatagaattagggaagtgttttttgacttggagcaaaataacttccatttcctcaggataaaatgctgtgtctttgtgttttctctttttctttcttttctgttgttattagccttcacctgcactttttttaaaaaaattggaaaacctccttgagtttcttttgcattcattcagcctcacttaatctcctgtcacaggccaaaggagaattacttaatagcattgatgtaaaccatatgttagagaaattgagctctctctcactggttagagaaagaattagataaggctggtcttcatataaatagtttaaggaacagcaagagtcttctctttcaaactactgatacttgacatttctttaaggcaatagttctaaaacccagttgcttaatagaattatgtgctttaaagaaatagtaatgcccagtgcttttccccaccccaagactcagattcaattagtctggactgagacctgggaatcaatattttaaaaaacaaatcaaaaccaaaaaaacaagaataaaaaatactccaggtgactgcaactgctttaaggcattggttcatatgtgttcttttcttcttacccaatacacctatgaaaattgagacactggcctgaggacacatgagatgctacagaagctaggaaagggtttatatcagagttgcttagaccattggttctcaaagtatggtatctgggaacttgttagacatacaaattactgggcctgacagaagaactttgggggtgaggttctacaagccatatcttaacaagccctccagggggttctaatgcccactgaagtttgagaaccattgtgtaagagtctttttacccagagtatgtttcagtctcagcatcattgagaagtctgttcgaaatccagaaagtcagccctacttcagactcaccaaatgagaatcaacattttatcaggaacatgtattattttttatgcataataaagtttgagatgcattatgttagagggagaagtatgtgtatttttttttaatttcactgatcccttttaagatgtattaattaagacaatgctaattgttatgaaagatgagttcagtaatctttggcttaacacaagacaagtatattttttgttcaaagtgaaagtccagttggtggtagaagttgtgtgttctgcacagtcatggcttggggatgacagaaactgctacttgcaacaatggcttcccaaagaaagtcatcctgaaaatcagcatccagtagcaaaagggagaagagagagtggagaatcctttgggcagttttcttgatcctggcctagtagtagtgaatcgcccacattccattgctcagaactcagccaaacaactccacctagatgcaagggatgactggaaaagataatcccaggatgggcagtgcaatccagcaacaactctacctcccacaatggaagcatgaacttctagcaactagtaatcgagctttgccacagtagggagatttaggaagagagaggtaggacttactccacttccccagaatcaccctggagagtcttcaaggcaaagtcctgtaccttacaattagttctttgtatttttgtatgaattgcagatacactcttatggtttttaagtcttctcaggtatcagcttcagaaggtagtcattgtagagattcatatacaatgaaagtatataggtagagaacaattagagtagatgaaaactcaaagaaaagaggaggcccgagtggccaactgatattaattgaaattagtgtttacaaggcacattcacatttgttatattttagatgtagcaaccttattaactagttgttattgtctaaaattttcgtaaaaggaaaacaggtcccagagaggtaaaaaactttcctgaggtcacaaagctggtagatccaaggctttcatattcaaaggcatctttattgtaaaatgtgacagagttgtgacagacaggctttgaggggtcctccatcatcccttccttcttgttgttcatgcccttgtataaacttcacttgaggagtctgtgggcaggactcatgatgtacttctaatctacaggatatgacaaatgggatgaaatgtcactcccatgactatgttgtcttactagcagatgactctttcttggtagcagatttgctgaagaatccgtctctcctcattgctggctttgaagaagcaagataacaaattaattaatctcaaaatgtaagaaaatggattctggcagcatgctgaggaagcttgaaagtgaattcttctccagtcaaacctctgatgagaactcagccccagctaacactctgattgcagccttgtaagcctaaagaaaggatatagcaaagctatgcccagactcctaaaccacagaaactgtaaaataatatatgtggttttttaagctgatacatttgtgatcttcaagtttcaaaggctttgggctgtatttttatgtacttttagtcacacatggtttttgtacagcccagttagctctgatctgacaattacttcatcattgatcttccataggtacaattgcattttcagcatccaattattcataaaaaatacaaaatgatagctactggattttccagttgccaaatctttattaacccagccatataatatttcatattaataggggcaaaggatgatttgatatattttattgtaatttcttgactcaaatttttaaaaaacacacggaaaagactgatagtatcttttttcctaactccttgatgctattgtcattttctttgacctctttttatcagaagttttctcccacttatagcagctaatgtaacagctgcatgtttgtgcttataaaatttcataaaatattaggaaccattgcttgtatgctttgtttttattttaaagctctcataggatcctattttgctgaataattgaagtataagggcttcaatcacatcttctacttttcctacgtaatgagtcccactctacctattcacattgcaggctatgaagaaaccatgaagaagggctagaccatgaaggacaggaggagggaaagtaggcaaggggtgttttgggctccagctgggatcagagaaaaagagacacaacattgagtctaagctctctccctctagcccactctggatattttgttacaaccagaaggataagaagaaggatgaacaaaataaattatgctcttttaagatagaagtcagattcctctattttctaccaccaatcagctctaagcaaaacccagtgctgatgctgtatgtatttcaaataatctacatttagacttttttttttttaaaaaaagcctgattttaaaaagtatgtgttaaatgttttcattctaggattccgttaaagggtatctatagatgcatacccacaggtaaatttgccttttgcatataaaactaaaaagtgtatcctattctgttttaggtactgtaaatttaattaaagggatactatctaagccaattacaacactataattaagaccaggggtcttatcttggacgtattcattcattcattcattcatagtttcattaatccaactattatttactgaacaactactatgttctacctgctgccaacatggcttagaccagagcttggaaatctacagttcaaaagtcaaatcctgtccactgcctgcttttgtaaataaagttttagtggaacataatcataaccagttgtttacatactgtctgtggctgtttttacaccagagaccatgtgggctgcaaagatgaaagtagttactatctggctattacagaaagtttatgatccctggcttacaggataagagatattgtgcctgagttagttatctgatttgaataatgaggacataagtgtttacctggtgagacttatattgttcggtgtacataaaagtgatattttaaaatatgaagtaacaagaactatcactcattgacaactcgtcaatgagtcaggtgttttgctaagctgtttataccaatgaactcattgatttcttacacctacaagggagctactctcattggttccctgtgacaaataaggaaatggaaaaatccagtttaattaacatggttagagtgtcactgccagaaacagcaaagcttgtccccccggctaaggaagatacattctcagttcccttatctgcctatcaagactgagtatctttctgggcagggttggaggagagactgaatgagaaagccagcctaaaggcctggctcagcacagagttgtgacattataatactagattgtttctgaataatcatccttaaagattatttcaccagagctgcccaacaaatatatttgggcaattatccattttgagtatatttattctttatgagcacttatgtccaatgacataaatgtggtcttagaaattacatgtaaattgtatgcgctcatgtactatttctgtcctgtctgaatgtcttgaattcagttacttaactcaacctgtcctatgtgtctaatgaagtattaaaggctatactctttctgtagaacactcaatattaaatgatccattttacatgttatgcaaatcttacagtggcatatgctgtgaaacatatttgggagtgagggagggagtgggtaggtaggtaaccaccctaaacgatgaatcactctctgtttaaatgctgttccattaattcaagtgacattttgataatagcatgctgtcagtccaatggtctgacctatacaacaacctctaattattactaattaaataattaattattcatagaagtgcatgccattagcatagcagagatgtgttggaatatgagttatatgaggtttatgaatcttcagaaaatagattctttaataaattaataaaggggctctggggtttcattaaaaggtggctggagggtgtgcttgcctgtttccaaggagaccacaggtggttcgttgctttttttttaagttaaacttgtttgggctagatgattttttttttccacccttttctcactgctctgtcctcaggcagagaacggaacattttaatgaaacccctgttgtcttcatatcactttgatccccctgtgttctctccagtctacacattggccagtcggatgaagggtttcagattttccccccagtattaaaaactgtggcatgccctccatgaataaacaacattgcagtggagacccagtgaaagagaaaggcagagcaaacaaagggatgaaggaaaatgcataaattcaaatgacaccggcctcatttacccacttaattaccctgactcctgactctgttagccactgcgattatttttccagttaagtctgatttaaagaactgaaagaaaaataggctcatccatttttttctccctcaacaatctctttgccacatggagttccactttttcgttatctcaccataataatgatcatggtaatattaatatcttccagcgctgctcactaaatagtgataaaaatagtaatattaatgttttccaacatccatttttgatgctctgaggcacattataaattctgtctttgtttaagcagtggggaacccacaaaatatcattacagttatcattagaactcaagggcactctccagaaactgaaacctaagtggggctatgtcagcaagcattccagggccatggatgaaacaaaaaaaatggaaaaattaattttttaatactgtttcaacatttgacctattttggaaaagacaccttttttttttttttttttttttgatctgctggttattctcacaaatggcgaagcagcttgtttgtttttctgaacttagccacaatcagcccttcaaagtcagtagggtccatccatttttctcccactatctttcaccttctacaaacaggaggggaaatggatctgcagcaacagcaatgatgtgcttcctatgcttccagagccatgcgactctttacttaggtagtattatatccaggtgagggatgaaagaaagaaaaggaaaccttcccatgactgagctgtggaaggccaaagtggaaatgctgagtacattttcattactaacggagcctgttaaatggaaacaaagctttccctggaaacctgtaaaagaaaataccctctagtgttaggcttaattttctgacatttccttttaccttcacccgctccatatgaagaaccagctgcaagctttggcataccccaaccactctgctatggctgtcagtcactgggagactggagatacctttgcacagttggggcatggagttagcagatcctggccttagttcaacactgtgtggctttctccatttttttccagctccctggctttggcaggtctttttttgttgcttttgtttttatttctctcttttaaattctcttccttctcttcccagctcctcagatacaccttcatctgctcccatgtctcctccactccatcgctatgtgtctacttggttattttcttgaagctgtctgctaagtgggcagttattttcattttatttttaatttggcaaaaaaaaacataggtggcacagtttataagtatctggactggaacatacaatcaagagaggtaaaataatatcaagccattatagttaattgctaacacaaactgatgtttactaatacttataggaataagagtcattgtaggaaaatattattaaccccattggcatccagggctccaccctcctttctaaaaaatgaactcagggaagattaaagccttaattaaacacatactttatttctgtattggcattaagttttcacaaacgacagccatttaatgtaaaactgacattctggcatcaatcacatgcccagaagagtcagataatcaccaacagtttataataacaccacaccagaataattaataaagtatgaagttcaatgaaaagaagtgtgtgctccccaataacacaatgagaagatattcaattccatgcgttaatataaaggtttgaggctctgaaaattagtgaaagaaattaagtatttggaggcttgtgacaactttgcccatcctatccatttcggtttctatttttttcttcactttttttttttctctggcttcactagatgagatttacttctcaaatttgctggctttcaaaagtataccaatcctctagtaaattcaaaccatgttaatatcaagagagaaatattctgttacaatataatgattatttacattcttaaagatatataattgcctattagctccaactttgtataaagaaagagctaggtgatctcttgaagtttttcccagacttctgagtccatcattaacttatcagccttatggcaatgtctgtgcaagcccagtgaattattgttctctgtaaaatcaaagcaagaggttagtaaagttagctatttcatgctgaggtttgaaaacttaaagtgagcttttagagacactgtctttacttatctaagccagtgattaatattaatgaggagtatcatgataaatctttccatgcaagcatccatccatcactcacccatgaaaacttgaccaagtgctatgagaaaatcagcattctgaatcctatttgcagacttagaaaacaaaaatgaaaacttaaaaatgaaaacttggtgttgttcagaattattgtttggaagcatgttttaaacccatgaaagatcttaagattggcctccaaatttgttgctactctgttctttaaagcccattcgtcttgctactctcaaagctgaatattctgtatctattgtcttctgacccccatggagccataatcagggggtccattccatgggagtagagctgcactcttactcttattttcccttctacatgggcttgaatagtactgagtcttctacctacctcagcttcttcccctactctttcccactttcttttttctccttcctacagacacacatgaccattgctcagctacagtgagacaatctggagagaagtctgtgttttattttaattctataatgtccccccattcaacatgttgctgaatatatcataataaatatttttgatgaataaggttgaatcaagcctattaaacaatgtggcactgactggctcttaactactcttttaataaatctttttaataataatttatatttatacactcattaacctctatggtgctattatctgataagtgataatgtactacctttctcagagacatttgccttgttagaaaatattatctttatgaaaagtaattatataatagtgatgcttcatacacattaggggaaataatttttgatgaggaacttccaatgtctctcaaattttgttgccatatattggtcttgttctggttctttcattagttgcatttagtatttttcagctacttgtatggtcaaatcatcattattctgagtgagtagaaaatctttggactggatctcaaaacaggatttttcttgtggtattaagttcctattgttgtcataataattaccacaaacttagtatctcaaaacaacaccaatagattatgttacagttctgtaggtcagaagttcaacattgttgtcactaggctaaaattaaggtgtcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattaaggtgtcagcatagctgcatttgtttctagaacttctagaaaaggatccattctcttgacttttccatcttctaggggccacccacattctctggcttatagactctttccttcattttcaaagccagcaatatgcatatctctgaccttacttctggagtgacatcttcctctgaacatagctaggaaataatctctgctgttaaggattcatgtaatcgtattggactgacccagataaccctggatacctcctcatctcaaggtctctattcttaattagatctacaaagtttctgtgccatgtaaagttatatgttcacaggttccagggcatagacatctttaagggctgttattctttctaccatactcattataccataaaatatttcagaaaaaggatattgtcaaaaagagagttagaagatcagaagcatggatactgtattattaggattgagaaaaaagcaggtgtcacacacaggctgaataatcaaggatgattcaataaagacaatttataaaggtaaggggaagggtagagaaaccacagggatggggcagcaccacagggctagtgacagcaccagagccattactaacccttaactgaatgggcacttggaacaagcagttaccagaacctggttagatatctgtatagagagggctgcctgacaaacgtgatggctttttggtatatgggagttgtcaaacgggaatgactgtgcagggagataatttgggaaataaatggacaaagactactttcctccatcctccttcaagcttttgccagtgccatatcaattatcctccaccccattggctgcttccaaccagcagaggacagcaagggagcccatcgacatagtccttaagtgcaagacaggatgaatgagagtgggaaatacatctcgattgacaaacataagatgttttgtgcaaatggcaaacagagcatcatgttggaggaggtaggcacaacttgaagaagatgagactatccagaggcaaacaaatatttataaacaaatgggccaaaaaaaagctctatagggacttattctgacaccaatgaccatactaaaagcctatatgccccagattcagagagaagggacgggaccttaaggacataaaatcatgccagacagtaatggagctaggcgaatactcctcagttgaaatctgcatagaagtaatgacagtcatagatgggaaatcactctgcgtgaatactttacacatactatttcgctggccaggtatgataattttcctggtttcaactagatcctgagttgaataggacaatgagtgggtattaatatttattgagcacgtcctatgaattggacactttgcatatattattttaaaaaacacttgtataaacccagaggcacgtgttactatcttcatttcactgatgaagaaatggaaactgagtgacattcagtcatctacttgtacattcactcattcaagaattgtttattgagtgcctactgagtgccacttagtacatgaagtatttagatacaaagttaaataaggcatagtctctgtttctgttctctcttaagcagaaatatacattttaacagataatttctataaaatgtggagcataaggaagaaatatgttcttgaaagcccacctgaattcttcctttaacctgagctcatgctcttaccatataaagtatcagttccctgtctttgcatgtgggtctcctgggtgtatccaccactggcagagaaagagttttccatgattttgtgttaaccaggagagctgtaggcaactgagagtcagagtccattcagatagcaagatacgtgacagaaggttgactgtatttcctttttgtttatttttatcctctctctgagtaaagggaaaagaaaagaaggcccaataatattcaatggttgttcaccagggtctaattttgaagaatgtattgaatggaaagaaacttaaatttggtgtatccatcctcttccatcccattgatgtgaatatttcaaatggttcatacactacacactctttcaacacacacacagacacatacccatacacataaactcctacaacagctgagtctgggtccaggcttctaatccttctcagtccaatgtcccaggtagccacttccaacgggtcaaagtagtccttgaaatgtgttaagaccaatgaagagtagtgaaacacttgagactatgtatgtcagtggtaggctgttaaagtggtcatgatatgctataaggatacaattttaggctctcaggaagctatcaaagaacttattgctacttcttactgtatctctgcccagtgagctcttagttacctctttgattgctttgcagcatatatgtaggtgatttcctaaaggtttgacatcttctaaacatttggccattccaggttaatggttaatctggcttcagtagctcttaataatgtgtctttgtcctcagggtccttgctatgattacctttaggcaaggttatccttgagaatccaggcaaatgggggctagaaatatatcttacaagtccttcctgtagatttagaaagcaaaatctccaacttagttaaggctaaaagccaacacaaaggaatggatcttggcctgaatgtatcttacagccttaaataggctacaactagactcagtcaaagacttcatcagccttggagatctgctaagaaatcccattttccaactttaccagatgaagcttgggaggacaatttaatgccaaccttgaggctgactacatggaagagaattactggtctactagatggcctgatatctgaatcatacttagttatcaatcctcagtttcttgtacacgattatacagtgatatctcacatgccaagatacggaggtggaggagtcacatggtgtctgtcacctgagagaatttgtaaggagactgggagtgagtctgtataagctggagctcccaagagcgcttcttggccttttccacttccagtgtatttggataaatgtatatgggtatttctgacattacccttagctggatataggaaattgagttatatgcaaatatgaaatgcaaatgagagtcacaggtctgtgcctctgccacagacctagaaatgagaaaggaaaaggatataagcaaactggctataatgttctagtttccaccaaagctttggtcatgttagtgtagatgaatcagtgaataagtatcagttacctcattcatatacctcctgcctttctttcttaagtattcctagacttgttgagtctcacttgaaatataccttaagaatacaatttgaatgctaaaagttataaacccataacttcccatttgaggagagatatcagactaaacaaacatcacagcaagtcctctgtggtcactttatcttcatgaagcatccccttattataaaaatatatgttataaatgtgtcttttctattatctaatagataacacataaatatatacaaacatgtaacatgacagtacataccatataacatatagatgtataagatacatgtgtttttaaaatctatgtgacatatcacatatctatgcagcacatgtatacatgtacacatatgtgatgcaaatatatgcacacatgcaaaatgtttatagcatatgttgcatgtagcatatatgcatgcaatacgtatatatgtattataagtcatgtgtgcacagtatgcacatatataaatatacattgcacatttatgtgagttggtaagtatataacatatatcacataaataatattgatagcatacaaaatatatatctatataacatatgtacctaaaccataagatatatatgtgcatatctctatataacagaagacataatcttcataactatttataacttcagaacacatacataaaacacacacaaataacaatttaaaaaatatgtgtacatgtataatatattataaatatgctctcctttctcttccaaattgaaattcataaatataaaatgatttcacatgcaatttaaatatttaataaaatgccctttaataaagaagaaatagaaagcaattataataacataatatgcattccaatttggaaaatcttaggcatgactacactagaagtcatggtgattaattagatttttttctttacccacttacaatgactatctttggattaagagttataaaaaggtcgtaagtcattgcagtcaagccaaagaggaaaattaaagaactgaggtataagcaaatactagactaaaaactagcattaggttacataataacaggccaaatttatttgcataatatgagagcaagagagaagtaatcctaactgaagtagggatataatgctaatcaccccatatatttgcatacatgaatggactgtgatatacaaaacagtcatgagtgatgtaggacaattctttattgtgtcagactgctcaaacactgcaggacattagcatccccggatctcacccactaaattccaacagcacatccaactattgggacaaccaaaattgtccctgtaaatttccaaagcacactcagggactagacctctctccttgagagccactgttatgggaaatgaactaaatattgcttttatccagatcttcaacctccaattaatggatctgaatgaacaacagcatacaatttaatttgagattaataattctattctgttcatatttaaagcaactttacaatgtttccatatactgagtattcttagctgtcatatcatacatgtaataatgtaaataggtctcaaacatttggtacatttggtctactcaggatagtctaaaactctaggagaggtcaacatgttagtcttgccacccataagaccacttatgcaatgaggataatgccacagtgatatatatagatgtcatagtgaaagcagccttaataattaacatccttttgtactcaatctcattactaatgtggttcacatatggcctagtgaaactctgtacacaggaaaattgtattaaaatatatgaagagatagctttcaagggaaaatgtcaccaaagcataatacattttctcaggggtatcaagaaggaacagtcttttagctttgcttggtgattttgggggcaacagaaaatgacagtatgagcatgattcaaagaccttttcttaggactcatttgccctcgctcacaaggtcattgcccaaactaccaaaacttcccaaatatagggtttgagatgaccaccctgattccatgcatccttataacactctctaaacaacaaggagtaaatagggatttcattgctggcattcctgtatccaacctgggtgatgagctacatttaaatgcttcaaagtcacagagaagatacaagtgtgatttgcattttgttctgaacaaaatcttaagtagtcacatttcatacatcaaagagagtaaactcacagtaagaaccattgcatatgttatctactcttatgtgaaaatgtatggggaggtgctggacttctatttgtcattgattaacaataacagcaaatatttgtggagcatttataatgtgccaagtattctttcaagtgcttcactgatactaaaccatttaatccagacaacaactttctgtagtattttctatttctccaagttacagatgagaatttggggtccagagagattgagtaacttgcccatggttacatattaggaaataatacacatgattcagatccatatagtcttgtcgcacagccttctcttttaacaaatacaccctattgtctctgtcattctttactgtcctgcaaaagaaatgtatcacctgtgttttaagaattaaagagaaaaattttgtggttggctaatctggtcttgatgcctgattataaaaaaaaaaaacaaaaaaaaaatctatagcattgtcaacaatctatttcctatttctaaaagaacttttaattttctcactagccttaaaaaaagtgtcttttttaaaaaagcagctgactttccatcttattaaatgtctaccttgcataatgtcagagaaactcattctaatgctgcccaggaaaactaagattaattggagttaaatccgattgaaggctatgtaagctatgttcttttggttaccagatccactcttctgtttgcatggatcagcatcctacctatttttccaactcccaaaagtattagaagccacaagcacagctcgctccatttctcttctctttttatgcctccccttttccttgtaaccagtattatccatgggagaggttccacatgggattttccaagaggccaggccagcttgacacacagggcccttccttactcagcccaaccgcaaccctcttccacctcctgcttcccctcatccttttgattgtgtgtgcttttccctttcattactgctaatggctctgaatgggtctcttgtgcataaggagagacaatagtcttcatttaatggtattatttacaataggaaaaatagttttaaaaagagaaagtgggagagacagttatagcaagaggcttgactgtgaagcctcttttattaggggtctggcaccctcctcaccttttcctggccatcagccaagctctccttcactccagagcggcccttgagttttgctacagtttccgtatgatgccacagcagccaggctctatggtgtgactcatttccgcagcaagagtgctccagtacattaacagctttctcttctttgatcaagtgagaccagggcatccattctcatggccagtgttttcatatgattagtcttttcccaggcacacctgcatggaggacagaaggctgcctgtagaggaagctgctgagcctgatttcattggaagagtaggtgaagaagggacagctgagaccccggggctactctggcccaggcatggtccttgtgagaatttgaaaactctgtcttctttgagccagtggattaggaagagtcgcctgtctcagtggacacagccctacaagccccccactgaggtccacacacactttgcacaaatgcaggactacatgcagcaacttgagcaggatttgatgtctctaccagccatttgagcttcagctgacaatagcagtgacatagtgccccggcagagggcatggtacctacgcccagactgtgtctagagtttgaatctcgggtttaccattcgttgcctgtgcaggtctattatcttgggcaagttatttacttgttccatgtctcagtttccttatctgtgaaatggttatgcaataatagcatctaattcagaggtcactggaaggattatgtgaggaaacttacagaaagaatgcagaacaatgccaaccataaagaaagctctcatcaaatgctgtctgttgtgacttataaatagcaaagtgctaaggtaacctagaccttagcaaaaattgaaaattgctgatgttacctccaggaattccagccttatcctctgtactttttttaattatctgaattctccccatttttgagtaaaataaccaataatgactgacctttactttgtgttcattatatgtcagactctatgttaaatactttgcaaatatgatattgtttaatcatcccaacaactttctgaaataggttcttctattaaccctgtttttcagatgaagagcttgatgctcatagaagctgagcaacttgtttaaggtccaaaagccagcaagtggctcaggtggcatttgggaaaacctcttatctgtataaatatgcataaatttaataccttaaggtattgctttttttctttcctacttttgtgtcgtaaaattgtatatttcttaatattcctgctgactcctttctgaaagcagagatcacagtatggccccttaagaccttacaaatagtttggtatgactgcctatttagaaataaaatgaaagtggtaaacttataaatgaaaacatcctacccacaatggtatgagtttaaaataaagtataatgaattgccccttccaaggggcacatttagtgtggaacaaagaaatcagtcacatcctctcaaatgccagcgaggctggtggagatgggttgaggctctgtgggttgctcagtgtcttcaaaatcaaagcattatcagccataaccacttttgtgtatttttaagtctggttctatcttgtgtcctcgctagtttttctttttcttttttgtttttttgttttttgttttttgtttttgtttttcgagacagtctcgctctgtcgcccaggctggagtgcagtggcacgatctcagctcactgcaagctccacctcccaggttcatgccattctcctgcctcagcctcccaagtagctgggactacaggcgcctgccaccatgcccagctaatttttgggatttttagtagagatggggtttcgccgtgtcagacaagatggtctcgatcttctgacctcgtgatccgcccgcctcggcctcccaaagtgctgggattacaggcgtgagccaccgcgcctggctcatgtcctggctagtttttcaagtaacacctattagtattagtattagtattttaatatagatagctttgctaacagactatatttttctcattcctttcctagactattattttatttgtctctttcttattttatttattcaattttcttcaaattgcaccatttgttacctagcctgagggagcactggctattaaaactgcactaataattttaattgacttaaaattatgtaagaacagcacagcagccaagaagtatggggcctccaaataggtgcaacagcagagagaatgtgttgaacaaagcaaggtggctttaggttctgaacccccaaattcagcaagacgttactgaagaggagatggtctcatcgggaagtccatatgggccacattgcaatgcagttatgcttctattttagcacacattatagtggaaaatttaagtttccagaacgaaccattggggcaagagtgccatgaggtgcaattatttactgtataaaagttgtctccgttgaatataccctaagaatatttaaaatttgatttaaaaactatttaaactatttatacttaattgtttcagactgtaccttcactatagcataaaatgcatctatacatatctatacctctgactaaccctgttctaacatcaaatctaacaagaagtttaaaacagaataaagaaagtaaaggtggtggaagtatctactgtatgtcagaaaggtaatttgtatgtgggcatctgaaaagtagtgaaaagacaattgcctttcaaacgatattgggtggctgttgtagtctcaatttttctcttcttaaagtgggagaacactgatacctgatccagcaacctttgtaagtggaaagagatgatgcatgaaacagcattttgactgtcacagtgcatgacatatttatgaggaattacatggccatgctttatggaaggtatatgtgttctagtgtcagctcccagaaagtggagcctagtggagtaattgcaccacacaggcaatcttagctataacatgatggcagccatctactctcctttaagatcaagctggagaaaagtatagttatataacatattggaaatcttagggattattacatacaacttgtatattttacaatggaaaagctgagagccagagaatagtaagtactggcccaatgtcaccacctaattacaggctgtggcaataatagaactcacatctctcaatggttcaccatatggttttctctgcaatatcattgtcactacttaaaagtaatgtgacatcttcatttcctagcactactcctcatttccattttagtcaggacatattacctaaccgattttggagggagttgtacattcatgtgcagtgccacacaaatggcatacaaattatttcatctgaaatacaggctcaattgcatattatgctaataaaaaacatatatctcatcaaaagctatcatgtagtaacatcagtatataactgatgttatagaaatgcaataccttcccagtagataactgatgttatagaagtgcaataggatttaggatttagttctgcctttgtaactatttcctactcttagccatagtggaaaaggcccacagtctccttctaaagaccttgtagtacttagagcatacctctattagatcacacattatctccagctgtcaggctggcagctgacagctatcaactactgtatctctaacaataagcacagtacctgagtacctaataaatgctaaattaaactttgatgaatgaaagaggaaaatgagtaaatggacaaatttagaagtgatagcctgttgggctggggttgaggcaagattcaagtcttgggaaggttatgataaatcagacaaagttcttatttcagcaggatctttttcattagactcctccccactaggacccttcttgagtcttgagtactgagctcttgattggaaccttgataacaactcgctactgctatgtgactttagaaagctctgcttctgtaatatccatcttattattttaaaaataaagtgcctgaatctgatcagaatctgagttgcttgttagtctaggctaaggctggcggattagtcatacatgacaaaatgatgaaatgggctggggagacacagatacgatgaatacaagcattgagaaaagtcttaccggaggatgggtacaagagattgtatcatgctattctccatactttcggtatgtgtgaaattgtccatatagaacatataaataagttttgttttgttcatgagcaactaggcctatgagtagaagttagagctagagcagcaaaatatattgaatttgggaattgggtctgtgctaaagcagcaccaagaagaatgtcccatggagacatactggtgtctggaggtgccactgacgttctcttctgttgactcctgtgcctttcaatgcagtcttcactggagttggaagctcaagcttgttagggtagatcctgctctttcactccagtacttttgtcaccctccatcccctgtaactttgataaccatggacaatgacagtgatagaaccttgggtcaggttgggggctcaagttgggaggcttggttacttccgagttggatgaggatttttgcttatttcagcaggatcattttcattagacttctccccactagggcccttctagggtcttgagaactaagctcttgattggaatcttgataacaactggttactactatgtgactttagaaagctgacccagcctctgtggtctccatctcatgattttcaaaataaagtatctgaatctgattggatatttcaaaggtatgcctctactcatcaacattttactattctttgttgctgagcacagatttggtctgaacattcttctcaatgtagtatgacaactggcaatatctggcatctctatcaaataatttctgagttccttttaaatgagcatgttaaaatactaaatgcccatgttctggtttcttgtatattttagaatttgtgacctctggtcacaaattcaggtgactgaaattagatgattttctccatataactttagatcttagctgattatattgttgtttactacattcaaaaatgaattcataccatgtagtctatcaaagttatctatccatttatgtatttattaaataaatatggagtcctcaccttgcatcctctcatttcctgggtaaataagaagctgaattagacgacgaccttgtcctctgggagctttcaatcaagtaggaaaaataaggaaagacatatgaatacttaaaaaatcaggcaagatgtgataaatgacaaaattgaaacatagatgaaatgtttcggagtttaggaaataagaaaatatttctcactggtgtaaatgtatataaaatttaaacatgaaaaatctattagaagccctttttgtccatctgatgcaagaactggcttccacaaatgatgaccaggagcctgtcattatccaaaaggagtgatttgatagtctataccaaacctggatatgttctactgacttttctgttgtttttcataaactcaaagagacaaaactgctcagatatattttgcaaggttacttgctacagcttgaattttatgggagctggcattagattacagagtaagccatacagctgaggagcagttaaatgtggtacatctgtcttggcttctaatagacgtgcactgatgaaagtggtgggcatttgaaggaggagtatctgtactctttctgaaagtgaaaggcttagtgcaagatttagtctgtagtctatagtacacattaaaacttattccactgtagtatttaaaaacttgacactggttccatcttttcaatgaagaaatatacacgcaaagaactgaagtgtatttcttaagtagccactttcacttcatagaaaatcttggaccagaaagcacaattccttgttttccaagctaccacaaaatcataatttctactattaattaggtctgtttttctttccattaacttaaatcatccaccatcccccaccatcaactgatccaaatttttcagactgcagaaaaacttatcatacaattgttcatcaatctatattgtgaaatagctgataatccttgcaagtgttgcaagctttgtacaagagctaagtctgtcactttttatttgtgctgtctttcccacctggaaaactttgattatggggcatttcaaaggggccacacaccaggacagttaaagagggttaaatgactgtgcttaactgaagattgtttaggtgcaattctaaatgctcactgtatgcaatgaacaaaataaggcttaattagcttcctggaagactgcttttattttcagctttttcttaaaaaaaaaaaaagagctcacattagcaatgttttggaaagtatttcctttatatatttaatttcttgcaatgtggtatcaatatgttccctttaaagtaaaaaaaaattattgccaataacttagtttcatgtattgagatagctatcacatccaatttctatatgcctgtgaaagataccccccaaactacacacaaatgatataatttcataaatgtagatgcacctaagtagatatgaaaaggagggaaatttacaattataaaaatacatagctagaaagcctcatttatcagagataacattgaattctatagaataccctggtgcctgctttctgcacctgcacccaatagactgagcatgaaaatgcaaatgaacaggaggagtatacagtatgacaaaacaggagtgtagaaaatgcttgatttcatgcctgccttctaaataactctgaagttttaatttattttcttaacatattgaacaatggtgacatttctaacaaagcacatataattggaccagagtaaaaataaattagtgtgtataaaaggaagacgaagccaacattttcttggtctcttgacattatctaccactgtccagttccctgttgttttcctcctttcctttgtttcaatttaattctatccagttccagaagcattaatggagtatatgctgtgtgccaagcactagacttggtacaagagctctagaaacaaataagatgatgcccatgttgccaaagaactcaaaggtggaggagaggagctgcacttgcctcactgtaccatagtttacaacaaaaaagtgaatccaaaaaggattcggaaatggaaagtgaagatggctgttagggcaagtctttccaaatgaatagatacatgaaacaagtgttcagggataaaaggtacttagctggaggaataaaggaggaaacagcattccagaaaggtataaagtagagagagaatccaggtttccaaaggaaatgtaagtagtctagtgagattataacgtagactttaaggtaacaaacaccaaattatgagcaggggaaaaaaaatatgggatccagaaaataaataggaaaaaataattttgaaaggtgttgggtaatcacaggtagaagtgaatgctgaatgaattacacatagggctcacataatttttaaaggatatttaggacatttctaacgataaccaactgaaaataaagctcaggcatagtcgtcaattcaatgatatggactgggtatcactatgtaccaatacagttcctggtcctgcaagaatggaagtgagcaagatgagtcggatccctgctccagtggggcttatgggctggtaaggggaactgacactaaaactaaacagagagatgaacaagagagtctcagatcatgaagacatgaggacaagtggcacaaggtgagtgatcgccgaagagagtgcttaagggatgccgtttctgaagagactttttgcacagaaacttggataaagtgcagaaattagatgttggaagatctgggagcagagttttccaaaaggagatagcataattgacaattgcaagcaaagcgagaaaggtagcctgactaaagcaaagtaagcaagggaaagagtgggaggacaagaagtcagagaagttggaatggagcaaatcataaagggctttgcaggccatggtaagaaatttgaactttattctcagtataatggaaatattgattagttttcattggagggtgcatatgatcttatttgaatgctccctttgctttgttccaatatttgtggtcacatcatgtgcatagaatccacatccatcacgaaggatctgcagactatgtttcatgtgttcaagacagaaacaatgcctctatgtgactctacaaagatgactactatcacttcctttcctttctatgtacacgtgttgctcctaatgtcaagggatagagccccgtttccctttctttgaatctaagctggatttagtgacttgcttgaccaatataatgtggcagaagtgatggtctgattttcagaggctagatcatagaatttcttacatttttcactggatctctttggaagctcctttttggaactctccccctaaaatcccagctaactcacaatataaaacctaagctacaaggaggggtcatgtttagggcacctcagtggaaagctccagctgaggtccccgctgacagccagcatcagctgccaacagtggctggactggataaacatcaagtccagtcaagacttgagatgactgtagtcccagccaacatctgactacaattttacaaaagtccccaagcaagaacttctcaggtgagctcatcaatttatgaaatatgggagatgttaacaaataattgttttaaatttggggtggtttataatgcagtggtagttgatcagaatggtctctttttttaaaataatttaattacaagtaattgtttttgaataattttttaaaattacaaacaaaaaaatcaacccattcctaaaatcacccacaaacataatagaaagcactttgaaagatatacctctaaacactctaaaatgtgtacagtctcacataaatgaaatattttaactgaactggacaggttatttccgggaatctttcttcctcaaaattaaaacagaaaaacagtaaagtgaagacacacaaacacacgcgcgcatgcacgcaacccaaagcaaaacccattccactactggaaatattccagacaggggattgcctgagccattatttgtttcaaattagtgatgtatttatagtacctgatatactctggcttacagccaattttacggaaaaaaatccatttataagtgattcaaataaatcatgattccttaatataatgcaaatacattatgtaaccattaaaaatgtaggtgtctagatacactaaaaaatggaaaaacgccaaagagaccaagttaaaaaaaacaaggtgcaactcatctgtgtttatggtatgatcacatttgtttaaaacaatatacataaaatgactgtatatgcatagaaattatcttcatgatacccaagaaaaagtaatagcagttactgctcctggagaacagaatgaggatgtcaaggtcagatccaagagtgacactcacttttcatctccccctttctcaacagtatttcaattttatacacaagcatgtattatcttattaaaagagaaaattttaacaatgacaagaaaaaaaccacagaactcatgactgccatctaagtggcaaagaaagatgcctgctaaatttgagtacatgttaataatacattttatggattacttttctactaaaatctactaaaaagatacttaggccatttctactgtgaacttaaatggcataaaatatttacaaaagccttaatgcaagcacataagctaatttcaaacagatctggttacttaccctccaaccctcacaaatagtgagaattttagatgcagatttcttgctgaaaagtcatacaaaccacttcttcaacctaccctctgccccacaatcagttccctaaagcacaaacatatgatacttacaattgatttgaatgattgagagagaacttaagtcacccttgttaaaactgcacttaaatgttgcgacaagctggaacatttatcttccactcatcttagactccattatcaccaagcgaaaatttgaattggtgacttatagaatgatcagacagaaaaaattcacctccaggattggatggaagcatgaagaaaataatgcctcatttatctaaatggttaaatgaatttgctagaaatgatcagtatatcttttttcaattcataaaatgtcttacttaggccagcccactgttccaacacattatcttctggcaggcactctgtgaagctgtcccacattactttctactgcaatacccagggacaaagtgtcataaaagtaacaagtgtcaagtctccttgtcttttatgtaggtcttttaaaaatgaggcacagcgccttttccttcactttgaagagcacagcaacagtatttccaaaatgaatctgctctccacaggccctcccagccccaaattaaaatgttaaatagtacaacaaaatcatcataatattctttgaacttagaaaaaaaaacccaactatttcaaggcacatttaatttaatatcaagagtgcaatacaaaaggcccaaatacaatgaaggaacacattcccccattaacaccaacgacaatgctctttcaaacatgtgcctgttgaatggaatggggatttcataaaattcactaaaaaaaaatgcagtgagtctcatcacagctaatatccttatacaatctagttgtgaaatgaatgtttataatgcttcaaacagtttcaacctgaagtttgataccacaccttcatgtctgtacagtcctcagtaagtttatctacagtttttgcagccattcaaagaacaaaccattgaataaaaccacattgattaaggctcaagcaagtaatacagagccccaaactaaatggttaaatatatgtgctacttgtacggacatctattatttgattctctcatgactatcaaaagttgtttctcagcaaataaaacctttaaaggcaaaattcacctcatttgagttttgacccagaagtacaacaatcatgaagtccacagtcttattggcaaaactgatacacagtgtctctaagtcactatgctcaaggttaagagcgatgcatattccatttttacattttactggaattttacattttcacttcatgatttaaaatctctaggttttcattccttcaaactgtctgaagacacagtgtgccacagacttaagacttctgtttctccctctattttcttcaaacagaaacatttctcaagtgtctacatgttctagaaggggaatttttcggaggtggccacttcttcggaatagtccgatgccatcaggcgtctgaagcaaggggaaggggaaaagaaaaaagctgaaacacaaggttcatctggtaagttttacattaaacattacaagctggacagtgtaagaatgtggctttttttttttttttttttggctcaaaaagtctgagtcttggtgtggaaacgagtacttggttgtcccaccacagctttctcgtagtgggactgtcagggaagtcttaactggggaggatgatttgtttacctatcaggcgtaaacttccaggcactcagttcattttgggcttgttccagtttgtctttagtctgttccagttcacctttcatttttaggaaaaacaagttgatcgctgggtctaccattgttgatctcagttgggcaacgctcggctgctggacttgcttgaggtactggatttgagtagtacactcttgcatctcttgttccttggttgctagtcgcattacaaggatgttttccctgcgtgcagactcttgctgttgttgctttagtttttcttcagactctcttaggccagttacatcattagagtttaagatctgtatacttgccctccaaagcttgtacgtatgcttcatattgtttccatcttagaattaactcatctgttgccataactttgaagtctgtttcactcagtcgaactttcttgggaagaggttcttctctggtcatcttgaatcgaagagtcgcctttcaggcatggcgggcagtcacttgcccgccgccgggcccgccaggagaggaaaggtgaagggagggagcgaggccgccggcctagcccgatcggagcctcgaggcgcaatagagcagctgctccccggtaacacgccccgtcctttccggggagcctggtgcgagctccgcgggcgccggagctcagcaagcccagaatggtctcttttgctaagagttcacgatctattccaaccattctcctgatgccaaatttggcacttcagacatcacttatccctcactctctgtttttttttttttttttttttctccttggtttttcctaaatttcagaggttttcttgtgaaccagaagcagattgtttcttcacatactcttggcttaaattcaggaataagtcagccatccagctccagatatcccagagctgagctcaatgatctctcataagagccatgaagaacacctgatcatgaattctcttccacagggcattctgctaatgcctccccacctctttcttcttgcagtttcaggcatcttcatttaagtattttattgttattgttaatcaaccaaatgatgttcatctttatcggcaggcagttggtgactgcatttttaggtcaccgtgattctgcaaatgtgtatattttatccagattagataatcgtgactgtaaaacacaggacagttcattgattaattgatcatcacagagtgagatctcttctttttaacataccaaggcaactaaagtctgattatgtcatttgctatcacatattagattggtaatagtttataattcgtatctgtatattacttactgcttaagtaactggtaacaaaaactgtgttctttaaccttattctgaatcatcaagtcagtgagctttagataaggatagctataaatgtagctctttccacatccataagcatggataaagacaggattatgtagaacagagaaaaataaaacccctgacctcacacaacattaagatctttttaggaaaaaaaaaaggaaaaagtagagcagatatcctgtggaaccttcgtgtccttccattcttggaggtaaaaggctgaagccaatctcaaaccacaggaaacattttgacttggagttacagtgactgagtttaagtcaacaattagcgccagtcgtctgttggctcagcaacccatatggaaatcagtcataataaattattttctatggtctttctaatcttacacaaagtaattctttattgccttactaggtttattaaaaaaggattttgatggctctaaatagctatcaattaactttctatttcctgttataaaatgtgaacattacaatagtcttgagtcacccatgaacccaagggaaaaaatcactttcgtcatctgacctcctttacatggggcataaatgtggcctttatatattgctaatcataaccacaataggactaatcatgttctgataccaagttaacttgaggaattagaagagttctttctaagtctttaaaaatctgaatgcaacccagaagttacccagaggaagtcttttttggagggcttggttttggcagaaccgagtctgaggaaggggccttctgtgattggtggcactctggtgttgcttcatatgttgctcttaaaaaatattgaagtttctgttgaattatttttcctaatgatgaaaaacagctgaaattaatgaatgctgtgaatttaaataacatcacaccattagtcataaatatctcaatagtaaacaagcatattaccattaacatttcaaatgatcaacagagctgctcaagctacacttttttactgggcaaatttatcagttcaaggttggctcatattattgtgccttgtcaattcatattatttggctgcaagatacaccaacatattttgttttgaataactgctagtttttctaaagtgatctatttgggaaggaggtggccagagggaggactgaggaaatatagttaacctaattacaatattgtgttatttttccttttagtaatttgtacaggatgtcttcaaatgtctttctgtaaagaaaatgtaggctttttctttatcagtcaaagtaaatgaaaatgctaattgattttaaatgaaattatttaggttaattttaattttttgatgtttgaaggcaaagtatccctatgcacatataaatggtgcaagtctgacatatgtaagactatttggtcagatcacctaagttttatgaagaaggctgtgtggtgggggccctcaaaggaaaggcagggactaatgtttcccccacggcatgctgctctgccttgctgcatgggagtcccagcctgcaattcctttcccccatttgatgccttagggaagagcatcctattttctgtcagcatctgctcaggagtaacctcctttatgagaccttccctaattttaatattttgaggttttctaccactcagcttccagagtctcagtagcatctctagtagtgggctcatctgatattatgtacatatctttcccctatccccttcttctgactaaaaaataaggaaatatttaaaaagtctatggcccccttagggcagagattgtatcttattcctgtttccctctttatatcccatggatttagtactggcagctgtagatacttcacaatgaaaaggctgttcctaaatggaagtcattttgtagaagtgtgatcttctttcaaacatggttactatgctgggaaatactgaaatttcttaccatttaaaccaattacttgtatgattctcttatctgtcacggttaacctttgttcataatgttgaaaggtttaaatgccctatgaaaggtgatatggtttggctgtgtccccacgcaaatctcatcttgaattgtagttctcacaatctccacacatcatggaggggggatccagttggaggtaattgaatcataggggtggttgcctccatgctgttctcatgatagtgagtgagttctcaagagatctgatggttttataaggggcttttccccgtttgcacttctccatgctgtcaccatgtgaagaaggacgtttgtgtccccttccaccatgattataagtttcctgaggcctctaaaatcatgctgaactgtgagtcaattaaacctctttcctttataaattactcagtctcaggtatgtccttattagcagcatgagaacagaataatatgaaagggatgaggcataaaagtataagaatcatccctccctaaagttgagcgagtagaatttttccaaatagataaataatacttcttagttcgttgatcattgatgtacataaactgtgcatgcttatttaaaataagggatgacatagataggttgttttttaacattaatgtgttgtagattggctgaaatacttattgaaaatgcagattctcattcatcagggctaagtggggctcagccatgtgcatgttaaacaaggattccatgtaagtctgacagtggtgccagccaactgtactttgaagacacactactgtggatgagaagcttatgtgcttaggaactagttttcacatatgttattatgtacttctgtatgactttttttttctctcatccgcttagaatacaacatcaccaggacaaagacctgatcttttactttcttctcaactccattgcactgaattcagcactctacccttatggtaccctcagggcaggcatggatggaaaatcctttcagttcttagtttatatgaggctgggagaaagggtgaaatctgaggtgggtaacagaacacagagggcttcacttttctcaggtgtcatataaatatttctggtttttagtatctgcacatactaacagagcagacgaaagacagtacttgtgagtcaacacacatttatgcccatcttcataaaatgccactgcctcagacagcatcagggctgttgatccaatatcaatctactggcacccgtatatcactgccatgcttaaaggctgtcattcctggagtcaagccttacctgactccagggatgagcctgaactctgatcctcactgataggctccttgtgaggggctcctgcctttctttccagcttcaactattttacctgcctcagatacaccactgtccagccatatgtgacttcttggaggttccctaatattgtaatgagctcttttgcagtgtccatgtacataccacctcctacctaaaaggactttacaactttgagttccctgttaatgcctactcagtctttaatgctcaattccattatcacctccaatgggaagcctaaagtgacaaagccaactgttctgatgtgtttaatttctctcttttcaaatgctcatcaggctatcataaaaagctaacactagctaacctcaaatatattagctcatttaattgttttaacaatcctatgaggcatttttccattttacagatgagtgaactgatgcattgagaggtgaggtaacttgcccaagtctacacaccagtagtaactaaaagagttaggattccaattgatgtagcctgtctcttgccccaagctctaaacatttacaccacaactaaatagtcttttacttgtgtgccttctctactaggtgaagtattctttaaatacaggagccatgtcttatgtttcccaggattccaatttcctagaaaactgcctagtccacagtagatattcacttatgcgtgattcgataagtcctttaatgaaatcacatgactttcaccttggccagaattgcaagggcagtggaagccacacacacaaaaaggcctacttgagttatccaaccagagcccattaagaccacctagttacagcctatgagggcttcggagagacttttaatttctacactgaagcaagaaattagtaaaatgcaataaaacgcaacagtaacttacttgcagttggcttccagagcagagatgtcagctaggaatgacttgttcttttggactcataactatttctggatttctttgtggcaagggacattagtttcacctcatgtgatgtgaggcagtgatgggcctaatgatcaaagtgccagtgatgctttgtgctcagaggcctctgactatcattccttcccgtcaatgttcccagatagcacagcccagtgcaatttcagaacaattcggtcttctgagcttttagctttgaccttttagcacatgcctgaacttgaaggtggctgttagttgttccaagcaactgagcaacttcattcctaaccaagcacatactccatgcttttgggtcagatagacctgggtttaaattacagttttaccatttaccatgtttgagtttagacaatatgtaggggttctttaagccttagttttcttgtctctaaaatagaataaacaaaaatattcaccttatagggtcactatgaggattaaatgacacaatttgtatcaagcatttctgtgcaaggtcacatgtcttacaaggctgggtccaggaagcaagttcagttcttttgatcccagagcctgaactcacaggccttagtcccacaacacatgttcaacttgcttagatggataaatgtaggctatcctcattgcttttcatggtaaacttcttttttatcccgctccagtgg

SEQ ID NO: 588 - DNA, 40001 bp, Homo sapiens
aaaaaataagcagtccaatgaacttgagctataaaattcatagtagagccatttcaacaagcttattttgaaatggtagtgtaagatccaactttatatatttataaagatagttattcaatttttataatttgatattctatctaacgaaaccatttccaagtcaacctcaaatgaaatgaggctgaagatatatttaacggatttaaatgacaaaaggttttctcctaaggaaaattaagctgagtgatcttatgaaaatgagttcataattgatgttgtaggccacagcgaaaaattataagattgacatataaatattttagaattaaaaagcatattagctaaaatcagatgtgataattaaaacttgaaaagtagctcaagatagagaagaaatgcagtgtatccaacagaggaaaaaacttagttggaggaatccctaagcagagtatagaggctggtttgcctttacgggcattgggatagcagtttccatttgatgtaaagtgaactcaaatctctgcgcacgtgctctctctctctctctccacacacatacacgcatgcacacgtgcatgcacacacacactttaattctacctcaaaatattaatgaccttggtgaatgtgagtcttgagaagcagccagctggatacagaagagtgaaacacagtgtgaatgaaagacattgaacaatgctttgaacctgtgcccagtaaattgagcaatgagtgactgtatttttatagatcatctaatctctcttctataaattattttgcaatctataataataggctaagtgtgtgctctgttcttcagtgatcaggtgagagaagatataatcccaagacactaaatgggagacacattatgaataattaatatttctaacaatattttgggattatcagcttgttgggatattagtatgaattatcataatttctaactttctgaagagttcagatagtgttagttctgaaattgatagacttataaacattcctaacacccatagcatttttctatcgatattttctatgtttgcatagattttcatgattttaaaatgcttttataatcaggctcttgagagaacaaattagccctgacatttcaaactcgtacagcagaaagttcctgagaaaaccaatgatgagaaatttcttgggaagtcatgaaagagactttcagggaatcatatagtaaaatcacagtggacctcaaagtctcccaaacaaacacgttcttcattccacagtgatctcagagttgtgatttatccaacatttggaggtcatggcctccttgtcttcctatttctactctcactattcccccatccctgattgtatgtctcccccttgattttctagtatatactctgaagaatatagtggaccataggttttgatgaggggtcaagtaaaagaggacccttaaacatacttggtggaagtataaattgatactattcggttggtgcaaaagtaatcacaattttttgccattaaaagtaaccactattacttttgcacaaacctaatatatttctgaaagacaatgtgtcagtacctattgaaaatcttatttatttatttatttgaaacagggtctcactctatcacccaggctggagtgtagtggtgcaatcatggctcactacagcctctacctcctggagtcaagtattccaagtagctgggaccacaggtgcgtaccaccacatttggctattttttaacattttttttgtaaagatggagtctcttcatgttgcccaggctggtcctgaattcctgggctcaagcgatcctcctgtctcggcctccctatgtgctgggattacagacatgagccaccatgcccagccaagaggtttttatatattcacccaggaattgctattctgagaatttatcccaaggaaatagaaatatggacagagtatagctacaatggtgttcatcacaaaattgcttctaaagctaaatattggaaagcagcctaaatttctaatacaggacaaattagaaaataaagaagaaaccatggtacattcatacagttcatactatgtagtcattaaaattttgttgtggtataatatttaataaaatgcaaagatacttaagatattatagtaaaaaattcagcttaaaaataatatgattcagtggctccttaaaaaaactgtatatatgaaagacacgaatatagacaggaatattcttagaaggaaatatggcaaaataagtatagagttctccaaagtgatgtgtcatatcattttaaagttttctccatgttaattatcagaatttttcaaattctttatgaataataactgtaaatctggcatataaaagtgggtattgaaaaggaatataatagaaaaccaatttagaaatgataactttgacagtaccaaccaacatttcaactaacaagttctttgaggtctatctattgtaggtggagagacaatgtttttccatagaaatactaatacagttattcatcagttcactgaagcaggctgacaataaaatcttataaatattatcaaggtagcaaagccatgaccaaacaagtatgctcactcttgattgctgatgacaatggtggagatattgaagagtttggtgagggtctggtatagataaaatatgaagtggtatttttttagcaaatgatacatatggcctcaatagcagctacctatactctaaataaggaatatttgagcagcacatttatcagcaattacatacattttagttaaatgaaagatagctcttgaatattattttattcataataaactgcaaaataaaacagcacacactaagactaaattcatattttattcttaagaaaaaaatggaattttctttttaccacgtttctcaattgtgattcacatgtattcaaactaatttaaaaatgactttttattatatttctatattcaacccattattgaaaacagttaagacaattcaagttaaattagtaatgagatgtcatatttaagatttatcctccagaatacccataaaaataagattgttatatgatccaaccactaaaatgttgataaataaaatataaatataaacataagagtaaggtattattagaagccaaaaattgatttaaaagatttcttatcattaacatctaagacaatatttctaaacattaagaaatttttatggttctaaaaataagattgaccccctttcatttgcattctaacttttgtaatatgtgtgacatattgctgcaaacaagtctgtctgctcagaataatcaggaatgaataattcatcacagatgctgcagatgtcgaggacatcctctattgtgcccaccctttaacaaaaataaactccaaagctgtttgacttgcttccagttccttccaaacagagcccagcgagaaactgccattgattttttttagagtgagttgtggagacggatcaatgctaggaagaataaaaactgatttcaccttgaagaattcagaaagtgttagttctgaaattaatagacttataaacattcctaacacccataggcatttttcttactaatatgctactcattgtataaagccaactctgtaatagtaatgggaatacttctttttccagccaaggcttaagagtaaaattcctgcttactctttctgaaattcttacagttatctatcccagctgctttgcttgattctgtttctgctattgatttacttttgggctcaatattaacatgggtaatagggttttggcttttcttttatcccaggcactctagcataaaacactagcataagacatttatgggataggtgttagttcacccttatctaaaagtctggagacttttagatttaaagaaatcacaagcccagcttcacgaggctattaaatggtaggtctgtatttgcttaaatttaagtcttacttactatttatttataggaagtaggatttattggtgggcagaaagaggagagggcacagtggaaagtctcatgaatgtagcatctgccactggtccaggaggccacagttgaggatgtattagggcggtgcaaaagaaattacttttaatggcaaaacccacaatgacatttgaccctacagccatctgggatgagctgcttctcagccaccatgccttcaaattcatctgacttgaacttggtaaagccccacttctttgagatgtgaatcatttgctggtgaggcgacttgaacttggccctgtataaggcctcagtcacatgctccttgttctgcagtttggagtgaatggacatgtgaattggctcatgcgaaccctggccacagtgccctgaggctttccaaaggcatctttcatacccatctggagcctgtcagctctagcgcaggacaacatcttactgttctgcatgacttggaaggagtagaaccacacttggatatgaaagccaattttgctgcaagtttttatcatgtatctgttggcccaaatgtgggcatcctccaggacttcagagaagaactgctcatattcatctgacaccatgtggcctcagagtggatactcatccatttttgctttcttctgtcccaggtcaaaaatgcaaatcttggcatcagggacacctctgcagaagccagactttgggtatgttttgtttttacaatatcagtaatacctagtggagtgttccatggagataccagaattttaagtggcatgccaaatgaaaagtgaggaagtcttatttaatatacactttttaattttatttgtggcatcaatatattttatacacttgaatttacatagtgtataaaataagcctttttgggtatcatctctttctaccaatctgccaaatagcagaggtataggttgattcagttaagaacagaataaccttggttaataggtggttggtggtatcatagatttgtatatttctcatgatgccagtatttctctattttttattaactacaataattagaaaatacagatttttgagaaaatcctaattactctatggataaagcttgaaatagaatcctctaaataatgtaaacataaacaaattattttaagtccattatttaagcaagaatatctccttttaaaaatcattagttttcattattatttttagagagaggattttgttctgttgccgaggctggagtcggtgatgctatcatagctcactgtaacctcaaactcctggatttaagaaatcctcctgtcccagcctcctgagtaactaggactgcaacaggtggactgatgcattccttttgcctggcttcccaaagtgctaggattgcagacatgagccaccttacccagcccgctttttaaaaattgattttatctttagagtagttttaggtttacagcaaaattgagcagaagtcacagaaatttcctgtataacccctgccttgacacataagcagtcttttccattacagcatcaacatcccctatcagagtggcacatttattacaactgatgaacctacactgacacatctttgttaccaaaccataatttatattaattagggttaactcagtgttgtacattctatgggtttgggaaaatgtataaggacaggaattcaccattataatattatacagagtaatttcactgccctaaaaatgttctgtgttccacctattcattccttccacccgtctagccactggcaaccactaatctttttactatctttatagtcttgccttttccaaaatgtcacatagttggaatcatagagtatgtagcctttacctattggcttcttttacttagcaatatgcattcatttctttcatgtcttttcatggcttgataactcattttctttcagtgttgaatcacattccattgtctttatgggccacactttacttatcctttaatctactgaaagatgtcttggttgcttccatgttttagcaactacgaaaaaagctgttagaaatgttcatgtgtaggtttttgtgtggacatatgttttcaactcttttgagtaaatatttctaagtattgagaaattattgtataatttcttaataataattagcaaggagcatgattgcagggtcatatggtaagagtatatttagttttgtaagaagctgccaaactgtcttccaaagtggctgtagcatttgcattcccaccagcagtaaatgagcgttcttactgctccacatcctcaccagcatttggtggtgtcagttttctggattttggtctttctaatagatatctcattggttatttaatttgcagttttctgatgacatatgatgtagagcatcttctaatgtgcttatttgtcatctgtatattttctttggtgaggtgggtgtctgttcagatcttgtgcccttttctgtttgtttttttctgtctgtctgtctctctctctctctctctctctatatatatattatattatatatatataatatatattatatatatattatattatatatatataatatatataatatatatattatattatatatatataatatatatataatataatatatatattatattatatatatataatatatatatataatatatataatatatatatattatattatatatatataatatatattatatatatattatattatatatatataatatatataatatatatattatattatatataaatatatattatatatattatatatatataatataatatatatatatatttaagttctgggacacatgtgcagaacgtgcaggtttggtatgtaggtatatgtgtaccatggtggtttgctgcacctattgacccattatctaagttcctcccgtttccctccagcccccaacaggccccagtatgtgtcgttcccttccctgtgtccatgtgttctcattgtccaactcccacttataagtcagaatatgcagtgtttggttttctgttcctgtgttagtttcctgaggatgatggcttccagctccttccatgtccctgcaaagaacatgatctcattcctttttatggctgcatagtattccatggggtacatgtgccacattttctttatccagtctatcattgataggcattggggttggttccatgtctttgctattgtaaatagtgctgcaataaacatacatgtgcatgtgactttatagtagaatgatttatattcctttgggtatatgcccagtaatgagattgctgggtcaaatggtatttctggttctagatcctcgaggaatcaccacactgtcttccacaatggttgaactgatttacattcccaccagcagtgtaaaagcattcctatttctccacagccttgccagcatctattgtttcctgactttttaataagtgctattctgactggcatgaggtggtgtctcattgtggttttgatttgcatttctctgatgatcagtggtgttgagcttttttttcatgtgtttgttggctacataaatgtcttcttttgcgaagtgtctgttcatatactttgcctgcttttcaatgggtttgtttatttttttcttgtaaatttaagttcctcgtagattctggatattaaacctctgtcagatgggtagattgcaaaaattttctcccattctgtaggttgcctgttcactctgatgacagtttctttggctgtacagaagctctttagtttaatgagatcccatcaatctggcttttgttgcagttgcttttggcattttcatcatgaagtctctgcccattcctacatcctgaatggtattgcctaggttttcttctagaccagtggaacagaaaagagacctcagaaatatcctcacacttctacaacgatctgatcttgaacaaatctcacaaaaacaatcaatggagaaaggattttatattcaataaatggtgctgggaaaactggctagctatatgcagaaaactgaaactggacccctttcttatgccttatacaaaaattaactcaagatgaattaaagacttaaatgtaaaacccaatcataaaacttttgcccatttcttaagcaggttctttgttttcttattgttgagtttaagtgttcttggatattttggataacagtcctttatcagatatagcttctgaaaatattttctcccagtctgtagcttgttttttcattctcttgacagtgtatatttcatagaacataaatttttaattttactaaaatttaactttttcatggatcatgcctttggtgttgtgtctaaaaagtcatctccatacccaaagttatctacattttctcctatattatcatctaggggttttataggtttacatttgttgaaaaaaaaaactatctttgctatgttgttggcaaagatcagttgattgtgtttatatgggtctatttctgtgttttctactttgctccattggtctatttgtctattctttagccaatatcacactgtctttattactagaacttcataataagttttgaagttgggtagtgtcaattcactaggtttgttcttctccttcaatagtgtgctagctaatctgggtcttttgcctctccacataaattttagaaccagtttgtcaatatccccaaaataactgctgggattttgatcgagattgcattgaatctataaatcaagttgggaagaactgacattttgacaatactgagtcttcatacccatgaacatggactatctctccattcatttagttcagttttctgcatgtagatcttgtatgtattttgttagatttatacctaagtattttacttttgtgcatactaatgtaaatagtattgtattttgaatttaaaatcccacttgttcattgccggtatacataaaagtgattgacttttgtatattaactttgtatcctacaacctattttaactgtttgttatttccaggagtttttctggtcaattcttttagattttctacatagacaataatgtcatgtgtgaacaaagacagttttatttttttccccaatctgtataccttttattttctttccttttctatttcattaactatcacttttagtacagtgttgaaaggagtaatgagaggaaacatccttgcctttttcctgatcttgtgggaaggattctagtttcttaccattaagtatgacgttagctgtatattttttgtagatactctgcatcaatttaaggaagttcccctctgttcctagtttaatgagagtttttttttcttttttattataaaagtcatgaatgggtgttgaaaatattattttaacaattctcttttctcaagacttcagtagaaatgtccagaccttagcaactaaagtgtagtccacaaaccagcaccatcagcatcacctggaagcccatgaaaaaatgcagaatctcaagcttcacctcagacctacttaatcagacctgcattttaataaaatgctgcaggtgattaatatgcatattacagtatgaggggcactggccttggtcattttcttaatcttactgtctagatcgttagtcacctttctttatcctctgctttttcagtggaaggatcattgacatggagccatactgacattgaattaggaacccagcacttgccaattacataagctttaacaattaactcattttttccaagccacgatgcctcccttgtagaatgagaacaatacctatgtttcacaattattgtgtgaattaaatggtgttatgtatgtaaaaattcaatatagttagtatttgacaaatgttactttcctttctatctgtccatcatgtctcttatgctagagagacattgttttataaaggttttgactctttcatgacaatcttttattcttccttgtccttctctcctaattttagtttactagtctttccttgtatggtgttttgtgtatactttttcttttgttatgcagggttttgcatcgtctttccctacctattccagcctccaaaagtagacagctctgaacacactccgatcttttctgcttcagaattttctccaaatcttggcaagactgcttaacacaacctgcagcatagcctgggactacagcgaagttaatatctgaaggggtaatgctcatggggtatgggagtcaatgggctaagtattcttgtcttctgtactttagagggaaaatatacatgcattctacacattttgtcagagtcataaatgagattgcctcattatgtaccacagtaaccagctccgtagcttcccttctttcctttcttttctgactctactcaatcaccttggttgctggaatcactttccattaaactatctacatcgaagtccttgcttcgtgctctgcagttaggaagatctaaactaaaataaatcatggtttttttgctctcagcatatacaaaaaggggaatacttgtccatcaaagtatttgtgttggctctaccataatacaaaagtgtgatttggaaaggctgctcagccagggattaaatttcatagcactttcctcaacttgcatgtaggtggagccaagaggattaaacccaagagggttaaaaaagaaactctgcagccgggttcagtggctcatgcctgtaatcctagcactttggaggccaaggcgggtggattgtctgagctcaggagtttgagaccagcctggggaacacagtgaaacccagtctctactaaaatacaaaataaattagctgggcgtggtggcatgcacctgcagtcccagctactcgggaggctgaggcaggataattgcttgaacccaggaggtggagtttgcagtgagccaagatggcgccactgcactttatcgtgggcaacagagcaagactctgtctccacagacacaacaacaacaacaacaacaacaacaacaacacgaaagaaagaaagaaggtttgctttctctacacttttgttttaaccatttcttctgaatttttacaaataagcataaactcatgcctgtaaccccagcactttaagaggccaaggcaggaagatcacttgaggccaagaattcaagaccagcctggttagcatggtgagactccatcttaaaaacaaaacaaaacaaaacaaaataagcatagagaacttgtaaactgtgtggtaaacatggcagagtcacaaaaggcaaggaaagaacaccattgggagaggagctagctgcctgttaggtacagctgttttgaatattccattattaagaaataaacatttattatgtttaaagcagtatacatctgggaatttgggtctgtttattacaacagctgtcattattctgatttggtcattaacatatttttatgctccaaaccatttataactgctttagtggatgcttatcactaagggtatctatccactcacttttcatagtactccacacagtgctctttgctggatctgttatttgcttaagagtgaaaattgtgtggaatagtttcaaatttctgtttttaccaaagctaaacaaagtcttcttcacttcaactaaaaagaataggctttgtgacagagttaccaggagctccacttgacatcagacaaaatgagccttgatccctccattcattcatgcatgcttcattctataaatagaaattgagaatctcttgtatgccaagtattctactatgctctgaactcaaaaaataaataagacatggttgggtgtggtggctcatgcttataatcccagtgttttgggagactaagatgggagaatcacttgagtccaggagttcaagaccagcctgaacaacatagtgagacctgtctctacaatcaaccagtcaatcaatcaatcaatgttgctggaaataatagtgtccatctgtagtcccagatacttgggaggctgagtgagaagatggcttgaacccagaaaatcgaagctgcagtgagctgtgatcattccactgcactgtatcctaggtgacagagcaagcctcggtctaaaaaaaaaattaaattaaaattaattaaagaataagacatggtccttccctcagagagcctaaaacctagtatttaaagagaacaattataataaagagttctggggagccagcactatgagttgtctagtcaaaatgactgagtgttatttttggctccctgatgtattcacagagtgattttagtaaagttatgtcttttctgtgcctttttgtttaatacgtaaaagggagataatgtcccttttaacattttgtgaggactgactgagattttgtagagttcttagaatagttcttagtaacttgctacatatcaataaatgttagcttattattaaatattgggaccaatatacatgcaggaccagatcttatagggtagtgcacatcaaacattagggtttatatgagttacctggaaatcttatcaaagttcaaatttttacttagtatctctgtagtaggacccaagattctacatttctagcaaggcccaggtgatgctgaagcttctggtcttgagagcacattttgtgtagcaaagacagtgctgcccaataaaactttgtgtgacggtaaaatgtttatatctgctattctaatatggcatcttctaaccacatgtggtaactgaaatgtggctagtgcaacagaggtactaatttttttaaaaatgtatttaatgttaataaacataaatttaattggacacatgaggctagtagctacttgtattcaacctcatggttctagaccagtagcttttaagactggtcacacgttcaagcaaggatcagtaacccagaataatactgaatattgggttacatcatcaacataatgaaaatatctctagaagtttgaaattggattgaagactacgaggataactattgttctttagaggttccatttacactagttttgctttaatagtggacaaggttaaaaccagctatattcaatgtcaaactatatcagttcagctcaaggtaattgaaaacccaaactgatgtggcttgaacaccactcatctcaaataacaagcattttagaggctgacaagtgatgatgcttggtccagcagctcagcggccaggtactatgttttcttctccaacattcctagcctgttagctattgtcttcaaccttctaagattcaaggcccaagaacactgaatatgcttgtggtgtacgtattcaagagaaggttgagagggccaatcaacccgcatgtgtactcttttatcgtactacaaatatcttattatctcagaaagttgaaaaaaaaaatatttagctgggtacatcgccatcccaaacaaaacgaaaattttggtggcaagttagaagataaaatagataatggttaggtagccaagaatgtctgacacacaaacctaattatcattcacatgtgaagaaaaagaaatacatttttccaaataagcaaaacctcagtaagatacatcaatcattcatattcaatatgaatttaaaatataaactcatgaataataaaattatggcacaaaaggattggcagtgagcactgactccatttgaatgatagatataaataaatgaaattattatgttattacattgaatacaaatgctaaattttgttgtgaaaagcctcgtgatatcaaatgataatcactattaatataatgggtataaaattacaaccagttaatatcagaatattggtagagtggtggtaggcaggagaaatgtagcttgctattatgttatggtgagaaatgtagtttatgtatttaagtaattattttaaaggaataaaagtaaatacaagtagaatttaaacagattatgtaccttcgagattattgcagggacagaggggtctaatttcagagatcaagaaaatgaatccaatttttaaaaaataaattaagcaagacaaaaagaaattaaggaagcatttagcagaatgtttgaaatagaatgataatatgccaagtatatctgttacagcaataaatataaaaggaaaatgaccactggaaaaaaactcagttgagtttaaaaatggaaactctattgtatgttatatgtaataatcatatcacacacagaaaattatttaaatatgtagacaataaaaaataagcagagaaatgcctagcaaacctatacacaaaataagaaataataccggtaaaataatttataatatataataatatataatatatactataataaaatattaactaggagaaagctattttataattctgagatgactttgcaaacattacaataatactgaagatttatgtgtcctttagcatcacactgaaatatagatgaaaaactactagaaatacaaggaactgtccttgcatcccaggaataaaccccacttgatcatggtggatgatcctcttaatgcattgaatttagtttgctagtattttgttgagaatttttgcatctatattgaataaggatatgggcctgtaattttcttttcttgtaatgtccttgcctgactttggtatgagggcaatgctggtctcataaaaaaaaaaaagtttgaaaatattctctcctctttgatcttttatgaaagtgattgaggaagattgatattagttattctttatatgtttggtagaagtcagcaatgaagccatcacatcctaggcttttctttaatgtgagacatttattaatattactaattcagtctccttacttgtcattggtctgttcagattttcctatgtcttcataattctgggtagggcatatttatctaggaatttatccttttcttctgggttatccaatttgttggcatataattgtacatagcagtctcttatggtcctttgtatttcttggtacaagctttctttttcattttttattttatttatttgtcttccctcttggcaacatttttaaaggaccacagttcacattttctgctctccactatcgcatcaaatgctgagcccagacaaattctgttgagactatttccaaccttttaagcatttcaactatcgtgtatgtttctaatgctatttacacttttacaatttcaagtaaaataaggaatattttcttttgtttgttgagtactaaataacactaagaaaacatctaatgaagggatggaacaatcgtagcagggcactatttatctaaatacatagttgatttgtatgcaaacagttattgctgtggtcaaatatgcctgggaaatactggcatgaacagatttccttactgtagaaccacttagagatctgaaatattttaacaggtgtggggaatcctcaacagagggcttttattgcttgtcctcatcacaaaacttaaaaaataattttttaaaaaagcaagatcttttttcccccttagattctctgtggcctggcttttcactgaataagtgttgaaaaattatataccaggaataaaaagcctggaatacctggtgaattcgtgtctcagctaatttggtgtaactttaagaggacacaagcagataaacaaataaaaagaaataatgtctttaggcaagaaaaatactcttcagttctttacagccttgactgctcttgtttacataatactcagccttttcacaaatttgttacctaatttgctctgaaatatgtgaatttataattctgactaaaaacaaacatcatggttgattaaaatgaaatatgatgcatgctattatcaaatgaactacatgaaagaacagctcattatgacctaatgggtttcattccaagaatgtatactgtagttcaaaattggaaattgtactgataaaatgcatttgcactgtctttataagggaagaaaattatttcaatagccctcaaaaaacttttgataaagtttaacacctaaaaaaaaaactaaataaacccatgattaaaatacaaataaaaagatgcatgccatgggttgggggggccagggccaagacagctgactagaagcagcaccgtttcgaggcttccaccgaaaaaaaccataataagcatgtgaagccttcaccggcagccagggtatccagattctctcatcaaaattgactagaaggctggtgtgacccacagagagaaggaagaacaatgtggtgtggcaacccacctgagagcgacacagggaaggggaacccctcccgacagccaagggaggcagtgactgagcacactacccagccagggaaaccgtgctttttccacagaactgtgcaaccgatggatcagaagatcccactcacaaacccacaccaacagggcctggaatcccaatcccagaatgtccacattcttactgactctcagctggaatctgcttaagcctaccaaactccccagggggaggggtgaccagcacctgctgcccctgtctgctgtctaagccttttgagctccttgtgggagggacagcagccagcactgggactagcaactgcctgacacactaagcttcctgggcaggggaaggttggcacccatttctgtaactctaggctgcactttcccaatgctggagccagggaggctggactgcttggtcccaagacttttccccacagctcaacgcactggctgtggcagtctgcagccagagtgcctcttcaggtctaaccctgacccatccttcctcagtgggtggggcttccctgaaggatctccaataactccaaccagaggctcagagagagaattcagatctccttgggcctgagcccattggggaggggtggccacagtctctgcagaccagcagacttagcctctcctcctggtatttctgagaaatccaggcagcccagaggagtggttttgccccaagcaaaacacactctcttcaccaagggacaaagtggttcgttaaatgggtcctgctcttcatgccacccaactgagtgagacccccaacagggatagtcagacactctctacaggagcaatcctactggcattaggttggtgccccttgaggtcagaggtctcagaagaagtagcaggtacccatctttgctgttctctagcctcctttagtgacatctccaggcacgggagcaaatcagatgaataagacctgaagtgaacccccagcaaactgcagcaggcctacagaagagggacctaatgaaagaaaaacagacaagcagaaagcatcagcaacagcaaaaacatcaacaacaacaaaagcccccacaaaaaccccatccaagggtcagcagcttcaaagaccgaaactagacaaactcatgaagacaagaaagaatcaatgaaaaaatgctgaaaacccaaaaggccagagtgcctgttctcctccatatgatcaccatgtctcatcattgagggcacagaatggaacggagaattagacgagttgacagaagcaggcttcaggagatgggtaataaaaaactatgatgagctaaaggagcatgtactaactcaatgcaaagaagctaagaacattgataaaaggttagatgaattgctaactagaataaccagtttagagaggaatataaacgatctgacggagctgaaaaacacagcatgagaaccttgtgaagccaaatcgacaaagtggaagaaaggatatcagagtttgaaaaccaccttactgaaataagacatgcagacaagaacagagaaaaaaagaatgaaaaggaatgaacaaagcctccaagaaatatgggacttaataaaaagactgaacctatgattgattggagtgccagaaggagacagggagaatgaacaagctggaaaacacagttcaggatattatccaggagaactttcccaacctagcaaggcaggccaacatgcaaattcaggaaatacagagaacaccattaagatactccacgaagagatcaaccccaagacacataatcgtcagattctccaaggtagaaatgaaggaaaacctgttaagggcagccagagagaaaagccaggtcacctacaaagggaagcccatcaggctaacagcagacctctcaccagaagctctacaagctggaagagattggggaccaatattcaacattcttaaatcaaataattttcaacccagaatctgaagtttgaagacactttgaaagacacttttaagaaagtgaaaggcaagccacaaactgggtgaaaatattgccaaatatatatatatccagcaaaagacttgcatttaaaatatataaataattcttacaatccagtaagaaaaacatattaactttgaaaatggacagaagatttgatgggccttttgtaaagtataattttaaaatgactaagaaaacaagaaaatgagctcagtacacagtagtttttaaaatgcaagttaaaagcggaattagatactgctattcatctaccagaacgagtaaaagaactaacgatatcagatattggcaggaatttgaaggaactggtattcttttctattgctggtggatttataaaatgatacaccaactttgccacacagtttggcagtgctttagaaagtcaaacatataggtactatatgatcttgcaattccactcatggccatttatctaaaagaaatgttcacaaaaagactcatgcctggacgttcatagcagctttatttataatagtcaaattctggggaaaacctaaatgtctatcaacaagaatatgcaaactgttatatattcgtatggaattcctcagcaatatataaaggaacaaaccactgatacatgcaaaaacatgggtgagtctcaaaaatatcatgttgagaaaaaagtcagatgcaaaagagtacattctgtataattccatttataaaaagttctggtttgcataaaactaatatatagtggtaaaaatcagataatcagttctttggggatggtgattagagtggattaattggaaagagctatgagagaacattttagggtgatgaaagtattcgagatgagaattgggttagtgattacacaggtgtgtatacatttgccttggaatttcagttgggagttagatggcagaaaggtgggcctgacactgctgggaagatcgtgactagaaatagtgggtttgtgcaaatataggttccattgatttacaggtaatagtagaaagtgaaggaataaatattgctgaagcaaaacataaagaatgagaacagggccaaagacagaaggcccaggagcacctccatgtgagaagaaggggaaaaaaaatagagccagcaaacaagaaagaaccaaaggtcaaggaattctacttcccaaagcgagtaatctttcttatcccctaggatgaatcattgtttgaagaatttaaattagaatgcctttactaagtaacttagtaatcagaaccatatttggcatggaaaaagagcacaggccagaactctgttctgcttttgtgattctgtatgagctatatccaacatttttatcatagttaacaatcatcagtaatttgtttctgctattagtaattacagcagaaaaatcagtgatggagatgtcacagctggtgggacaaggggattcttttcctgatgattttcttcatctgtcatggaaagaaggatacagagtgattcagaaataaatggtgctttaaacatgataaagctctttttaagtgtagtaaaaagtcatctcacacaggtgtctccatgaagttctaatgagttccatgagaacaaagagagtgtgcttcattcatctttgccatcctcttaataactagtattgaaaacctactatgggccagtgttctgataggtattcagctaaaaagatgaataaaatggtaccaagtcttccattgctccaagtgtgaaaatccaaaaacccatccaaatatgccaggacaattttttacgatgggaatagtgccaaaaatgtataaaatattgagaaaatatttcattgtatattcttctacacgacaatttagccagaaagaagacccaaaatgataaaaaccattctcttccttcctcttatagcaaagagatatataaaagtattagatttggtgagattttcttcttgtttgtataggttggagaggatttctagaattgtggatgtcacataagatttcataaagcaattctcagttattctatgcttcaaaatagagcatgcagtcatcacaaacttaagtaaataccaaattgttgtttcaggaaagatttattactctagttcactgtagctgttattgtgacttgtgatgcatagcagagaagtctgcagcccagtccccagcagaccataattgttgcctgtgcacccatatgggacattaacattaagaaatagctctgtccttcataacacctgctatcatctaatgatgaacatgccacagcaaaattttcctttaccaatacaactttatgaattttcattgttttgaattttaataaaagatgcttttttcactgattttgagcaaaatttgttcaatactttggaatctcttgaattgatcttacaaatgaattgcagcaaacaacatgcatgctaattgataatgttgagaaaatgacaatcaaaatgattaagtgaataaaatgaaattgtttcatgtttttgtgattaacatttgacatatgtcagttgagatatctgatatatgtcaacaaaacaatcattagactcctctcagcaaagtaatgccacaaagtacatcatgctattataattctgccaatgtattcagtgtgatttctaaatatagaacactctatagggcacttgctgttcaaatcactatgtagcttcctttggttctgtatccagaggtcaacacatggtggaacgaagaaacccagtttctaattccaagcttccatttactccctgggaaagtctatttagaacacacaagtagacttttcccaaactatggccctagcacatgccccaccgatttcatatttatccttgggaaagccacattatccgtctttgtgatattgcctgtgttagtaactggagttcataactattgtcagtgtatgtgtattagtaaagtaatttgtttgttgctgtgcgcaggcaagttcagctctttgggatgaatatgctgcaaagctgtgttctatggacaagtatttctattaatatacatttttccagtaatccaatatgaaaaaattaacactatttatttgtattcatgttcccaaacagacttgatttttgtaagtgatatggggtttaatcacaatgtaggagaaaaaccatcaagtctaatgtcagaagtctgaattcagcctcaattccaccaattagttctgtgaactttcatgaactgttaagcagtttgggcctcattttctttatatatagtaactaagtaatactgttaaccttcttatttctttattacatattggattttttaaatgtaatatggtatacaaaattttaggaattattattgccattgttgctttcgttggtaatagcagtagaaactattgatggcagaacactggtattgaatgttttgttttgtccaaataagactatgctgttaaaaaatctcagcctagttctgtatagaatataacactgaggtaaattagattttaatatcactgtttcacaatctttttgggtcttacctatagaattaacagtccagcctgcttgaaatgaagcttttcagcctgagagaaatgattattactcaaactaaggattttttttttatcaggagtgagtgttctacattagttgctggatcttttctcacctaggctgagagattactggcagtggtgtgaaacaggtggaggaagtgaaatgagggagtaaagtgggtgctcttggctgtgctttgaatcaaatgttccttaaagtcttttaaaaagcagagaggagctggtttgcagcttgagttctctgcagaacaaactctgagttggagtttaactaaaagttgtttatcaaagtatcctttggatcagtctctgtagaacagagagaggaaagcagcattgaacagagcaagacattgagttgtgatgcaggcctaatgaacttaggttaaaaaaaaacttatgataaacttattataaaagaacacagatgagtttgggagccaatcctatcaaggttttaatactgactgcttttgcagtctcccctcttgtggtggattgggtactggttaatgatgtgaattctgcactaaagccacctttctttgtccaccttctagctgtgtgatttagtgaaggctagcttgcttctctggacttcaattttctcatctgtagaataaaagtaaccacctgcacacatagagtgtgcctcagagaccccacagagaagctctggatttagaatgacccttcagagtgacaaggatgtgggcagagatggcccagcctctgcatgcaaggagtgatctgtcatttagaagtggactgccctgggaaagggtctgacttttattaaagcagttggcagtatccaacgcaatcgctggaggggctggcagctgaaggctctctaccaatgcacaaccatagcaggggcaacaggtgtcttcctgagaggtagtctaggcacagtgcatggcccacaacaagcccctccgagctgaaaactttcatagctggagggaaggcaaaggagaagtaaaggagtggggaaaaaagaaaatgaatgcttatttaatatttgttatgttccacacactggactaggcactctcttggttatcccatttaattcttaaaactctctctgtgtgcaggtggttacttttattctacagatgagaaaattgaagtacagaaagcaagttagtcttcactaaatcacacagctagaaggtggccaaagaaaggtgactttagggcagaattcacatcattaaccagtacccaatcctgccacaagaggggagactgcaaaagcagtcagtattcaagtctgaacaggattggctcccaaactcatctgtgttcttttatcttaatataacctaatgccctatctgatctatttgacatgaagattatcattgaatattgaacaaatgtttaatggccatccagctcaacatgcattctagagtagctttagtgttttgttttgttttcttatagtagttgttgtttttctctgtctgtttacagtgcagagaatttctaaaaatgtgaaaacacttatcagagaaatgttgtattgtgttacaaatcaggataaataccttggttttttgagtaattcaagcaaaatctaatggaaaaatgatggagaagagagttcattcaaatactcccagtccaaaagccaattaacattgttatcctgatattattcactgtttaatacagcagaacagttttatatttctgagtgaagttatgttttgtgaaatgaaaaagattcttatcagttaaatcaaatgagttccaaattgcaagctgctgatattatggctttcataatatgtcttcaataacacaaggaaataggagaggcaaatatttccatgtgaaaattgcagtaatgttcagcaacttgtaataattaactctctcaaaatctggtgctgtgccagataaattatttcaaaaccacactttcttttttcatttattttatttaaacttatcatttatcacgttaataaagcattttcactgaggctgttctttaaaacactaaaacaaagattattaacccaaattgtccaaatgatagattttaaaacatgtcctgaaagcagacaaaaataaataaaaataaaagcacctcttcaagattttaataaggaaaaaaaaggaatgttctcaatatttctacagcaattctacaaacttagaaataggacaaaaccagcacattatctaggtaataaaatgtagcatctttacattcattgcatgaaatagtgacatgcattgatgtacaaaacacatgtgtttcaaggtaagtcaactctgattaatgaaaatgtaactgaacttgaaattcaaagttaagggctctataccaagctatgccacttactagttatatgacctgactggataaggcatctctctaaactctaggttttttatttttaaaatgagaatataaaataactaattcttgtggtgttggtagtataaatttaggcaatatatgtaaaatacactttataaacattcaacattaaatcctaatgcctgtgtgatattatgattcatttccatctgtggttcctagttcgtaactttcataatcattgtcacaatcttggttataatgttggagaaatttagggctcagaagcaagcctgaggaaacaaaagctttctctctgaacttctgtcttccttttacccacccgagataggactatagtccaattataggtcataaaaccctcattctagagagggtcctgccccctactccagaggaaggaatgctgtacagagagatcaagaagaatctgaatggacaaggcttgctgagtttaggccacatcctttttgtccaatcacattttgacatagttgtccatgctttaatcattgacaaccaatgaattctccataaaaggcccaaaggatggagttccaggagcttctggagagctgaacacattgagcatgacaggaaggtgaaaaactctttcacatgccaggaagttggtgcaccccaactctacagggacagaagctgctgcacttacaaatcctcccagacctcaccccatgtatctcttcatctggctgtttatttgtatcttggaaaatatgcttgatagtaagccagtaaatatgattccctgagttctgtgagctgctctaacaaataaatcaatctcaaagatgggatcgtgggagcgccaacttgaagccaattggtcagaagttccagaggcctggaattgcgacttcagggaaggagaggatgatcttatggtgttgagtattaacctgtgggatctgacactgtctctgggtatatagtattggtactgaataggaggacacccagctgttgtccactgcttgttgtatggttaaaaacccctcacttttggtcagagaagtcttcttctgtgttgattattattgtggtggtgtgagagcagaagaaaaacccatttaagagagtacttcccaaagcactgtgtatacagtaaactgtggtccaatgggaaaatacaaattaatatagccaataacagtgtatgagaagctctttctcccaaaactcttgccaacacagtacatagccaaaaatcatctttttatttgatagaagtatgacatattttgttttaattcatatttcaataattttgagtgaaattggacaactttatacacctttaaaatatctttctgttatgaactgcctgctcttcacctttgctggatcgatgtattttacatattaatttataagagctctttaaaaaataaggacattaatatatttaatatgtccgacaaatattttagacatttttttctcttctcatttgacattattattgtcatgtagttattttatgttttatggagtcaagctttctttatgacatcaagctttcaactatcacttagaaacaatttctcttattctgtttttacaaaatatgttctacatttctgtctagtacttttattgttcccctttttaaacttatattattgacaatatcaaggattggcaaagattttaaaaaactggtctgctcatatatttctggtggatttataaaatggtacatcaacttagtaacacagtctgacagtgccttataaagtgaaacacatactttctaagtgatctaaaattccactcctggtcatttacccaagataaatgaaagcctatgttcacaaaaagacttatgcatggatgttcatagcagttttactcataatagccaaatcctggaaacaacccaaatatctatcaactagagaatgggcttttttgtgctacccagagaggggtccatatggcgatgttctagattcctgttgtaacttaaagggaaacttttacagtgtacagagcccttgatgtcctgcaaatggaggaggaggatgtccttaagttccttgcagcaggaatccacttaggtggcaccaaccttgacttccaaatgaaacaatacatttataaaaagaaatgtgacggcgtctatatcataaatctgaagaggacctgggagaagcttctgttggcagcttgtgccattgttgccattgaaaaccctgctgatgtccgcgtcatatcctccaggaatactggccagagggccatactgaagtttgctgctgccactggagccactccaattgctggccgcttcactcctggaatcttcactaaccagatccaggcaaccttccaggagccacagcatcttttctttactgattccagggctgaccactgcctctcacagaggcatcttatgttaacttacataccattgctccacgtaatacagattctccgctgtgctatgtggacattgccatcccatgcaagaagggagctcactcagtgggtttgatgtggtggatgctggcctggaaacttctgcacatgtgtggcaccatttcctgtgaacacctgtgggaggggatgcctgatctcttcttctacagagatcctgaagagactgaaaaagaagagtaagctgctgctgaaaaggctctgaccaaggaggaatttcagggtgaatggacttctccatctcctgagttcaccgctactcagcctgaagttgcagactggtatgaaggcatgcaggtgccctctgtgcctattcagcagtttccttctgaagcctggagtgctcagcctgccacagaagactgatgtgtggctcccaccgctcaggccactgaacaggtaggagcaaccactgaatggtcttaagctgtacttgcaccggctcttaagcaatatggaaataaacattaatttttttaaaaaagagagagaatggatatgcaaactgtgacacattcacacaatggaattactcagcagtataaaggaacaaaacgctgttatatgcaagaacatgggtgaatctcaaaaacatgagagaaaaaaagacacaaaggagtacctcctgtatagtcccatttatatgaaattctgggatgggtaaaaactaatataaagtggtaaaaatctgacttctgttgacacccaagataaaggaagctctctatagcctttctctctcaccaatggtcaccaaaaactctagagaggatacagaaaacagctacttaaagactgaagtaagcccaatgggaagggagtaaaatcttgaaaaccaactggtatcatggggaatttcctgaattcttgtttcctcttttatcttctggctatgatgtgagggcaggtggggtcctagaactgtgcagccagcatacagagtaaaaatgggaataaataccttgcatcaagcaaaaataaacagcatggcagacatctaaatataaagtacagttagcccttgaataatactggtttgaactgtgctggtccactaatatatggatattttttaataaatatattgaaatttattttcaagatttgcaataatttaagataactcacagacaaaccatgtagcccagaaacataaaaaaaagtggtgtaaaagttaggtatgttatcaatgtgtaaaatatatgtaggtactagcctattttatttactataaaatatacacaactccatgataaaaagttaaaatgtatcaaaatttacacaaacacagaccatatatggcactatttgctgttgagagaaatgtaaacataaaaatgcagtatacaattataactggataaaattacagcacataccatactactgtaataattttatagctacctcctattgctatcgcagtgagctctagtgttgcgagtttccacttaaaatgctgtgtgatgctagtcatctccacatgagcagtttgtctctccaataaattgtgtatcacactaaaaagtgatctcttgtggttcttgtgtatttttcatgtttactgcaatactgtaaaccttgaataacaccatgagacctatacagagtgtcactagtgatgctaaaagtgctcccaagaagcagaggaaaagttgtaatattacaagaaaaagctgaattgcttgatatgtaccacagattgaggtcaacagctgcagttgtccaccatttcaaggtaagtgaatccagtgtaaaaacaattgtttaaaaaattttaattttaaaaaaaggaagtttgtgaaaccatccctgcagctacaccagcaggtatgaaaacatagcactttttgtgaaatatattttatctcgtattgaaaatatagcttttatgtgggtgcaggattgttataaggcatacctataaactctaatatgatttgagagcaagtaaagtcattatatgactacttaaagcaaaaggaaggtgaaggatctaaagctgtagaattgaatgccagtgaagggtggtttgataattttagaaagaggtttggcttttaaaatgtcaaaataaaaggagaagaagcaactaatgaccaagaggctccctggaaaccagggagtttccagatgccattaagaaaaatcattgaggagaaaggatatctgcctgagcaggttttcaatgcagatgaaagataatgctctattctatggggaaaaaatgccacaaaggacatcatttattagtaaggaagaggagtgatcaccaggacttcaggcaggaaaggacaggctaactccactgttttgtggaaatgtagtcaggttcatgatcaggattgtccttatctacaaagctgctaacccccaagccttgaagggagaaaataaacactaggcaacaggaacacttcttctggatgggatacatcgatgctttgtccctgaagtcaggaagtgccttgccagtaggtgactgccttttaagttcttatttggcaaaaataccaataaattgataatgaacaatgcccccggacacccagagtgtcatgagttcaacagcaaagacgtcaactgttctgcttgcccccaaacacaacgttatctaattcagcctctagatcaggaggtcataaggacctttaaggctcattacacacagtattttatggaaatgattgtcaatgctatggaacagaatcctgacagaatatcataaaaattgtgaagaattacaccagtcaagatggcatcatctttatggaaaaagctgtaaaagcccgttaagcccaaaacaataaattcctcctggagaaaactgtatccagatgttgtacattacttaacaggacatacaacagagccaatcaaagaaatcatgtaagagattgtggatgtgggaaaaatgatggtgggtggagaggagacaaagtgttgtctcatatatgaatcttggagctaatagataaccataccagaggaattaacagaagataatttggtgaagatgagcacttcagaaccagtgccagaggatgaggaagaagacatagaagaagcagtgccagaaaacaaattgatatcaggtaatctggaagatgggtttgaattactcagcactgctttttatttcttatatgatattgaatactgcatagtatttttagagaaattttgaaaaagcaaaaaagtcagttagaaattatagtgtagttccataaaattatactgaatatgcctgcctctcttgcctccccttctacctcccccagttctttggcctctgccacccatgatacagcaagaccaactcctcctcttccttatcctcctcctcaacctcctcctcaacctactcaacatgaagatgttgaggacaaagacctttatgatgatccacttccacttaatgaatagtatattttctctttcttatgatattcttaatggcattatcttttctctagctcactttattataagaatacaaaatatataatatagcatacaaaatatgtgctaatcaactgtttatgttatcattaaggcttctggtcaactgaaggctattgacagttaaggtttgggggaatcaaatgttatacacagatttttgatgtatgggggttggtgtccataaaccccacattgttcaactatacaaattttaaaaatacatctcaagatataatctttgtgaccttgggcaagacaaacatttgagctctaatgagcaaactcattcaaaatcaatggaatgattcataaataaaatgaataaactggacttcatcacaattaaaaagctctgctctttgaagagttttaagaacttttaaaatacattaatttttaagccacatcggaagaaaatatttctgaattaagtagctagttaaggacatgtgttgagaatatgtaagtgactcccaaaattaataataagaaaacttaaaacccaattgaaaactgggaacagtttgagcagacattttaccaaagaaaattcaagaatggctaataagcccatgaaaaggagtttaacagcatttgtcattaaggaaatgcagctcaaaaacacaatgagatatcactacatacctcttacaatggaaataaaaacatccaacaataccaaattctagtgatgatgcacagctactggtactctcatacattgctggtgggaatgcaagatactacagtcgcttttgaaaacagttttacagtcttataaattaaatacatccttactatatgactcagcaatcctactcccagatattggtccaagagcaaaaaaaaaaaaatattcacactaggaaaactatatgtaaatgtttatagtagctttgtagcataatcataacaaaattcaaacagcccaaaggttcttttgctgccagattgataaacagatgatggtacattcattcatacaatagaatactattcagccacacaaaagaatacattatttataactcacaataggaatgaatctcaagtacattactttcaatcaaagagtctggactcataaggttacatactgtgtgattctatctacatcactttctgcaacagccaaaactatagcaataaagaagagatcactggttatcaggagttagcaatgggaaaagtggctacaaagggcaacctgaaggaattggtaggataataagatttgttgattgtgatgttgggtgaatatgggcttacatgactccgcattaatcaaagctcattgaacaatacatcacaaagtaattattttggtatagattaataagctagtgatccaagttaatttcttcccctatgactatcaaatctcaaaaagaacaaatggtctgggcatggtggctcatgcctgtaatcccaagactttgaaaggcggagacaggtggatcacttgagatcaggagttcgagactagcctggccaacatggcgaaagcctgttcctactaaaaatacaaaaaaagccggacatggtggcacactcctgtaatcccagctacttgggaggctgaagcaggagaatcaattgagcccaggaggcagaggttgaagtgagctgagatcgtgcaactgccctccagtctgggcaacagagggagaccctgtctcaaaaaaaaatcataaatgaaataattatatgtaaattcttcaaacgtaaatttagaaaaaagttaattattttacatactgtgtactacagctttaagcaatgcttgtatttctttttaatgagatgaggtctcactctgtcacctaggctgataacagctcactataacctcgaactctggggatcaagcaatcctcccaccttagcctcccaaagtgctgggattacaagtgtgagccactgtgtccacgtatagaatgcattttttacctatatatttttttttatgttttcgattttggaataaaatgtttttcaaatgtgtcattgactgagctaagggatgctcagatagctggtagaacatttctggatttctggggtgtgtctgtgagggtgtttctggaagagcctagcatttgaatcagtagactgtcaaaaagatcactctcactttactggcatcattcaatctcttgaggttccaaatagaacaaaaaggagtaggaagggcaaatttgctctacttttttgagctgggacattcatcttcttctaccctttgacattggagctccttattctcaggccttcggactccagtagtgcatccctcctgctcttgttctcagaccttctcccttggacctagagttacaccaataggatatgaatctatttatataactaacacacacacacacacacacacataaactgaattatgtgtgtatatatatatattttccattggttcaatttctctggagaaccctaattaatataaattagtctcagggctcaaagaaaataaatcattatgaaatagagaaatgaaatagagtaagatgtaaaattgtacgtatgtgtatgaatcacatatattattaaaaagttcttgttaactttatagattggtatattaagagcagggggaatagtcactgaagaacataagatcgatatagcttgcatatttctcaccatccaaatctcatgttgaattctaatcccattgttgaaggtggtgcctagtgggaaatgattgaattatgagggtggatttctcatgaatggtttagcaccatctcctttgtgctcttctcatgatagtgagtgaattcttgtgagatctggtaatttaaaagtgtacagtgcgccccctttgctcccactctgccttgtgagacacctgtgctcccttcactttccaccatgactggaagcttcctcaggcctccgcagaagcagatgccattatgcttcctgtacagcctgcagaaccatgagccaattaaacctcttttcttataaattacctagtctcgggtatttctttacagcaatgcaagaacagcctaatacatatactgagttttagaatatatattatgtatataaatatgtaccatttacttcttgggcaatacttcttgacattaagaaagtatcttggttatgcatcagaaaggcctgatatgacatgaggaaggtagacaataaagtctaccttgagaacagggcattaccatttcttagatgttcagggctatccaaagcaaaatagtaggataatttctatgttttgtgtagtccttggcatattactacattgtagaaatatgaaaatgttttgtagtaatctagtttatccatcccaagtggaatattttaaatttctctgtttataaaaggattgtaaactgactttatttgcaaacatttgtgggaaaataaagccagatcttctcttgtgttggagaaaactcctgattgtcattgaaaaggtgaccctacttaatacacagtgttccgttcagctcaaacaggctctcagaaaggtaactttgggtcaggaatttaaaaaaagtcacatcatttatattagtgctcttctttttagaagaacttactggcatgtcttctcattgtttgctgtgggtgaggtttaatatttagaatttcaagatataactatgccatatcatatatatatatatcatcatacactttatatatacacacatatatatatagcatcatacattttacaaaatgtaaagattagtttttcaacacccaaatcccatgtaaaatacatactgcactgaacactcaaggaattaattgttgagtaattaaattctcagttcctttattttccatccagaactctttctccccatttagtttgcaatttctaatatattatgaactaggaaattagaaagcaaagcttaataaaatttttgataaaataagaatagatagtctctgaacgctgatctaaatgaactattctataagtgaaacacacatgtatttaagacatctattatctgcgcagaggaatttcagcactattttcagattccctggataggttctttgtggttttaccctgctacaggacaaacacaatttgtgcttgaatatttgattgtaactattgtttagcattttcttgcccttaaagtcattttttccagcatataaaaaaattaattttgtggtaatagctatacttcattttgtacctgattctatactgttcagctataatttaaggggtgactactatgcctaatcttattctaacactcacaataattctgcaaaataaaaatattttcctctcttaatacataagaaaactgaagttaaattattgagtaatttttcaaacaggatacaactaggaagtggcattgttgagattcataccctctgtccaatccaaaattcacagatttcttagcatttagcgccgtgctgtctgactgtttcttctgtatttggagagaatgctgtagtctttaatcagcctcctttttgtcagtatctactaactgagcaacatttctagggaaatctttagagagcctattctcattttcccttcaaaggagaaagaagggaggatagaacatccccagtgctggccaaggctgcagtctgcattctgtgctaccagacctggagttgcacattcttgctgagacaacctaggaagctcagaataagagtgacagacaagttggttggatcacaaggttcaaataccactgatgcaaagtactattactagattaggcaacataaaccatgaatctagtgggtagctcaggatcaagaaaatgaaaccaataaagagattaggtgagggcagatacggtcaacactgagtaggagtgggattcggggtattattagtgcaatcacaggcatttgcaactggcagtaagatcctagagggaagagattatgtctcattttttcatagactcctcagcacccaagagagtgtcttttttgttaattgctgtatttaagggtaatcatggaattggactggactgcaaacatgcagcaaaggtctactcgtcttaaaatagataagataagaactagaattcctgtgcaggggtggagtgggatgagaacacacggctaagacatttccttccatttttaggctgtcaccctcggaaaacctggcaaggactctgtcacagtgacactcgcagtaacttacataccaactcttggtagccctgatcagacattttaaatcctccccatttcgtcatacctagtttctcaatgaatattgattttttttttgtttgcttttgtttagttttgcttgttcttgatggacaaatacagtaattagatgtctagaggctctgcaaaggtttgcctgtgcatgcagtagaaagaacaagtggagagcttttttctcactgcagtgctggtgcctttggctatcatttttatttctgctaagactatcataattcttttttattttctcatcttagccctggactctcaggccttttatgatatatgtaactcaatgggatagtatgaaacaaatgcatctgcatgaagtcactcagctttggttctagtattctattctacctggagtaatttgctgaagtgtagaattattaacaaatttgtgagagctaacaaatatgattccccagattcagagtcaaacacttcttcaccgtaaaccaattcttcacgtaggtcctgggccagtgtacttttgcaagatgttcaaggtataagatgtcatttttgatagcacatgttgatagttagcaatggtcaaaaataattgtctccctcaaagcacaactattgtaatgtacatgcacctttttctgtcaactataaatttgaaaacaaaattacactgctttgcaagtgttgaagctctttacgttgcactttaaataaatgatattttatgaggagaaactggatgttttcttatcatactgaatgagttaccagggtgttcccttgtcacttattatatcccctatacagtgatgatatgaatcgtcatcattataattttattttagtttttataggttttaaaattaatttcccttaatttgtatttttcttttaaaaatataattagttttctacatgaatttgttcatatcttaaaatgctaagaatgcctataaatgaagcaaagtaaactttctctagtctgccatactaacctgaagactttatctaaatttacaaagaagaatgctgtttccttccaaaatcaatcacatcattagggtgaagaaagaaaacctggaaaggtttttctacaattgtatcattagtaccacatggaactaaaatagttgtgagaaagctgcttctctctgctagaggaggaaacagatgtgagatttaagaggacaaaggaaaaagaggtaggtgctctgtgcattaggtgtgattgcttctgtattagatctctaacgcttcataacaaattactacaaactcagtggcttataaaaatactcatatattatctcattgtttccctgagtcaagagtttggtgttttagctaggtcctctgttcagtgtctctcaagacaaagtaaagatgatggctgtcttcatctgcattgggagacttgactaagggaagatccacttcaaagatttctcaagttgttggcagaatttgtttcctgtagatgtatgactgaggtcctgttatcttgctgacttgctgccagggattaggattactctcaccacccacagacctctatcaggtccttgccatgtggctctctaacatggcagattggctcctttgaggcaagcaggagagtttctctcatcctttgaatcacttctttcagcaatgcccctgctctcttttaaaggatcacttcattagattaggcccacctaggataatctcccttttaatgaactcaaagttaaccgatttaggaccttaattatatccaaaaaatctcttagcctttgtcataaagtgtgacctaatcgtgggaatgaaattcattgtattcagagtcctgtcctcactcagagaggggatgatacagagaatggacatcaggaggcaggaatcatggatgtcatctcagattcagctcaccacagcctctttaatttaatgcttgttctaaaaagagcagtatgcattctgctgattgctatccttgaagcacataagttttttttcctagaaatcagggctgctacttcaaagctgaagtaaatgtgtgagataaaggacaaatgagaaatagcactgtggaaacaaattatcattttacttccagttgtatggtgaccctggctaaccctctaactcccccaaaaaataatacctaaaaatgcacagcatttaaaaatacctctaatgcatgaattagctatcaatttaataagaaatacttaaaggcttaaagctaaatgaaaacacactcccatgatggtaagctaggcattgacattggtgtttatttgcagattgttgaacccagagactgaatgtacttgaaagcaaggagacaatgaatgcccaggagcttcaaaatggaaagtcaaatagaagacccttcacataaagctagaatcccgccatgtaagaagcttttttttttcttttgttggaattcttcagagaaacagaaccaacaggataagagcagaaagagaactagagagggcgagagttatcttaaggaattggctcatgtgattgtagaagtctgacaagtccaaaatctgcagggtagactggaaggctggagacccaggtaagaacagcaatgtgagttcaaaggcagtctactggcagaatttcttcctacttagaagaggttagtcttcattaacaccttctactgctgtgaggcccacccacattatgaaatgtaatttgctttattaaaacttcattgatttaaatgttaatttcatctaaaaataccttcccagaaaaatctagaataatgtttgacaaaatatccaattgctgtggcctagccaaattgacacgcaaaaagttaaccatcatgtcccttcaggtttgtgggaactagaattaaacatgccaacttaagggagacaaaaaaaaattgtctccaattctgtcacagaatagaaaaaagacaaaacatttgagtataagataattcataggcaggtttgtagtctgtattagtccgttctcacattgcaataaagaactacctgagactgggtcatttataaagaaaagaggtttaattggctctcctggttctgtaggaggtacaggaagcatggctggggaggtctcagtaaacttacatttatggctgaaggtgaagaaaaagaagccacatcttacttggccagagcagcaggaagagagaatgaaggggaaggtgctacacacttttaaacaaccagatctcatgagaactcactcactgtgatgagaacagcaaaggagaaatctgctgccatgatccaatcacctcccaccaggcccctccactacattggggatcacaattcgacatgagatttgggtgtggacacaaatccaaaacatatcttagtccaaccaaatttaccctagcttggtgtactgaaaataactcaaaagtttaaagcaaccccaggtacctgatagaaacgaatacaaaccatccccctactcttcaaagtaagaagagtaccttcacataggcctcaaagtatattacataatattccccaaaatatgagttcaccatcgcaaatcacacacacacatgcatgtaccaagaagacatcatgaagaagagtgagcagaaaaaaaacccaaagtaaaataagagtttctggccatcactgtaagaggagtaactgaaataaaacaggtacagtttggaaagaagaatcacagctttcattattttgggttatatgattgtctatataaagtaccccaaagagtccacagataaattttcagcacccatagaagaatataacgagtttgctggacacgttatcactgcagaaaattaattgaattccaactgaatttcctgtcaacaaaaaggtagaaaatataatcataaaaatgcgttacttacattaccataaaaatatacatatctaggagtaaatctaaaaagatgtataagaccttcatgaaaaaatataatactataataaaatatattaaagtctaatagcaagatataacaagttcatacattcaaaaattaatgctgaaagatttcaattcttatcgattcaatgaaattacagtaaaaattctaacattcttagagttactttaataagatagtaattaagactgtggagtatatgtgcagagatttaagttataaatgaaaacagactggagagtctcaaaacagtgccccaaaatatacagaaacttgacttatgatagaactatactgtagatcagtgatggaaatatttatatgaaattaaaaaataaattgatctctagctacttacccccaaacgaattcatgagtgattaaaatctaatgtaaaaggtgaaaccataaaactttctcagcaggaatataggaaaataattttgctataggagacatatcttacaaaagatataaatatataaaccataaggaatacttaagaatcttctgctcttcaagactccagaaagagaatgagaagtctaccaacctatgggaagaagatgactgcaatgcaaataatttacagaggactattatccaggataaacaaagaactcacataactctacaagaaaaagataagcaataaaggtaagcaaaatatatggattgacatttaacagaagaagcacctgagtgatcaataaacatgtaagatgatatttaaaatcactggtaaccagggaactacaa

SEQ ID NO: 589 - DNA, 88661 bp, Homo sapiens
ttgggaggctgaggcaggaggatcgcttgaggctaggagtttaatgccagcctgggcaacatagcaagaccccatctctacaaaaaaattaactgggcatggtggcacacacctatagtcctagctactcaggaggctgagacaggaggatcacttgaacccaagagtttgagctgctgtgaaccatgatcatgccattgcactccagcctgggcaactagaataagaccctgtctcaaaaaaaaaccataaaataaaatttaaaatgctaaaaataattaaatgacttctaatcatttgaaagagcaaaagtactagctgaattgaagccaacttaaaactaaattgcagatagtctcctacagtctagataaccaagtgtaatgtaaacattgcattattactaggaatgaatggagacacctgagatttagaaatgtatgaggaattgcggaagaggtggaggtttccctatatgactaattctggcatggcttctaaatcaactgcaacttctttaggacccattaccacaggtatctcctgtcactatcatataacatgtcagtgtcatataacacacctgcatgtgcaagcacgcactcacacacacacatacagacactgcaaacacatacctacataatatgcattcacacacccacatatctatgtgacccaatgcacaatacacatttccacatacacaccctacctagcacacaggtttggcaaacatatgcccccaaaacatatgaacatccacacctcaagaatatatgtgtattttccaaacagcaataccacacatgagcataacacacccacacaaataatgtgcaacacacagctgcaccacacacactcctactctggcttccctcttgaccgtcacaggctgtagtctcaatatgttgatagaagcagctcatttgggcaggaaaagtgctgccttgaccatcgcgactttggttttgcttcagcttacagcaggggtctccaacccctgggctggtactaatccatggcctgttagggaccaggccacacagcaggaggtgagtggcaggcaagcgagcattactgcctgagctctgcctcctgtctgatcagcagcagcatcagattctcataggagcgaaccctattgtgaactgtgtatgcgagggatctaggttgtgcgctccttataagaatctaatgcctgataatctgaggtggaacagtttcatcctgagactatcctcctgtctctggtctgtggaaaaattgtcttccacgacactggtcccttgtgccaaaaagtttggggcctgctgacctacagtgtctcccgtaatctagaagcctaaaacaaagaacccaaaatcatcacagtggagccgcaatcaatatcttattcccaggaaagttgtgaagccctttgaattaaaatcaagatagtccgtgaaccagagatgggacaatgagttctttctgtaaaaaaccgaacatggtgttcactgctgatttgatgcaatttaagggcagagatgagtgaaacttggcacaagtggtttcaatgaaaaatgctgtaaccagaaaaatcattccatgtacaggacttggtcttgaattctcaatatatccctctgtattttgtggcttttgaatatataaaagtgtattagctaggatttggtgcagctgtcaagtggcgggaaactcaaaatagtagtgacttaagaaagaagagggaaagtaattctctctcatgtatatatagaatgtccagggctggcatggtggttgcatcatcactggggacacaggcttcttctctcttgtttctccaacaccttcagcatatggcttccacttcaggatctaagatggctgttccagttccagccatcatgctgacattccagccagccagaaacaggaaggggaagggcatgcccctttctttcaagagcactttctggaaggtgacatgctacacttgcatgtacatcttactgatcagaacttagttacgtgagcacacctagctgcaagagaggtgtagacatatggtatttattctaagtgaccatgtgccagttaaaatttggggtctattactataggataaagagagtggatataagaagatagctattagtttctacaacacatttttaaaggattaaaaatagctttgggagcctgggcagcatggtgaaaccccatctctacaaaaactacaaaaattagctggccgtgatggcattagcctgttgtcccacctactcaggaggatgaagcaggagaatcacttgagcctgggaggttaaggctgcagtgagctgtgattgtgccactgcactccagcctgggtgacagtgagacacgctctcaaaaaaaaaaaaaaaaaaaaagcttccacccagaggtaatcactgaatcactgttaacattgtaatatgtagcgtgtgtgtgtgtgtgtacatataatttcttttacaaaactgagtcaataccatatgcacttttttgtttgcattttgcaaatgtctttttatgactatgtataaatatctatccttttttaaaaagctcaaaagaaaaatctatgattcgacctaataaaataagcatgttatccaagacacttactaatacttgcttgatgtatcattcagttcagggatccaaggagaccatttcacatcatgcaaaaagctgggaggaattgagaacctatgagagggcagggtccctggctcaaggaacacatgggggagtggtgaaacccctaagaatgcaggtgtaaaggatggactcctggtgagactcacctctctgtccctgggaaggaaaagtggaggggggaaagagagtacaaattgatgcaggtatcctccctttctccagccaaaccttcaagtgctgctagtgttggctgaagaattgagctcatgatattttgggaaaattattttatgaattctgctgtttatgatacttagggctttattcccttagcaacttctcctaggacttagaatccttctcaaagctcagaggattacatttcagataagcatgcagaatggtgacttatcttagtggcaactaagaaatctcagttcctgtgtgctctcatttagtaggcctgctttattgacttggtccccacaaatgtgtcacaggaaaacatctttctttctgcttaccactccctcgctgtcttcctaaagcatcaattcaaatcaactcgtctgagaattctcctgtgggtccctgcttcctcttgcaccacatctaaccttctctactgaacttgcagccccctctgcgatcagctcactgctccccactgcgggctctttcccagctcctcattgtactgaagccagcaacactgtgggttcctttccagggctgagacctttctttcttaaggaagggtgaatttgagaaccagatggactctatctctaatgaactgtgtaatactgaatgttatttaacccctttgagcctctgttttcttgtgtgatcaataatacataggagagaataacaaaaatggaataataaatatgatcctataggggcgtggctgggtcaaaccatgcacacagagtgccctgcattgtgcctggcccttggcaacggattaagtcactgtgacattcctctccccatgcttttccttttcctgtgtagccatttttctgtttagggccttttctctgctcagttcacagcagattgtatcctgcctggatgccacttgttctgggttggtcttcttcaccttgctcctgctgggctgggctgtccagttgtgcagagcctgttggcttttcttgcagctgaggttctagcctctgaccttcttagggaattctgtgccagaacttggtggctatggtctcccagctgcccaaagtctccactgtcctgatgtgctaacacccttcttggataaattgtacaggccttggacgcagagtcagcctctgggcagtcaggtggagactgcagcctgcctctggacctgcccccttccagaaccttttatctccccagaagttcttggtcctctgtcttctctaataaatgacagaaaggctccactgtaaagccatggatgtgtctttctgaggttagaagccgcagtggacattatcttttaaaaccacctttataaaaatgcaatttccaggacaatcaaaactaaagttagaaaaggaaaaatgaaaaaaaaaatccctcaaattggacatacaaagcattactatctacagtggacttcatcagctctacaagtacagcattaggtcctaacagatggggtaaagaatagatcattcaaataagaggaaattgaaactgtcttacaaaaaagacaaatatttaatgttattggtagtcaaataaatattagtcaaataaatgtaatttaaatttttaatgaggtaccactttgcttattagattgaaagattattttaaaatagtaaaacccagtgctggaaaagctgcagagaagctgttacgttcacagagtgctattgtcattgtaaattattaccatcattttgaaaagcaatttggcagtgcattttaagagccgtgaaaatgtttctgctctttgattgacaattttcacgtcaataatcatgcaaaataaaaataattatgtgcatgaaagtaatctttgtagggttgtctacaacagcaaaaatacacgcaatctaaatgtcaaacagaaggggaatggtgaattaaacattgccccgtgtcctcaatgtaatattgtgcagccatcaaaataatccttccatttaccatctcatatttgtctgatatcttcatccccacattgtgcaacgaattaggaggcaatcccttggttttctggccccctaattatcaatcatgtgtggccccatctgtgcttgtcatccttctgcccctgcccactttctcaggttaatctctccacctgtcttgcaggccttccctatctttgttccccaccatctcactccctcaattacctcctctcccagaaatcaacctcagcctcttggctgtctcttttcccttcttgttgctttcattttcaaggaaagctctcccttgtacctacatctctatctagctactgccctattgctccctcccactttaagcccaccttcttgttagaggcacctgcactgacctttctcacccctcactgacacccattcacttcagcctggctgccctgtgctttcagcaaggccaccaacatcctggttgctgtgttcagtgaatagtttttccttcttgaccttagctcatttagcctcccagggtgtactttgactctccttctcctgaaactgctcttcctttgattcccacggcccactctcttgtctcccacagtcttgtctccctcactgaggctgggattccatcatatgtcctgcctttctcactgctcttctcaacatcctttgtcattacctcttcctctacccatcctgtaaaaacagtattcccgaagggactgtcactgatccccttcacttaggttcatcaactcttttcaactggagtcagacacgtgggattcaaattctgaatttctcactttccaaacatgtggcaaagttgttccacctcttaagcatcagttttctttcctgtaaaatggagataataacagaacccaccccatagcatacctagtaaatggtacaaattcaatacatgctagctattcttcttcttcttattattattatatgataccctactctattttttcagtctagactctgctgagtttcagagcaactcttgtattcaatgtcctactggaggcatttgcctggctgtccttcctcaaactccatatgtccacaactgcatgaacaatttagctcctccccaaccccattcctgaccatatctgaaaactgggagacacccttgataccttttctccctttatctgtatttttctccccaggcatgtcccataaaatactccaagtggatttccctaagctcatgccccaaccaccagaatggtgaaatgctaacgttgtaaatgcgggaaactccaagatcatagaggagcccagggctgtaagataaaaggagctggggccccagactgaccatgtgaaaggctgcctgcctggcagaaaggcctgctttgaatttcatgtgagaaacaatcccctagtactttatgccaccaagatttttgaaactatctttcacagcaactagacatgctttaactaatataagtccaaaatatctgaaggattcatgaactactccagtcccctctgttacaaccctccgttaagctttcataatccttttttttagtagatcattgtaaccgcctcctaacaggtttgcctgacttcactcttacctttctctaatccattctccatacagttgttggtggggccttcataaattgttagaggatcccaagtttgattttatcaaccattcctgcttaaggagatctggcactgattccccactaccttcatataaaatccaactcccgctatgccataagaggcctttcatgaattgtctccacctacctggtgtatctgtgcttctgtccttttgtcttcctggccagccagagttaactacccacagtctcagtgccctgtgccaggcttccttgactgcaagcttttgggtatgcagctccctcagcctggaacacttccgtgtcttccttacctagataacagttactcatcttttaagattcagctcaggtgtcacctcccctgagaggccttctgtgactcctccaggctgggtgaaagtctcctgagtgtcctcattacccttatattcacatcttttataacatgcattataccgtcctcataaaatctgtttacttgtctctgaatacagacaatattttggtgtcattttctagcacgatgtatagcatatagttagcactcaataaatgcttattgaatcaatgactaggcaaagtataaaaacataattacaatgcaacatagaaaaggttgacaataaagagctgggtgtggtggggcatgcttgtaatcccagctactcaggaggctgaggcaggaagaacacttgagccaggagtttgagtctagcctaggcaacatagcgagaccccatctctataaaaaagaaaagaaaagaaagaaaaggaaagaaaactattaacaacatgccatttattactaagtgaaaatttgaattgtaaactgtatgtatagtacactgcacactatgcaataaatctacatgaaatatatatacatgtggataaattttggaaataatcattcaagagacatttatttagcacctactttgtgccagataatagtaatggaaagattaattagaattgatccatcctctcaaaaagtctacagtcttggggtggtggtgggggtgaagcaatcttgtttagctgatgggaatattgggaaatgattttctttcaaaattctctttaattgttcaaagcaatacatttaaaaaacagcttgcaaacagaaaacagtctatcaaatgctgctcatagtaatactgaagttataaaattcaacctccattatcttggatccatctatccacagtaaatcctctatgagtttttgagtctgcctacacactgttgcacactttgatccatatttgtttttgcttccccacaagattgtcagtctcatgaacacaatggatttgtctgattaaacaggtgctgggcagcccctaactggcttaattttgctatctagtttaagggtggcctttcttttcatacaaagcagaaacattggggtaaggtggggtagggaaaagtctatgctagaaatggagaggaaccttttttgaattactcaaccccaagcccctgctcacctgcccttcagggaaactgaggggagctgagaactgtggcaaggggaggcacctttcctaccacatggggaagccctgaccacatgcccagtgtcctggaggccagagttgatgatagtgctgctccattttgcatggttcatcaggcctcacttgccctcttggcccagacagggacagaaagagaggcaaacctgctactgggggcctgatggccatgccagggaagggtgagggagaggaccatcctgttctttccatcaacagctccaggacctgtcatggtccctggcaaatggcagcccttagtgagtatgacgctggtgaaatgaaccagatcaaggctcaagtctcctgctagtgccctgtgtaactgtggacaacttcacctctctgaacctcagttatcccacctgcaaagatcataacttcaaactccatgtaattgtctcgaagaataaaatgaaatagtacggaaggagcttcaaagcactttgaacatgtagggtctatttgaggatgcagggtgggaggaaggggaggagcagaaaagacaactattgagtcctgggcttaacaccagagtgataaaataatttgtacaacaaaccctgtgataggagtttacacatgtcacaaaccttcacatatacccccgaacctttttttttgaaaaagagagagagagagagagagactccagcctaggtgacccagtaagactctctctttctcaaaaaaaaaaaaaaaaaaaaaaggtggggggagccagagaccttaacagacacctcaccaaagagatatcctcatggtacatatgcatctgaaaggatgctccacattacatgttatcagggaaatacagattaaaacacaaaaagagagagagagagagaaaagaaaatggggggcatggcaggttggaagactgcctctgtgttcattttcaaatacactaattaatagaaacaactttctcattaacattctcataatcagtaaagttggtgctctaagttgtaatagtatacattccttcataaactcaataaagttattttcactctttatgaaaaaaatacatatgcctttaaatgttatgatttatttctcatgcaaaataatgttcattaagtgaattaaaccccaaatctcaactttcctgcagtgttctgcatcctgtggacatgtgatgataataatggtgctttgctccttatctaaatttgtggggaacattaattgatgctgagcttccaggatagaagccctttggagtggggactgcccacctggcatgagggaggtaggaacatccccgatgtgtctggacatgctgaagaagtaggtaccatagagcactgatgcctgaggatgaggggcacccctggggacaagcagaaacagaaagaaaggagatatttttaatagaattcatcttcctcagcatgtgtccccaaaagattacactccatccaacaccatggatctggacaaacaatgtagtgtattcagtggccctttgtgatttctgtctcttgtagcaacaatctttcttaataaacagcttcatacatctcaccaagcacttgctgtcttcctgagatgtcagcacaagcacctggataccaccagatagacttacacttcccagttgaacactatactgcttatccccaagaatcaagaacagggagcgtgtgtgtgtgtgtgtgtgtgtgtgtgtgtttgtgtgtgtgtgtatgcgcatgcagatgcccagagagagagaaagaaagagacagagagaccagaatttcttgccagtgtgggtcttttcaacgtagttttgtaaggttctggacagcttggctggctgcagtcctgatattatgaaacagaattgatttgcaaggatttgagccaggagagggcacacctgggaggcagctgtgagatcagccagagcaagggtgcaaatgctgaggtatcttgaaacctacagcagaataaagggttgggacaacctgaaccagagccagagtttagtgctccctaatggggctattgaattcatcagggccaagagagaaccatgtgccagcctttatcttgagagaggaaggaggttctgtgtgtatatggaaaattaaaggtctgcagaggagatgtagtgaatgtgttaaacctgaaattacacaatgatttagagctggattctcactgaaatttctttattgcaactattccaaaaagatatccactatttcaggagtttcactacacactaaactgacaaagggattgtttagatgagtgttctcaaccctgagttttctttcgggtctttagaaaatacccactccagacaaaatgaatcagaatttctgggtgagggatccaaagatgggtagttttaaaaacccttccatgtaattctaatatgcagccaggattgagaactgctggcttaggctgagatgggaatgagatatcaaaggaagctagagaaagaaagattgtggttgaaaggctctgattcctgggcttagcctcagacaagaaaagtgtcctcatgtttatgcttaaatagtgctagaacagaaagaagcaaggcacctcagcctgtgataagttggtcaaagggttggcaataatgaatttaatctgtgactaccaatcagaagccaaactctgaagaccccaaaacataaacaaaaccagacaagctggtggatgaataatacatttggttgtatgtttcagtcaatgatcaaggattcacagaatagaaaccattcaaggtagcgcaagattaggaaggtttgtggtagagacccaaaatgtaatttcaaggcatcaagggatttgggctcccagagccaggaaccagacactcagggactgaggtcactcctttcacctcttggtcatttgatcttcttcatctctgttcctcttcacacatctgcttcattcttccagagcagttggctttctctgattaaacacttcacacaaggtccaacacacaagtggttcagctctaatttatcactgtctttcatgtccagagcccaacactgactcaccgttgttaacgtgtttcttagttcaaattttcaacagaaaaggatctggtcactagcccagcaaaggatggctgatcgtatctagcttcagttgaggtgtcaatctcctcccatatactagggtatgtgtggaaaatttcatgtagtttacaggctgaacactttaggagaccattggaagggcaggtgcttatatagtagctataggcaaggcaagtaaagaagtccatctaatttccatccataactgatgaaacagacatattttgctttcccatcttctaccttccaaaatatgggtggatataggggagataaggaggagtttgaaagaacatgctctgtctgcccaggacctagtctagcatccaaaagaggtaaccacagattggcatcactcaaagtcagtctacatatcctcaaccatcatttatgtacatgattctacatgtgttgtcttcctctggaaatcactgagaaatccattcttggtaatgttgaagcctaaggatattcagagatcctgtggtaggttcaattttaacctcatactttctgctacattgtggcatgtgaaaatggaacatacttagatattaaggaggattctcctccccttgggcttttatctgatcatttggaaaatcctcagttaacatgctgttacagtggtttgacggctcacttgacagctctgaaataacattcttgactcttagatgacaatcttgtaccgaaacacaaaacggctcttttcagaaatttagaacttcagccaagttttgggttcaagaaaatagtggtgtgtggatttttttaagctctccaaatggataaattgtgtgtaaactcactttctgtccaacatcagctattgcaccaaataattgaactgtcatatgtcccttgttcttgtaattaagttggctgcattgaggcaggaatagtctggacttgggggtcatgtttaaaggcagcaacctagggtaaacttatcctccaacccatggacagtctgaatatcttttttcccctctttggagctagaggcaaagtgaagggaggaaagggtccacagggagaagtagggggagcactagcaacaaatgttgccaattttcacttttcccagaccatgtggtccctgaaaagtatggctgtggcctctgtgcaatgccatcatgccaatgtgcaatcatctattttagaacctcagatggcatcaactattttagctcttgcccaggtacagctactgcacattctgggagaagaaagagaataagaagactaatattcgtatcttactgacaaaacaaaacacctttaaaacaaaaggatgatttatctgggctgaaaataaaactcctgcctactgaagtctggtgcagctgagttatcacgattttcgtcctgtaatttgttttatagggtactaattaacagggcaaagtctgaagccaagaaagtaaatcacattttgctgttttccttttctctagcaagatgcagacctggtctttaattaaagcgcaagttccaagggcgatatcagctaccgaaatcgggaaaacatgggccgaaaaggtcacagtgaaacctgctgtgtagagttcagaaaagataatgggaaagagaggaattgcacaggcaacctccaaaagaagagattgttttcctcagatgtccctgtcttatccatcttttaactgctccccataactcagaatttcttccctgactctactcaactgagcatgtaccacaaacatcctttttaaaaattggatttcaggcctggtgaggtggctcacacctgtaataacagcactttgggaggccgaggcgggtggatcacacgaggtcaggagttcgagaccagcctgaccaacatggcgaaaccccatctctacaaaaattagctgggcgtggtggcgtacatctgtaattccagctactggggaggctgaggcaggagaatcgctagaacccaggagacagaggttgcagtgggccgagatcgggcgactacactccagcctgggcgacagagtgagactctgtctcaataaataaataaataaaatttttaaaaagtgaatttcttttcccagataattcctgtttcgggaacggcatttttttttaaaggtagctactttcccatcaaacacccctgtcccaacctcccccttctccggggtttcttttttgacctgatccctcagtgatctttgacgctgggctttgctgcccggcaggtgtcactcatccttcacccctcccctcccagctcaccctcttcgccgcctggtctcagggtcttcttcactcctttctacctctccttgtctctctcccatcccattcctggaagttctggactggaggtggttgctctggcttctcctccctcctaggaccctcagatagtgttgggggcagggggagtgcggcggggagggcacaggatgggctggcgaggagagtgagtgctgggctcgcaccgggagccgggagcctgacgtcaccacgccctgcctgtcaatctgcagcgcgcgccgctcgcagccgccttttctgccaccaactgtatctctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccaggtgagtggccgagttcccagggaactttgaggatgtggggagaggaggggagaaagatatccaggggacaggtctttccagaagaggagaaatggagccaaccttgactcccaccctctgctgcccccatacacacaccctagtctctcctcccagacccccttcgcaggggtctctgggctccaggactctccaggcttcgcaatgccagaaacttcgctttcagcaccgcggacagcgtctctgctgcccagccccatggggatgtcctggtcgcgccgccacaacccaggcgggactctcccaggatgacactcctagcttggtgcactcgggtgcgtgtgcaaatacaggcagccttggagaattgatccttgtgcatgtgagtgcatgttgtcctggtgtatatctgcaaaaactcagaagtccgcgtgggcatttcactcactcactcaacaggtatttattttgggttcgcacttaacccatgattccccgatttgctctggggtcccagggtggggtgggcaactcaagtggggcaatgcgagaggaggctctacgcgtggggaagtttcctggcagcctgaagtgtacacctgacgcctgcactccctccctatgcagggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaaagggactaaagagaaatgtaacaaacttacaaggacaaagaggcttgttggcactttacatatacagtgtatacatgtgtacatatatatacaaatatttgtatcttctggaggtgttcaggatgtggagcttcctattctgtgaaaaaccaagaaaaagatatggttgtatactcaaattgtacatcacgtttgtcaaacgaagacattccaatactgcttaattatagcactttatttttagctgctgaactgccaaaacagtgttgccattttcaagggcagggaaaagggagtaaaaggtgtatttttgtcgtatgtgatagaatattttgctgcacatgcatcaacaaattacaacatgttttgtacacgaataaacccattacaagaatgtaatttggggtatgtcactgactatagaattacaattagctgaattgtaagtgtatgagtgtctttctttcctttctttcttcctttctttctttcttgcttgcttgctttctcttgctttctttctttctctttcgtttgttcgagatagagtctcactctgtcgcccaggcctgaatgcagtggcacaatcatagctcagtgcagccttgaactcctgggcccaagaaatcctgctttagcatccctagtagctgggactacaggcatgccacagcactcaccttactttatttatttttttaagtttttaaaatttcagtagttttgagggtacaggtgccttttttggttacatagatgagttctttagtagtgaattctgagattttagtgcacctgtcacctgagcagtgtacactgtacctgatatgtaatcttttatccctcacctccctcccaacctctccccactgcaagtccccacagtccattatatcactctatatggttttgtgtcctcatagcttagctcccacttataagggagatcatattgtatttgatttttcattcttgagttacttcacttagaataatggcctccagcttcatccaggttgctgaaaaagacattatttcactcctttttatggctgagtagtattccatagtatatctatatctatatctatctatctatctatctatctatctatctatctatctatctatcatctatctatcatcttttctttatccaatccttggttgaagggcaagtaggttggttccgtatccttgcaattgcaagtttattatgtagcatcattctcctgagaaaaccttaacgtaaaaaaatcatatgcatttgcacattgttcataaactttcactgaaataccaaatttatatcattgtggttggggagggagggtgcaggaagggagtaatatattcatgtggcagtattcacaggacaacaaagggttactggtgttatctgtgcaatttagtctactcccttggttagtgggtttggaaaacaagtatccgaggatgtccgaaaacatatcttcctctcattccctgtgcacttgtgaatcctgaaaccacaactttcatttgtaatttttccagtatggcaagaattttaaatgtctaaaattcatgttgacttaatacattgtcgctggccagatcttgtagtaaaatgcacaggcttgtaaaatgaataaattcttccaagacagaattccaagatatatacctccgacctcatgaggtacacaaaagtatatccagtatcctctcttgaggtgctctcaccttcaaaagagggcactaaaatccttaagcactaaacattcttattccactgatagatgtgagtcatgatgattcccctccttcccttcttataggatgatgtgaggataaattggagaacacatgagggcatgctctgaaccctctgtgaattaatatgcacaccagcacaagtcgttactactcttatgccttaggaaaatacacacaagcaaatttattgagttcctactatcctactattgagttcctagacacaattccacggattggaatatggaagtgaaaaaaaaaaaacaggcaagaagtctctgaactccatagtgctaccttctagtggggaagatggcctacaagcaaacaaacaaatatataatgtcatgttaggataaatgctaacaaagaaaataaaggaggatgagagatggagtgctccagttagggtggccagggaagatctctctgaggagataacatctaggaggaaagctcagtgaagggagaatgagatgcatgagcatgcaagggaacagctttccagacagaggaagcaacaagtgtgaaggcttccaggtgggagcatggtcttcaagttcaaggaacagcaaggaggtcaacgtggctagacaggctgaacaaggagaagagaggcatgcagttaacttgaaggacctgggatacgatcatctcaaacttcacaggccactatagggacttgggctttgaccctgagtgatatgaaagtgacatgatatggtttatatttttaaaaaaatcactctagctatcctgttgaaaatagtctctaggagggtcagagtgagagcaggagataggggtctataaacataatccccatgagaaatgacagtggcttgaggcacaatgacagtggtggagatggtgagaagtagtagattctagaaatgtgttgaaggataaatgggaggtggggcatgaaagaaaaaagttcggaattcatccaatgagtgaatgcggggctttagtgagcaaggaaaaactgagggttgggggggtgtacattgggaagtgtgacgattaattttatgtgtcaacttggccagacaatagggagcccagatatttggtcaaacacattttgatcatttgaagtcctgaatagaacaaaaatattggcctcccccaagcaagaaagaagtcttcagtgggtttcccttggactccacttgcaacattggctcttcctggttctacggaagatggtcttgagactggaactacagtgtcgacttccctgggttgtcagcctcctggcccaccttgcagattttggacctgccagcctccataatcattgaaaaattccttagaataaatgtcttcatgtgcacatatgcgcacgtgcgcacgcacacacacacacacacacacacgcacatccaatgggtaggatatatctatgtacatatacatcctattggtcctgtttctctgaagaatgctgactaatacgggaagggtggcaaatttaaaaagttagttttaaatacctagagagctcacgtgtgcagtttattcatttatttatttcacaaacacttctatagcacttactatatgccagacactgctctaaaccctttacaaatattagcttatttaatcaccacctttatttaattccaaactggttaggtctcagcaggagacaaatggcacactcaaaccaggtgactgaggagagtttaatgaggagactatttataaaagtgtgagcatagttaagggaaatcaacaaggaatggtgaaacacccccagagccagcaccagcagggctgcgagaacggggaagaagagagagcaattactggaaccaggagagagggctttaggtctcggctgtccagcaggagctatggccttcaacagaggaaggcagcaactgccaacctatggcttgacagggagagatctgggagaataaattactctcttccctccgtcccacctcttgatggaggcttccattaactaaactgtcagaagccagacagcaagacaactctttggtgcaggccacacagatcagcttccctgggcactgagcagatagagaagggtgagaagtggacctgctggtgcaaacagagaatatccagcacaaacactgtgagctcagtacccttgttgccccactttttagctaaggaaatggaggcacagagaggttagctgtgcatatctggaattcaggaccaaggtctaagcaggacaaatgaattcaggacttgtcaacatataggtagtatgtaaagccatggatctagaaggggtcacctcatgatactcatagacagaaaagagaagagggccaaggactgagcccaaggaaatggcagcatttagaaatcaagaagaaatagaggatcaagcaagggagaaagaaaagtgatcagtgaggtgggaggaaaccaagagtacagtgacccaaaaaataaagaagaaaaaagtgtggggagaagtagtcaactagttcaaatgcagctgagagaataagtaaaatgagaactttaaaaaatggctaaagatgatgtcatgtgtatgtcattggtgaacttgacaagaaaagcttcaggagagagagagaaaaaaaaagcctgactgtagaagacacaagagaaaatatatgagcaatctagtctccagcaactcgcaacagaacggtgaccttttcaacactataaaacacactacattttatagatgtagagttttacactgtctataaattcaaatcagggaagatcagcattattgctcactcatcaaattaaaattttctaaagtattaactaccatcatggactcttcagcatcaccagacactggttcaggtcctattatcatctggaatgcattcaagtgaactaaaatgtaaaagctcgtgccgtcaactttctcatgtgtgatggggaaaacaatataatttcagaagtagaacaaaaaagtcaatattattttatcttttatactcacggagaaaaaatttcttgcaatcatcacattaagaaagttcaacactagagtaatcagacgcaaaccatggatctgtcttcaatgcactcattaatattcaatatctgccctggtcctaataaaaatgtctgggagagccaagtttaagaagatactaaacaatcaagttgttactaatgctgacttacacagttggccaagctgtgtaatgtcagcaggcttaatattaaccaacctgggaatatgaaaaaataaaactgtgagaagatcttgaaacatttccacagaagaaagtcacatattcatttgacctatcaaatattaattaagaattacctactgcaagatcctatgctagttgctagaaacatagtcttttaaaaagttctttaaatttttttatttttaatttttttgtgggtacatagtaagtatatatatgaaaacatgcagtcttggagaaaggcaagactcactcaaacagctaactgcctacccactttgttgtctaatgggcatcctaaatttaacacatttaaaattggaccactgatcttcacttttgaacctgatctttatcccttatgtataagttaacaacaatgtcatctttctgggtattcaggccagaaaccttagactcacacttgcccttctatttctctcatacctcacaatcaatgtgtcagcaaagcctgttgtctttaccttcaatgtatacccagaatccagccacttctcaccatccacaccactctcatcatctcttgcctgaattactatagcagcctcctgtcttgtcgcccacttttcagttattgtgcctatccacccactatctacacagtggctcacccacataaacagttgctccttgactactcttcagatctaggcataaacctaccaggagttctttattttattttattttattttattttattattttattttaattaattaattttgtttttgagacagagactcactctgttgcccagcctggagtgaaatgccatataaggcaatagaaacagctctgagaacagtactaatgaaaagtatgacaacaaaagtatgcactgaatagaaaaggatccaacaggaatgtcaggaaaatgttgtgcaggtctccactcaggaggcaacaccaagctgagtctagaagaacaaaagaaattttgaaggcattgaagggggtggggggtgttctaggcgaagagggcaacatgaagcacaaaagcataggccactcagagaaatgcaggccattcagcatggctggagtgaataagatgtagagaccagagaggaggtggcaggagatgagtctggaaagatagaaggaaccagagcacaaacagctgcattgacaatggatgtagatggaaaagactggaacccaaataccatttgggaggctggttgcagtaatgcaagtgagaggtgataacagcgtgagctaagcagggcagagggctggggaggagatgaactcaagagatctcaatgaagtagagtgtctcagactcaacgagtgattgtaggggctgaagaacagtttagaagtcaagagtgttaaactgcgtgaattcactgaaatggaaacatagagggagaggaagatttgagtaagagaataacgagtcaagctttctatgtattgaatttcaggatctgtgagatattgagtggccctgtggctttggagctcaatattattttatcttttatactttgaagctcacaaggatgcttggaatggagacataatttctgtagtcattgaccttacagtggaagtgaagctatgggaggaaatgggaataggccaaggtcatagtccgggaccagtaacatatggaagtagaatgaagaaaaggaaaagggaaaaggagacctaggagtggcatccagggagagcttgagaagccaagaggatgtgattaagtgtgtaaaggctgacaagacatcaagtaaatagggattggcaagggttcaatttaggaacatggtggtcattgatggcttcagtgagagcagcttccatggagagtaggatgaaaactaggttgagtggattgaggagaaaatgggaattttcatgtttttcaataaatttagctttaaatggaaggagagagatagtatctagatggaaatacaaaatcacaagataatctttctcacttttagacagaggagaaatcaccacataactggaaacactgaaaataggagaggggaaagatggctgacagagtcaggcttgacaggaggaggatggggtccaggacacagtgtcagaggaaagaggagtatagacaggaggaggtggggacacagttcccctactctgacaggaggcaaggtgggaataattggtactgatagatctaagtttatgggaggtgggaggaagttcatagagttcctacctgacaacctagattcatctgaaggaggagtgccagttaagagactgttacaagaagtatcgagaacctgagttgatgacattgggaacaaagctgcatacttgagacactgtaatcatttaacaaaaggtgaagttcacaccatacaagcactgcaagaatgtagagcaattagaattctcatagactgatggtggaaaagtaaaatggtacaaacactttggaaaatctttaggtggtttctcaaaaagttaaacaaagtcctaacatgtgactcagccacccactagtaagtatttacccaagagaaatgaaagaatatgtctacataaaggcttgcacatgaatgtttatagcagctttatttttaacagccaaaaactagaaacaattcaaatatccatcaacagtgaatgagtatacaaatggtggtacatccatatgatagaatgctaccctgaaattaaaagcaatgaactattggtacatgcaacaccatggatatgtcttcaaataattatgctgagtgaaagaagccaaaccaaaaaaaaaaaaaagagcaaatagagcagtattctgtttatacaaaatcctttaaaatgtatagtgacagagaagatcaacggttgggattgggggtgtaggaatgagagagaggaagggattgaaaaggaacacaatgaaagttttggagtgatatgttccatcaataactagtttactgagagtttttaacatgaagggattttgaattttatcaaaggccttttctgcatctattgagataatcatgtggtttttgtgtttggttccatttgtgtgatggattatgtttattgatttgtgtatgttgaaccagcctttctcccaaggatgaagccaacttgatcatggtggataagttttttgatgtgctgctgaattcggtttgccagtattttactgaggattttcgcatcagtgttcatcagggatattggcctgaagttttctttttgttgttgttgtgtctcttccaggtttgggtatcaggatgatgctggcttcataaaatgagttagggaggagtccctccttttcatttgtttggaatagtttcagaaggaataataccagctcctctttgtttttctagtagaattcagctgtgaattcgtctggtcctgggctttttttggttggtagggtattaattaatgcctcaatttcagagcttgttattggtctattcagggattcatcttcttcctggtttagtcttggtatgttttatgcgtccaggaatttatccatttcttctagattttctagtttatgtgcacagctatttattacaaacccacagctaacatcatatttaatgggcaaaagctggaagcattccctttgaaaacctgtacaagacaaggatgccttctttcaccactcctattcaacatagtattggaagttctggccagggtaatcaggcaagagaaagaaataaaggatattcaaataggaagggagaaagtcaaattgtctctatttgcagatgacatgattttatatttagaaaaccccatcatctcagccccaaaacctctggaactgataagcaacttcagcaaagtctcaggatacaaaatcaatgtgcaaaaatcacaagcattcctttacaccaataataggcaagcaaagagccaaatcattagtgaactcccatttacaatctctacaaagagaataaaatacctaggaacacagctaacaagggatgtgaaagacctcttcaaggagaactacaaaccactgctgaaggaaataagagagaggacacaaacaaatggaaaaatattccattctcatggataggaagaatcaatatcatgaaaataaccatactgcccaaagtaatttacagattcagtactattcccatcaaactaccattgacattcttcacagaattagaaaaagctattataaatatcatatggaatcaaagaagaccaggtatagccaagacaatcctaagcaagaagaacaaagctggaggcatcacgctacctgacttcaaactatactacaaggctacagtaaccaaaacagcatggtactggtaccaaaacagacatatagaccaatggagcagaacagagacctcagaaattacaccacaaatctacaaccatctgatcttcgacaaacctgacaaaaacaagcaatggggaaaggatcacctattcagtaaatggtgctggaaaaactggctagccacatggagaaaactgaagctggatgccttgcttacaccttacacaaaaattaactcaagatggattaaacacttaaatgtaaaacccaaaaccataaaaaccctagaagaaaacctaggcaataccattcaggacataggtatgggcaaagacttcatgactaaaatgccaaaagcaattacaacagaaaccaaaattgacaaatgggatctaactaaactaaagagcttctgcacagcaaaagaaactattatcagaatgaacagaaaacctacagaatgggagaaaatttttgcaatctacccatctgacaaaggtctaacttccagaatttacaaggaacttaaatatatgcacaggaaaaaaactaccccatcaaaaagtgggcaaaggatacaaacagatacttctcaaaagaagacacttacacagccaataaacatatgaaataaaactcaacatcactgatcatcagaaaaatgcaaatcaaaaccacaatgagatactatctcatgccagtcagaatggtgattatcaaaaagttaagaaacaatagatgctggtgaggatgtggagaaacaggaacgcttttacactgttgctaggaatgtaaattagttcaaccattgtggaagacagtatggcaattcctcaaggatctataacgagaaataccatttggcccaggaatcccattactaggtatatacccaaaggaatataaatcaatctactaaaaagatacacacacatgtatgtttattgcagcactatttacaatagcaaagacttggaagcaacccaaatgcccatcagtgataggctggataaagaaaatgtggcacatatacaccatagaatactatgcatccataaaaacgaatgagatcatgtccttcgcagggacatggatgaagctggaagccatcatccttagcaaactaacataggaacagaaaaccaaacactgcatattctcacttataagtgggaggtgaatattgagaacacatacacacagagaggagaacagcacacaccaaggcctgttgggggttgagaggagggaacttagaagatgggtcaataggtgcagcaaaccaccatggcacatgtatactcacgtaacaaacctgcatgttctacacatgcatcccattttattttagaagaaataaagaaagaaaaaggaacatttggggtgatgaatatgcttcttatcttaactgtgatgatggtttcaccagcacatagatatgtcaaaagtcatcaaattacacactttaaagatgtactgttcattgtatcaattataactcaataaacttgtaataaatgaaggtcagaaaaagacctatagtacaatagcagataatttaaaataatgccacatgaaaataaaatgccaagtcccaatatagtgtgatttattagtcagaataggctaaattgtgtgctgcagtaacaaataaccctaagtcacagtggcttgacacaacaaagatttctcatttgtgcaatgttacctgcagtgtctgggagacttcacaatgtaacgcttctctatgcagcaatatagccattcatcttccggctctatcccctcaacttgaggccttctccgtaattactggggcagggaagagagtacgggagggtctcatgcaagcaattaaatgttttagcccataagtgacagttccatttacagttcataagtgactcttccactctcagacctagtcatatgacctcacctaactacaagggtaatttcctgagtgctcagaaagaaaggggaatcagaaatgaatgcatctgagaagattttaccattcatggcttgaagaaaaaatacatcatctttgccatcccaaaatgaacatcaggcttcagagagagaagagatttgcaagattcaaacccaaattttcaaatattatttaagactaaacagaagtttatggttctttaataaaacttatgtaataaggatgttgggttaagttagctgaatacagtataaataaggaaaaacttgaggtaaacataaagaaagggctggtccagagatgagtctgattttctagcctcagccagactttgcccctggtctcacaggaagggagaattgtgaaggtttagcataaacccttcttcactgtgacagtaagctgtggctttggcacataacccaaacacagagcattcttggaagctgggctaggccatctaaactgttcttttctcttaacccaagaagggctaatgaacctcagtccaaagcatgacttgctttgcccagtttaagccctcagtactcaaactcaggtctcagatcttgccactaatcattacaaaacaaaccaaagcaaacttaaacctccatacctggggaggggagagagagagacagagacagagagagagagagagagacagacagacagacagagagacccagtggctagttagactggacctagccaacacagaggaggatagccaggggaactagctaggctcccgacaagaagcagtgcttgtcccttccactccagccaggaagaagggagtaagcagttagccacttgccagatagacaaactggatcagtactcttgtcatttaagggtatagagaacaggaagatggggagagagaaagaacagcaccttacagcataccagggttgttgtaaggtttaaataagttaatacattaagttagaatagtgcctggtacaggtgccttagctactatcattattactctcgtttttactactattaagcagactttacgaatgctgaatttcatagtctagattttatagccttaagtgcattttgcttttcaagtttccctctattgcactcataatatatttctcatatgttacctgttttcagtaatctgcaaatcttgaaaattgccattttgatatctttagctgctgctttggaaataactgttactgacacatagttaagatttatctccaaaacagcaattcaaattaatattatgcccattttttccaatagaccaaaatggagatctatgtgtttgttataaaatattggtcttcaattttctaatagaatgttgatattcaagaatacctgagcagaataacattaacacagattatatcatcttggcttcccccaaaccagtttctttgtacagaaaaactaaacaaaaagaaaacgaaccagcaaatacatacattctctctgtctctgtctctgtctgtctctttctctccctttaactcacactgacacatgcagactcacatgcacacacacagaaacacatacacattattatgtacctgggagtccctgtgacctaccagggctcactcactgggaggatataatacgcacccagtagtagtttgcatttaaggatggtctgcaaaactgaattattccctaaaaaaagtataagaaaggaatttgttaggataaactccagagatattgccttagtccgttttgtgttgctgtaacaaaatacctgagactgggtaatttataaagaaaagagatttatttagctcacagttcttcagactgggaagttcaaggttgagcagctacatctggtagcctctggtgagggccctgtgctgtgtcaaaacatggtggagaaatggaaggacaaaacatgaaaggcaacctcactttataagaatttgctctctcagaaactaatccattcccacaaaaactaatccagtcttgggagaaagacattaatccatactaatgacctaatcaccttttaaaggcaccacctcccaaaactagcacactggggaccaagattcaacacgagttttggtggagattaaccaaattcaaaccatagcacatattcataaactacaagaccaacatttccagccagagtagtggctggatgaacatatttgaacacagacatgaatgcaagggaaagaagggcctacagtcactaagagaattctgagtacagtcacttatcaggtgctgcacgttgggtgggaggaaaaggctctatgtattacaggctgtctgaatatgcaggagagaactgtgtgccacagacctccttttgtctcagcttaaattgtagcgtaaccaaacacaacaaagattacagtaccttgcagtagggtgttactgtactattgaaataagccttgtatcaaaagaataattgcccctagattttaaaaattactattattagggaaaacacacagtaaatgagcatgagacagtactgttacttttactggaagggtgttaaatttgcattttgcaaatattataaacaggataaatatgaaaactatggcagaaggtaaagacaactaaataataatttgagaacattttgataaatcatatttccactattgtggatgaccatccactttattactgaaatgtctgacagctgataacatcaatttttgtggctgaggcatttaattactatgtgacaggtgtcactgaatgggttggtactaaaccagcagaatttccatgccatgcaaagtgcttgtgaaatccagtctgcctggggcttgcagattgcacttaactccaggatcctgtgactatttgtgaccttcttcctcctgccatagggccaccttctctatccaggcagccaactgtgtttgctgggggttttggttgtggcatcagagggaatcagggaggcagggaccttagaagccatcttttgcaactcccttgggtttccatgatatcaggtctcagagaaagagggacacttattcgagactgcacagctagtaaatagggaagacagatttggaactcagtttaccagggcttcttaccacataaggtgttcagcattctgtcagctacacaggcccaggtgtgttcttgcctgtctttatagcccctctctgcccctccctctgctctcagacatgtcccttccttacatcttaggaacacagctgggccagcactccatcaccaaccctggtgcccaggctgagctccgagcattattaggggtggtgacacaagcctgacctttggcaaacagggtgctgatggagctgttttcagagcctgacactctcttctggacacaagctcagacgggatagtcccacagctccagagttcttgccctttgatgtgatgaggggaagggattgtgaaccccacgctctgcttatcattctctcaaggctcaaagtgtggctgcctttcctctttctttcagagcttcacaagacaaaatgatactaccaaggaggcagagtctggtggcagcttccaggtctattgttgtagacaactctctttggctaagcattcagggagttggtagacaagttgagccatcatccctaacaccagagccaaactctcctgagctctgtaatttagtccaggacctctttcatatcttgttcagtgcattcagcatcatcttcaacaacaaaatcatgctgttggccatcctaaggtctttaggtaaagcttttagtgcaatgagtcaaaagagttttctacctcctccatttacgtttaagatagattaatgagttaaaagttttgaaattattttattaaaaaattagaagaaaatacaagtgagtatctacctcttaaatctctggggtaaggaagactttctaaaagcaatggacaaagttacaaaggtacataagaaattaaagcatgtgtgccaaaacaagccctgccagaaacaaaactaaaagacaaagaacatagcagagaaaatatttaaaatatatatgatgtatcactcagccataaaaaggaatgaattaatggcattcgtagcaacctggatgggattggagactagtattctaagtgaagtaactcaggaatgggaaaccaaacatcatatgttctcaattgtaagtgggagctaagcaatgaggatgcaaaggcataagaaagacactatggggacatgggggaaaggatgggaagggggtgagggatataagaccacaaatagggttcagtatatactgctctggagatgggtgcaccaaaatctcatgaatcaccactaaagaacttactcatgtaaccaaacagcacctgttccccaaaatcctatggaaataaaaagttaaaaaaaattaaaataggctgggtgcagtggctcacacctgtaatcccagcactttgggaggccaaggtgggtggatctcctgaggtcaggagttcaagaccggcctggccaacacagcaaaaccctgtctttactaaaaatacaaaaattagctgggcgtggtggtgcacgcctgtaatcccagctactcagcaggctgaggcagggagaatcccttgaacccaggaggcagaggttgcagtgagctgagatcatgccattgcactccagcctgggctaacaaagcaagactccatctaaaaaaaattaaaataaatatataaataaaatatgtatgacaaagggtttactctcttacatatgaagaatttttacaaatcaagaaaatgttaatgaacccaacaggaaaattgacaaaaatataaaagctatttcctgaaggaaaatgaatgactcttggattgtattgccaaagaaatgtgacttaaaatgagatgccatttcttatctagcaagtcaggtaatttttaaaatgaaagtataaaatattgacaaagcaataatcataaagtctgttgggttttaaatatgtgtagaactaaaataaaacattattaaattttgttgtctaagagtagaaatgtgtgaatcaggaaaaaactgtatggtggaaaagttaacaaagcctttgcagtgtctgggaaatcgtgacagtactgtattagtttcgtagggttccatcacaaattaccacaaactgcatggcttaaaacaacggaaacttattctctcacagtccaggaggacagcaatctgaaaacaagttttctatagggctgagatctctctgaaggctctacggctgaatccgtcctttccccttccagctttgggtggctccagacattccttggcccacggcttcataactccaatccctgtttcctttttcacatggccttctctctgtcttctcttctgtttcttacaaggatgtctatcattagatttagggcccaccaagataatccaggatgatcttgactcaagattcttaattacatatccaaagagccttttcctaaataagatcacattcacacatatgttttattcagcttttattgctgttctgtgtgggagaactggtttattacagactagcccatcatagtcagaaatctctaatatgtttttaatgggtatcattctatttgaatgtgtttctgcagaatgtatgttttctatgcatatattttatatttacattaatggctgtgtgctgtgtgagatcacattgaattccttacctttttctctcagcaccatgcctttaagctatgtttgtagcaacgtgagtatctaaattttgctcctcactgttgaatttcaccgtgtgcttttaccacattctggtctccgggtaaagaagcccagatggctttcaacttcctaacaccacaaacagtatcagaatgaacattcccaggtatttttgaactatatatacctaggagcagaattactaggtcatttgacccagaatttctcagtcaaataatgatgacgtttgactaagtagtattaaatagctttcccaaatggctttatctctacctcaattttccagtattatggaagagtatttggaattttctgtacagcagaatagatacagtagtgatgctaatcattgtggtctcatcccccacacctgcttcctgctctggaatccttagttttaccacattaactggtccccacaagccacagctgattgacaaagccaggctctaggtcatgctgagccacttagattctttctaccaagaattttggataagaacactaaaaagcccagttagaaaatagtggacacaagggggaatcagttgagagagagagaaaatttggggaatggaggctggcacatacacatggcttcattagagatggagggagcagtttatctctgtaattctctggacttggtcatcatggatgtggctgaattttggtttccattttggatgtctaccaggataattgtttgttgaatccttaaaaaaaaaaatcttgacttcacctatactagctaaatcggctaagtttctagcaaccaaatagctcctaagaaaatatgtaaagttgggctcagtggcatgtgcctctagtcccagttactcaggaggctgaggcaggaggatcacatgaacccaggagtctggaaatgcagtgcactctgattgtgcctgtgagtagccactgcactccagcctaggcaacactgtgggactccatctcagagggagagagggagggaaagagagagggaaggagggagggagggaaggaggaaggaaggaaggaaggaaggaaggaaggaaggaaggaaggaaggaaggaaggaaggaagatgcataatattttcctgccttagtagacagagcacattgtttttgtaaataaagttttattggtgcatagccatcttattcatttatacatttcctatggtgctttcaaactcccctagagagctggaattctctagcaactggttttatctcttccctccttatggtcatccgctctttgttgttccttttcctttggtagggttgcagcaccatggttagttcctcctgtatctggcacctcttctgctatccgctgggccctcccccttgctgtggctttcttccctctttcccctgcagcttcttactttgcacttttgccttggaacactggacttttagggccagcatcagtcatcctatgctgtgctggggagctgtccagacactctgcatctttgtcagtcgtctcatttgacattctcattgattactttcatcataaattagttttctcttcggatcctctacatcgtggaaagttctgggaaccaagcagtggaaaactacaaaggatttcaacagttctccaggatacatgagataccaggcactggaacgggggaacccctgcatcttcactcagactctgctcaggcacctccccaagcctcttcctgtactgccccaactccacacagggaagggacaggccagggtccagataggcacctctgcagattgtcttggcacacagagacctcaccctgaagtacatcctgccctttagaattatcagtctagccatctttggggtgagagatatgagacaaggaagaggccctagatacccaggtccatctaaagtcttccaagacgtaggtttatacaaaacagccctaggcagatcatgaaggttgtgatttctgctaattggtggctggtgtcctgggagttggactggggcctcagcccttgctcttctcctgaatggccatgtgacctcagataaggcctttcacctctctggccctcagcttgttcatcagcaatgaggggtttttgactgagatgagttctaaccctgccactctgttcagagcagttgactggccaagatcctgtctgtgagggagcatagagagaagctatgttggctgggaacgagcccattcctcgggatctcagggatgtcccttgcttaaatatcttgggagggggtttattatacccaaaggctgctctgtgctttctggctttgactgcagcagaaatgctttgaaacttgatgggatttcatattctagcaattccttcccccaaaaggctccaactacattggagaaaggtctatgaacagcagagaagtgttcttttcacatcagttgttctgcttaaacccccagtagctccccattgtcactaaaataaagtcaaattcattaacatgactaataagggtttatgaagaaaaaccattaataatttgatccctgctgacttcttcccactgatctctccctggatatgcctaatgtctttcagtttttaaatacgctggcttctatctatctccaagattttgtgtgtactgttacctcttgcctgaactattttcatctcgctgctcccacgtcttcccaactggtgactcatactcaggtcttagcttccatgttcctccatcttactcagatcttagagttcatgttcctccatcttactcagatcttagagttcatgttcctcctttgtacagatcttagagttcatgttcctccttcatactcagatcttagagttcatgttcctccttcatactcagatcttagagttcatgttcctcctttgtacagatcttagtgttcatgttcctccttcgtactcagatcttagagttcatgttcctcctttgtacagatcttagtgttcatgttcctccttcgtactcagatcttagagttcatgttcctccttcatactcagatcttagagttcatgttcctccttcgtactcagatcttagtgttcacgttcctccttcgtactcagatcttagagttcatgttcctccttcgtactcagatcttagagttcatgttcctccttcgtactcagatcttagtgttcatgttcctccttcgtactcagatcttagagttcatgttcctcctttgtactcagatcttagtgttcatgttcctccttcgtactcagatcttagagttcatgttcctccttcacactcagatcttagtgttcatgttcctccttcatactcagatcttagagttcatgttcctccttcttactcagatcttagtgttcacgttcctccttcatactcagatcttagagttcacattcctccttcatactcagatcttagagttcatgttcctccttcatactcaggtcttagagttcatgttcctccttcatactcaggtcttagcttgtatattcctccagcttagatcagattaggtctccatgaggtgttcctgaagtgccctgaactccatcaccccaactggtattcttcccctttcataataattatttgttaaattgtctgtctcctttccaaactgttagctacaagaaaccttgccctttatcaccactgtgtgctaagatttttgacaaacctggtctacagaaggtactaaaaaatgtacatgttaaatgagggccatggaaggaattttttcctcttcatgagagagatacctttgttctttggcacttccatggcaactggcccaagagcctcaaagatgttctagttaagtgacttaattagctaaaatgcttaatggtggagagatgtctactgggattggaaggactccaagtgggattccagacaattccaatggctggggatgatgaggctattaaatgttgtcagcacatcacagctctgggaggcagctcagctgatcaataaactagttaaaaagcaaaaagtgaagagtctttcaacttttaaccaaagagggcattaaatccttcccactttgatctcttgactcattagctaatttccaacagcctaatgccccagggtagcaggatactcctttcccccaacatcttacagtgcccttaggcatctggaagccacccagcatggctaaatcacacatccctgagaaaactctggagtcccagagccaaggaacatccaaaaagccagctgggaagtctgagaaatctacttgttactgcagggtctactaattcaagcagatatgcactagagaaagcatggttgcagcatgtcttatatgtaaatggtgtttaatgagcaaatagtgtttaataagcaaaatgcttattaagaactacttacatataagacacactgcaaccatgcttcttatattttcagaggcagctactgcagctgaagaaaaaacatactttttctgtcacatttgttagaagacttcatatttataaaaaatttgatagaaatataatgtggggctcagtctgcttttgctaaaacaaaataaggcaaaatacttcgtttgggtttatcaaaatagttatttaaaatcttcctctgactgaagagcagtcctccctccctgggaaggtcatcctattccaaccagcctctgagatcaattgagctgactttggtgaacagtgggtgttatgggttcctccaggccatcctgtgacctggtcattttttttgtgcagccacctagcttccattccctcttctcatggcccttttacgtgcacagtgtcctgccctaccttgccagaaattgggcagagaacccaagctaggtcaaccaaactctttcctgcaagatctgattcttgactgcagtgccttaaggacagaaaagactgcatccattctaaggacagtggccaggaaaaaagcctggatgctttctgctatctcactgcccagagctgccctggttcctgttcttgtccctctcctggttctccatccttctgtctattatgtgagcttctcaatatctcttcaatacattacctttgtgcttaaggtgaccaaacttggtttctgttgtttacaactaaagaatcatgatataaactcagatccttaagtgaagatattttaaagttcagagttaccattattttaggtttatgacacagtgttcagtttaaaaagaaagatgcaaaaccataggtacattgatagctatttgaattaaaacaaaacaattgtgttaacagagagtaaaagagtgcaagaaaatatactaatgctgagagtggttatgttaagaaaggggcatggatcatttctcttatttttcctgcattctaaattatttgtgatatggcacattaatcatggaaatattaatttataataaagaaaatataaaatgagaatatgttgtctagtattagagaaaacatagtattgtgaccttcttaaaacgttgcaaatgtattacttggcctcttgttccaaatttctagttcaatttcctgccagaattctcaacacacagtagcagagtcaactcttaatcaactcttaatcatctagcgaagagctgggatggcgtgggctcacagcaatcgtctctcagtaagaacaaccaccctgcaacacattttagaactaaggatgagtcactcaaaagtacgcttgctggtagggttttacaaaaagtctttcttaccagtaaatagtggaagccatgatacatgggagcccaccaaagtgaaaagccagctttaatccacagagattttaagagcttaggcagaacatttccttcttttagcttaattaattctaaattaagaatttatttaaaaattgaaaaagacaagaaagctcatgcttactgttttgttgaagaataagcagaagaaggaaggtaaaatctgagttgactacataatttccatgtttgttaatgtctgcttatatttaagcacgagatcttatttcccatgtgtattagtttacaatggctgctgtaacaaatcaccacgaacttcatggtttaaaacaacacagatttattgtctttgctgtgcttcatccactccaaaccttatgttgaaatatgatccccaatgttggaggtagagcctaacgggagatactggggtcatgagggcagatccctcacaaatagattaatgccctccctcaccggtgagtgagttctcacactagtagttcccatgagagctggttgttgaaaagagcctgggtctgggcacggtggctcatgcctgtaatcctagcactttgggacaccgaggtgggtggatcacgaggtcaggagattgagaccatcctgcccaacatggtgaaaccccgtctgcactgaaaatacaaaaattagctgggggtggtggtgcacgcctctattcccagctactcgggaggctgaggcaggagaatcacttgaatctgggaggtggaggctgcagtgagctgagatcatgctactacactctagcctggtgacagagtgagactccgtctcaaaaaaaaaaaagagcctggaagcatcttccccactctcttgcctcctttctcaccaggtgatctctgcacacgtgggttctccttcactttctgccatgagcagcttgaggccctcacctgatgcagatgcccaaacttgaaactttcagctgagaaccaagagccaaataaaacctttccctttataaattatgcagcctcaggtattcctttagagcaacacaaaacaaactaagacacttaaggttctggaggacagaaatccacaatcaatctcacagtgctaaagttagcaaggctggtttcttctggaggctctagaagaaaatctacctgctctggtttgaatgtcctcttcaaaactcatgttgaaatttatttgctattgtgacaatattaagaggtgggacctttaagaggtgataagatcatgaattagatctgccctcatgagtggattaatgatgttatctcaagagtggtctcctgataaaaggagaagttggtctcctttctctctctaccttgtttgctcttctgccatgggaggatacagcaacaaggctctcaccagatgtggccctttgattttggacttcccagccttgcaaactgtaatctgaataaacatttattacttacaaattacccagattatggtattctgttgtagcagcagaaaacaagttaagacaccatccctggctttttccatcttccaaaggctgtcctcattccatggctccaggactccacatcatgtcaccctttctcctcctgcttccatcattacatggccttttcttgtctgactgtaaccttcttgcctcttataaatatcttataaggatccttgtgattacactgagcccatgcagataatccaggataatctccctatgtcaagatctggaacttaatcacatcacaaagtcccttttgcaatgtaaggtaacattcacagtttctagggattaggacatggactttaggggaagcgtagccattattcaacccaccacaccattgtatagcaaaaatactctatttgattaaaattaacaaatactgctgaaaatatagagaacaaacattttttaattagtaaaaatatgttaatatctgtcatgtgtgataattatactgtaatgtggccaaaaaaagtgcccaaattagagagggctcatcttttaatagcttcatccatttttctggtagagatgaatatttaagataaaccagtttttgtctcatagatatgaggccagtaattttttaatgatacaaatatatgtcttaaaattaacatattgcttgagtcttcttggcttgattagtaatgtatctattttattgtagggattcagaatttctaattgttacttatattctacatgcatgtcctctaacttgtgtgataaatgacagattctaatcagcatcctttctacgggtctgaagaggaactacaaggtgttaaagacaagaatgtcactccagcttgcagcactggtgcctcagcccttatcaatctgggacccaattaagaactagaaagtgagcaggaacaacatctgagcctccagagcaagaggtactgatgccccccaacccagcagcctgcattccatttccaggagcccagtgggcttcacacagagccatatggctttgactttaggcagcattctaataaacatgattatctgattcccaaggagacagaagttcatggaggtgtcaagttggaggttgggtcttgttgagtggagtactttactataggtggacacaatgaccacagcaacagtgaggtgattaggaaatatgtaggaatataaatgtgcacacactcacacacacacatacacacaacagacacactttctgagacttgatttcagtagattaaaaaaaaaaacaactcatgcctctgaacaagtaaagtaattgttcaaaaagcttacttttcattgcctaaaaagaccggctttttggttaattatccttaagaaaacagggaagtgttcagattatttaaaaaagagtttcataaaaattaagatttttttccctaatttacttaaaaggataaagtctcaaccatccagaaaacttggcttttctaaatgatttactttctggtatccaggtaggtataattgtttttttttttttttttttttgaaatggggtattgctctgtcatccaggcagtggtacaatcatagttcactgcagccttgaactcctggcacaagagatccttctgcctcagccacccgagtttctgtgattacaggcacacgccaccatgccaagctaattttttaaatttctgcaggacaaggtctcactatatttcccagtttggtctcaaactcctggcatcaagcaatcctcctgccttggcctcccaaagtgctggaattacaggggtaagccaccatgcccagcctgatctttttgcaaattaaatttttcattaatttgcattctactcattcagaatttttgataattatatctcagctggactagctaaattttgcctttgcataatccacaaagaaagagtttgcctagcaaactaataacacaaataagacttcagaaagatatatgtggtctgcttatctaaaaaacgtaaataaaatcctttgaaatgtatttatgaaaacaaccttcttagatatgtattttctgttcattactcttaatatggaaacatctcaatacaagtttcagtgtatgtcaatttttttaagtatttttaaaatatatttagaatttagactgaccacctcagtttgtccaaattaatgactctgtctccctgtgcattatactttaattaaatcagtggtgactaatttaacaaatagttggaaaactaagcaaagtgaaatgattttctaaaggcataataaccattaatgaccacagttcaagatataaattatacctaaaaggcttcctttgttaagttaaaaacatcaaacaccattttaattgagaaattaagtctaatgtatttaacactcagcaaaacttacaaaagctttataaacattttccagttatcctaatttttctttcatagacttacctaaaaacaatgggataacaattttcatatctgtaaatcacaaacatcataaccaacagatcaaaaactgaacttgcaggcataggagagtttgaatgcggtcttgtgagataaccaaagacctatggtcacacatagatgcagatagaaacacatctcttaggagatgaacccagaaggttaaggccagtatttaacattttcgaatttaaagctagcttagcatcttgctactttatgttcagaagagtttataaatagtgattgtatctgattacataaactatttaagttaaatttagcctaacaattattttgcttcctctagcaactgaatttggtcaatccaacagtttatgactagatagaaattggttaatacctttaatttctgaacaattggttatttcaactttggtttaaaagacaaaaagctttgacaaaataatattctatcttggatttgcatggaatttatctgggagtggagatggattattatggatgaaaccagatgggccatgagctgataactactgaagctgggtgatgcatacacagagattccttacagccttctctctacttttggtattttgatattttctggcataaaaaggaaaaaactatttgtattgaagacagttgaaagaaaacaagacaatactagtttagctagctgggcaaagtcagcccacttgctgttttgatatgattaggtccaaagaattcctgggtgaacaactgtgagatttctttctttcttttttttggagacatggtctcattctgtcaccctggctggagtgcagtggtgcgattatagcttactgtagcctgaacctcccaggctcaagtgatcctcccacctcagcctcctgagtaactggaacaatagccatgcaccaccatgtctggataattttttaattttttgtagagatagggtttcagcatgttgcccaggctggtctcaaactcatgggcttcagcaattcttccaccttggcctcccaaagtgctgggattataggtgtgagccaccatgccgggcctgggatttccatataataataattctgggatttttcaagccatcctcatcctccttggatgggaattgaccatgattcagtatttgatttctagtgaaaatgggcacatatgaacaagtacacctacacctgtacatttaaaaacatgtaattatacccctacgttgttctcagaaggattcaagatatttgtgcacaggagaaataaaacttaaattagttttgccatttagaatttctctccctaaaataaagttcatgaatatgtattttatatttgcataaaaaaggcaaacaccttgtcatgagacccttttgttcagttggctcacatcactcaagctcacgatgagagactttcctatttacacacagaatgttcaactgcttttgattgaaatctgattaagatcacaaaagttgccccagtaggaattttacttttcttcagtgacatccacttgaaattctcatttcatgactccttagattgtttttggtcatggaagtggggacccacaccttgtacccatatgcatttgagtgcagcagttctaacctctctgataggaaggtactttctgctagggacttatctgcattctcctttgtcatctcatcacctatcaccaataaaagtcttggaatcaaaaagtaggaagaaatttcctagctgggagcggtgctcatgccggtaatcccagcactttgggaggccgaggtgggtggatcacctgaggtcagaagtttgagaccagcctgaccaacatggtgaaaccccgtctctaccaaaaatacaaaatttagcccggtgtgatggcaggtaactgtaattccagctactcaggaggctgaagcaggagaattgcttgaacctgggaggcggaaattgcagtgagtggaaatcgcgccattgcactccagcctaggcgacaagagtgaaactccatctcaaaaaaaaagaaaaaaagaaaaaagaaatttcctggctaaactagagcaaaaggagccaaatcaccaaagatgacttagacaattcaaaggctaaaaagttggaggaaaaaatgttctgttcaagcaacacaagcagggatattatcctattccacccacttagaatcagtctgcagactgaataccacttggccgaaattctcctgtttgtctgcaggcaattggagcttgaatgcctaggtgacacagcagggcagggcacacttcaggaatgaacactccagcctgagactcagggactagaggaacagggggaattcatttcaaacaaaggtctcctggaataaggagttacaatcacatgtttttttaattcgacatgattagacagctttcagtgctaagcaggttgagaatttaaggatacctaaaccctggtgtgcatcttcactgtgcctttgagacccacaacgtcctatcactaaggtcaattcttattacatatgcttgggaacatttaatagatccatcaatgggagcaatgaaaagtttgcaaatgtgatgaacagtttccccaagagccatttggaacagcctaggaaattagttctaagcatgcagattagagataattctccaaattacttgtgacatgttaacgtcagtcctgtccccaaactctccccattggctttcttgattgtctaccccactaatgggtcaggtacaaggcaggtgctttagatccctgcttggcccccagccttcctctctatgtttagatcagccaccaggcaggtgctttagcctccctaggctgcatttaataactacctagacactgcttaaagctcctgatgctcaggtggaaccccagactaattaaactcaggtggaaccccaggctaattaaatctacctaggatagaacccaggcatcagcagttttttaaactccccagatgattccaatatacatccaagtttaaaagccaatacttcagatatataatctcatttaatctttaaaacaaccctgtgaggtgaatatttttccaaccctcttttatacaggaagaaataggctcagagaggttttgaattttataggtagtatctaacctatattagttactaaaatgctgatcctgatgtatcaaaactcaatgacacagcaacagaagcaaaaagcaggagctctgttaataaaacccaggaaagaacttttcaaaaggggaggaggttgggatgttctggacattgggttatgatgacactatggtgccttactcccatgccttgaagcctgtctcttgtctgaatgtcagattgatggcattggaccaaaatgattattatctggttaggacttgaaggatggaagctatttgtctcgaagaggaagaaattgtccttattaacaaacaggatgtcagtgggaaaagaaacttttttaaatctcaatttgggggttttaggagtccatagttctttaaggatggtctgggtagtaaactggcacatgcctcagtgaggcaggctgggggtcaaccagtgaggcactttgtaaatctggctatgtagcctaatccttggggagacattttaaaatatttcagtttccaggcctcactctagttctacaaaccattttcaaagagtggaatagaaatatgtcttctataaagctctcctacaagaaaatcactcagctaggggaccataggctgaagacgaacaagctgtgttttatgaggctaaataacaatagcgtcctctctgtgtttagttcccttttgtccctcagcccacagcacagccttgcttagacattcagcctggtctagtgtgtcctattagctgcatgtccattcacatgtcagaatatgaaaagtggccgaagtggtatctgtgaggcttcccttcagaaattaagtcaaagaaaaacctggttccgatcctggcagttactataggcttagacaacaatctccaaccctcagagcactggcttcctgatcagttaaataataagtgaataaagaatgcatgtaatacatataagacaatgcttactggtgcctaatacacgaaattttttaaaaacctagctaccttacctatgtggcgagaagtaaagggtctctcttcactgccagctttttgctataaaatgcagcaatttcctcccatctccggtcaaggcgagccaggcacaggtggaggatattaacaataattgggccatgtgggcggcccatgggaactaggcccaggtcatgcattagacatttacaaaaatacaaacttgcatttgaatgatggaggatttatttttcatatttcataataggtctatgttgtagaaaatgattcaaagttggatttcttcaatcagcccccctactgtaagataaaacttgtctacataaagctttctccggaaatcatctccagaattagagaagacccagcatttacctttatgaaagatatttccaaatataaaaccaagtgcaaagatgaattgtatgctgggagctctaccagctctcattttccaggtcttctcactaatttgccctttaatgtacacccaaaccaccagaagttatcatattcagcaactctttattgtatctgctatatggcattgggatagatgatggggctggttttgagctgtgatggtttggctctgtgtccccacccaaatcttactttcaattgtaataatccccatgtgttgtgggagggacttgatgggaggtaattgaatcacaggggcaggtctttgccatgccattctcatgatagtgaataagtctcacaagatctgatggttttataaaggggagttcctctaaacatgccctcttgcctgccaccatgtaagatgtgcctttgcttttctcttttgccttctgccatgattgtgaggcctccccagccatgtggaactgtgagtccattaaacctctttcctttgtagatttactcaatcttgggtgtctttattagcagcgtgagaacagactaatacgggtgagagtggaaaaatcaggatacatgaagagaaatacagcattctccctgccagaagagccaaccagtctagttacaataagcctatctcccttccatggctccgaggccccacaccatctttcctgctctcactggcctcacctcctaccattctccccttgctccctctctcccacctcactggccccttggctcttccttggtcccagcttgttcctacttcaagacctttgccacgtggcccactctgcctagatgcccccctaccgtgcccactgtgcacagacactacttcttggattggaggggtctgagcactaatgtcacctcttctggaaggccctttcctgaccatttggttcaaattggcatcccctttcctcttctctcagtcccttgttgaattccttcatggtgtaaaacttcttaccatttattactgttttatttatttgtctgttagctgagattttatttatctctctcacaagaatgcaaagcccattgcagtattctaagtgtttgtaatgtgtggttggtgcccaacaaagacttttacataaatgaatgagtagcaagttacatagcaaaggaagaggaaagattcaaaattaaagaaattagagattagagttcagaggtggaagagacagcccccctggtgctgagataagatggctgggataccttttctgaatggtaaaaggctgacactttccctagacttgtaggaatgggtgttggccacatccctcatggtcatatccctagtggtctcttggcagaaagccacagggataatcatctaataagccagttgatgtttgggggtatctcaataagatgccagaaaacagtgtagtgttttcaggtcccctgagtcccactttatcaacatgaagttgactctgaggagcccagcaagaggggccctgagaggccaccccttagggcctacattatccttgctctcatgtgaacaataacagctcacatttattgagcacctatttatgtgctaggcattagtattatcagttaatgcccacagcaacccttacttgggaaactgagtcagttaagtgacttcctaaggtcacctgagctaggaattgataacactgggttcaatccaggcatccaactgcagagcctgttctcagagaccctgaaagatgctgcctcccaaagctgttcatacacatcgccggatggttttactcccaaccactctagcccaagtggagtttgctaaatatttaaaagccattctttagtttgacaactattttgggcaactctattaaccttttcttttgagaaagtgggagtgcagttaatttatctatgacagtggtgtggtcttcacacacactatgatgtttttaacaatctgattattcaacacttttcccaggacaggatcttacccagctttgggggccacatggtcgatctgctgatttgctgaaagtcttcagagatatccttccaccacttgacaaatcctcctcctcctcctcctcctcctctttctcgacacgctgcctttggatttcttccccaccttggctagtgtacaatctcaaattaaaatgccagctggaagactggcacacacagtcacacgccaaaagctcacgtggaagtgtcaagtgctgctattactgagagatcgctggtagcatgcaagggtggcaaggcacaaatcttcagtctttctcttcctaagtgatgcagaggcataaaagcacaacttgactgaaaactcagaagtggtgttgtggctcttgtttgatgttgacatccagttgttgggactgtccatacagtgtgcgggtgagtgtgtgtctaggaaggggacagatccttttggctaactgtacagaacatggcaatatcaacatctgggtctgttaggaaagagtttggagagataagagccccctgttttttcttctccacatgggtgacagctcacacaggaaccaggtaggcccagagctgcttttcatctcaaaagtctttgttctgataaaatctacataaaagttttaaaggatcccactgtggtattccacacagtgttacagaatactatatttcccctcaaaatgtgtgcttccttaggtctgttgcaattcaaaaccagattgttttaccttcatcagccaacagaaaaatataaaatcattgatggccaacttctagaaagccactaaaagacatttttaattttaggtgaagtatcaaatagtaccctttttgcctcctgtttgctttttgtgacaaagtcattccaacaagttatttcgaagacatttctaaaagcctgtgaccagaaacaggcagaactgaatcttcttactgaacaagaacgttcatatgcaccttgaggtatgttatccggggtcaccttgaggtggaaatcagatgctggcatgaccagtaataaaagatgtcagatcctgaatacagttacttcattgggtgattgttacattttctttggaaaacagttttgcataatctacgaattttggacatacccatgtcttatgccccaaccattttcattcccatggaattagaatttcccaaggtacattctaggcattatagttctatcaaatgcttcagatatgcagacatgtgcaaaaatgttcacagcagcactatttgtaaaggtgaaaacatagaaactgccatcatgtctctcaacagtagaataaattgagatctagtcacacaatataattctatacagcaatgacagtgaaaaactactgctacacaccccatcgtggacgaatgtcacacacacacagtgttgaagaaggaagccatacacaaaggcatacgtattgtttgggtccctttatataacaaaggtcaaagtcatgaccagtgacagatacactagtgttcactttgccatcgataattgggctatatatttgtgtttggcctgttttttcacatgtgagttatatttcacaataaaaaatgactttttaaagagaaaatgaatagggaggaactaaagtccattcatatgtccatattctcaatttgggaaaaaatgtggctttgtcttcatcctcttttcctgagtgtataaggccagaagccaaaggcaagagcaggacattccaggagcctttatgattgctctaagtcacatctgctctcgagctcccattccactgtgaaaaatacctagtcttgaactttggagttccaaattccacatgatcgacttcctcaaggcttttcacttgacgaacaaattgcatgccaagaaatcgtcaaaattctatcaagcttaattatgcaatttctgtctataaatgacatacctcctgtaccctatgacacccacctatgcactaataagatgtgacagctgcatcaccaacaaagcctcccccgcctgccattctcttcggaggtgagcacctcctgctcgggaggaactgacagcccctttcagaaatgtgaaggcagtgaagtcccaaaccagaaacagtgtgaccacctaggctcacccaaggaccgtcctgtgcttctgggcaaccaatggatgtagggggttaggaggcagtggggattcgtcacgttttcacctttcacaccaaaacgcattcctgttggaagttgtagcgttctttccatgaagtcatgtgtgttttgttttttttttcagatggagtttcactcttgttgcccaggctagagtccaatggcgcagtctcagctcactgcagcctccaccttccgggttcaagcgattctcctgccccagcctcccgagtagctgggattacaggcatgtgccaccataccctgctaattttgtatttttagtagaaatggggtttctccatgttggtcaggctggtcttgaactcctgacctcaggtgatccgcctgccttggcctcccacagtggtctttttttaataaggtgaaaaaaaaatttttgccaaggtcatgtgccatgcttttctatccactgcccaggaaatcaaaaggtactccctccatgagcttcccgcagtgaggactcatctgtaacctcataatgttaccacctctaaggcaaagcggaaaatgtctgttctccaggttctccttgtctttttacccttttagaatcagtaaacaaatgattgaaagctaagtttccgaatcttaacagaaataaaagttcttccaatactggctataaacatgttcttttccaatatattggggctagtgaaagaaaatacccagtggactagaaataaaaaaaaaaaaaaatccccttcccaactcccctgaaccacacaccggatcccttgctccactctcacctgctttgagttcagagggaagatgccaggaaaaaggagcttagagattaaccagcatatacagcctcagataaagtaacaggactgggatgttttttatttattttttattactattatccaaactcttctgtatacaaaggtacaaattctagtaaaggctgcaacattattccattggtgctgattctactaaaagcacttggatgatagttattctggcattaattttgcatgcaacaaggcaatgcaattgaatataagtatcgggggaagtgtttgtagatgattttctagagctggttcaaaggaaggggtgtgttatttgttttccctaatatattgttaatgagaaagaaaagggaacgtgttagcaataaagggaaattcaagggctgaaaatttatctaaatcagtggctgccaaagtgtggctcttgattggtatccttagcatcacttgggaccttacagaaatgcaaattctccaccccactccagacctcagaatttctaaatgttcccagtgcttggactaatgtccaattccattttcactttcttttactcatgtaaaaatagctactagcacctttggattttttttgtagtcatcattttggggtacttgtgtgaatgggtcttgtcctcttcattctaaattatacggtttcacattaatacaaaatcacccagtcctgccttaggctgctcagtgtgaactaggtcagttcagcaactcagtgatctggttttcccatagctggtaggagaaaaaggaaaattactaatgcaatttccccccaagaagcagcttgtttctcatctttaattaattgttcctttcttccggaaactctattatgagttaaaccatgagtccctgagcctctgtgagacaaaagaagctattttttctatccctggacttctgtgatctcctgggggaaggggaggttaggtttggcagacggaagcgtgagaggggctgggtagacaagaggatggtgggtagcagtgaagtccagagcagatcgggggagggtgaccatgaggagcacccttgggggaaacagagctgggtgcccccgtaagaggaggcctgtctgactctgttcaagacatattttgtcacatgaaatcattttgggcagaaaccgatgaagagaaacatacaagtgacgtcaccaaggacagaaagctccctgagctttgccagagccgtagtcacccacacaggggcctctggtgactgttgaggggaccccaagggacagccagggtcttgtcagaacacgctctacctcagcagctcccccaaccccatctaccctccacatatttcccaagggatcatgactccctaagagtcctgacacttaaatagtgcttttccatttacaaagtccactcacgatgtccttgcttcatttatggcacataacaagcttgttgtgagtgtggtggggggaatgttggcccctctcctgaaagaagagaatggaggctcagagaaacttaaagtctcagtcaagatcacctggctgggagagtggggtgtcgtaccaaacccctattgacattagtaggatggcaccagattcaagaggctgaagagacccagagccagcagaagagacatagggttttattagtgggaacttgcacacagggcggtcccggggctgcgggctagataggaggactgccactgcttgtgaaaagcatgcagtttgtatagcgttttcacttagcaccctccttaacaacccacacctggcaaccttcatttcactaaaaacaaagggcctccatcctctgtatggcctgagttccacaggataggtaggggctcagatgttcctcacagataaaaataaaataagtacaggggccacgcccagattccttagctcagaactgggaacacacagtcaggtgcttctgccatgcagggtcattctcagggtgtgcttaagtgaatttactggtgtcaggtgcatctgccacggacacgtggtggggggagaggggtgtcccaggaccatgccccagtctcctctctcaggtgagagtgctctcctgtgcacagcctgcctccctgggaagcagcacttaaaaggacccagagtgactcagagactgcagaggcttaatgcccgcaaaacaggagcaggtgtgctagatttctttactctgaggtaccctcggccccttccagcatctattaacaccatgggctacaaggtacccacgcttgccagccaccctggctggatgcatgtggctatgtgtgtgtgtgcatgagccaggagcaccaccatgcacgcacccttatttctggcctgctggcctcaggaaaatcctttctcccagccttgggctatgttgaccagcctgcatgacaacttcatcttctttaccttcccaggctgtccacagttctggattctggtaaacccttcactatgttatttggtaatctcagaggtaggtggtgtttcactcagtaactagttattggagaaactgtttcacacgattctagcattccataattccacagcctctttatatgcagagagagagagattgtcatatgacttaggtacctgtggaaaattctgtgtactgttcccccttcacaaagaacattagcttgttaaaggctctgagaattcctacagtcaagaaacctattgaactttatttgcccagcttcccccaaatgcatttgattacaaactgctttttcatgggagacctatatactcacaggacattttggggatgggatcctacatcctgcccttctctccctccgttgagtttgaagcatgttcacatgtgcagccttcagaggactgctgctctgattcttggttatccctggcccagcatcctaggtgtaggagctaccctgtccctgaagcctggttacttctcatgagttcctctcaattgcaaaaaggacagcatagctcccaccttctgttctgaagcccaaagcccactcagactgcccaccaggcccccactttcctgtctgatgggtggttttgttttcttaattataggacagagaagactgtggtgttctgcacttggggaatggtcgtggggcaggacttcagccccacctgttactcccggcttccccggtgaaggacaagtcaggcttcccctgcaagcagtttcccacttgttagaggttcacaataacagaaacccagccaggttccagggacattaacgtggagacttataggaaatgactgaaatgcagacctgggcttgggagggaagtcagggtcagagctggagagctgaactcaggagggaggatgggagggaaggcagagctccttgaaggtcgaagggagaagtagaacatgagagccttgaattatgaggaccaaactctgaagacaatctgagagttcatttggcatcctccacctgaaaaaaaccctcatgctattctcattagacttattgagtacaacttggaaagagctggcatgggcactataaataccgagagatttcacaggaaaaacaaaaaaaaccaaggaggcaaataccaaagttaccatttttaaattttataaaaggtacaaagaaaaaaagtaatgaaacaaatgaaactcctcaaagagtaacattttgtacaatgtgtttctgtataatacctttgggaagcagagaaaaggagaacagatgtgagatcacttctatacaataattgcaataaaaaatttggatatcttttataaatgacaactcatcattaagctgaggatgactttcagttcaccatccacagctaccatctaaagtctgcaaactatctccaaccacacaatactcacttccaagcactgtgggttttggagctctccatctccaaggaaataattctgattccagtagagatgtcctataggagcaggtcaagcatatgagagagagcaaatgcaattagttgtcaaaaataattagactataacaagaaagctagagatcaaaaccattttcactatcaggtcaaaatgttttgaaagatggagcagaggaaatgagaggagaaatcacaatcttagtgatgttaaacaatgatctactgtgtaaaaaagatgttctttctctgcactgaacaagctgcccctaaactcccccttccaggcttggcaaaagatgatttgtgaggcagtagcaccaagcctaatgcgctcattgtcacaaaaaacctgagattgcattctatttctcctaaattagtcacctcatgagattggttccaggtaaaaatcaagtgtctcttgctatctttggctcttcttacaggagagtctgtctccagcagtttctaaaatttagcacttgcattgtaacatcaacaaagataacagaaggtcaggctgggtatgtgcacagtatgccccagtgggagcccgcgtgtgtgtctgtggcccacagagattaccgctcttggagccaggccttggtttgatggtctttcttggtgaggttttctcttatccagaggacacgtgaagacaaaaatccaaacaaagtgttagcaatgaaaggctcagcaccttccctgtttttctgtggtcatcttgttttaaaatgtacccaggacttgtttaaatcagatgtggtaaaacacagagacatggaaatgactgttatggaggcagaagtttctactcacagagccctagaaacaggaagcctgcccaccatgcagagagccacacaggaaagcaccagcattgggcaggaagcagaagcagcgagaggaaagctcaggcaaaaagctctattgtggctatcgcaagagggaatgaggcaaggtaagtatcccgtgagtggctagtgtgaataatttcagcaggctccaagcagcactatcccctcatctcacctgtgcaggaagccttcccacagcaccaccttatcacattgcttaagcaccatggttaggaaccggagttaaaaagacacctgcatgtcagaatcaccccggcttacccattaaaaatatagttccttggtttcatccagacccacagaatcaagtttttccaaggtggagctgagacgttatgtgacggttaattttgtgtgtccactgggccacaaggtgcccagatatttggttaaacgtgattctgggtgtgtctgtgagggtgtttctggatgcaattaacactggaattgataaactgggtaaagcagattgacctccccagtgtgggtgggcctcatccaatctgtcaatacgctctgtaatcttatcaagtgcttggaatctgcggacacaaatccaggtgtgcattctccatttctctgtccgttcccacccatgaagacttctctgcttcagcccacacatagttctttctcttaaatgcttggtgtactagtgatcagaactacacattttgcaatctcctgatcactacagctttatatgaagtcataaaatcaggtattgtaaatcctatgactgtgttcttttcaatcaaaattttaatcaaaattgttttgggtattctgggtacagatctattctagatcctttgcatttccctacaaattttagaattagctgtcaatttctgcagaactccctcaggggttttgattggaaatgtgttgagtgtatagatcaatttgtggagaagtggcattgtgataacattgagtctttccgtctctaagcatagtataggtctctgtttatttaggtcttcattaatctctgtaagctatgttttacattttttcattgtgcaagtcttacacatattttgctaaatttacccctacatatttaatattttcatgacattataaatgatattgttaaatttctaattactcactgattgtatagaaaaatgatgatttttgtatgctggccttacaccctgcatccttgccaaactcatgtgttaggtctaacagttttttgtaaatttcttaggatttctttagacaaccatgtcatccacaaataaatcgttttatttcttcctttctgatctgtatgccttttgtatcttttctaatcttattagatgggctaggaacgatagtataatattaaatagatatagtgagagtagacatccttactttgttcccaatcttgagggcattatggtcagcctttccccatttagtttaatgttaactataggtatctttgtcagtgccctttacctaggtgagattatttccttctattccttgttttttgtttggtttttatgaatcagtgttgaacattatctaatgctttttatgcatctgttgagatgattatacttttttaattttttgtctgtttaatgtgatggcttacactgactgatttttgtatgttatacaaatattgcatttccgggataaaccccactgggtcatggtggtccattttgtacattgctggattcaatttggtaatatttttaaaggatttttgcaccttttttcaaaaaaatggttcttgaatacttttctaatatttgcattatgatattttgattcttacaaaaatcttttgaagataatatgtcagtgcatcctaggcctctgatatccctgtcagtcaggcacttatgctgactgactgacttatctatttttggctattacttgttttgttgattgattgagacagagtctcactctgtcgcccaacctggagtgcagcgttgtgatcttggttcactgcaatctccacctcccgagttcaagcaattctcatgcctcagcctcccaagtagctggaactagagacgggcaccaccatgcccagctactttttgtatttttagtagagatggggttttaccaggttggccaggctggtctctaactcctgagctcaagtgatccacctacctcggcctcccaaagtgctgggattacaggtgtgagccactgtgaatggccacttgttgttctaataaatctcttaccgctttggagctgaagaaatgaactctcacccaaattaagcaacttgcccacagtttcagcatcagttaatgatagagctcagagtctcacagtccctgcactgccagtggtgaaggttgccaagaggcatggcaaaggcatgacagactcttctgcagtagtgagggtgggccgcacgtggtgtggtcctggccaaggcgaagtgtgtgctattagcgtcctgcccatcctctgctccctatcgctttctgatagatgatgatagaaggatttctgctgtaaaagatactcataattttaccttgaatagtcttcctgggaagtgttcaaagagctgttgatgcttcaagactcgttctctccctggaaagagaaaacaaagaggcccaatacctcccgttcttttaggggagaagtagtactttcatttacattgtggccccaagagataccaaaatgggtgctcaataaatgttgctgaccaaatgactttttccagaaaaatgtaagtgcttgtacctagaatgcaagattagctgctttcaagaaatgagcctggtaactacaaaatgcagtgtgcttgttgtgggttctgaatttattgtaatgtgcctttcctcttcatcccctctgcctcctgccctttctctcttcacactggcctggaaacctgctcttcccataaaatgagatagtggggaaggaacatattttgtgttaatatccatgccagcatgaaaggaaagagtgtcctggttgagtgaggcctgagtcacgcagggtgggctctgtccccaccatgggcctgcaagtgtggaagttaaagatgttaccatgttagggtgccatttccaaaggaatcttatgatgtagcctcagcaggaatggctccactcatgatggcaacaaaacacagaacatatttagcaataagcctcaggttacatgcatgagatcttaaagaaatctaaaaaacattagcaagagacataaatgaagaagggcactatataagccctgaatatggaaaagagacataaacgaagaagggcactctataagactgagagaactgttgataaaatgccaattgttcttctcattactttatagattgggaacaatcccattcaaagtaaagaaggacttggcatctgccaaaaatcttatttttgactccctacaaaaatagattgatcaggctttggcttcagctgtctgacccttaacaaattacttgacctctctaagcatcacttcctcatctgtacagtgaggacagcaataatccctaccttatagaatagtggcaaagattaaatggcagagtgcaaatgaagagcctggcacagtgcctaacacaaggtcagcactcattacatattagctgttatgattattaactaattttaaacaaaaaatattcctttaaagaacatcagagaaaactagctcgaccagatatttaagtatgatttaaaacaatgagtaaaagcaacaggctactgacaaaagaaaatggacatgtgaataaataaagagaataggaagtataggagacttactcttattgtgaaaacttaattatgtgataaaggaaccatcacaaaataatgaagaaaagaaggattatttaaatgttctcaggaatgataattaggctattttgaaagaaataatctaacccttcatatcatatactgaaaataaattccatatgtgtattaaacagttaaacattttttataaaacaaaaatcagcagaaaacaaaactaagttattatcaaatctctgggttaacttaaagctattaagtgatcaaagaaagtacaaaagtaaagatcaacagaaccaactacataaaagtgtaatagtttgatgggataactaagaaaatagaaaaaaatatttttattaaaaatgtaatgaatatttacataatatgaagaaattatgatttatgaagaaattgttgagattcattattgagaaatgatacaatccacacagaaaagatattgtagcaggacgagccacagacaaaactcctcagacactgaggtaaagaaggaaggggtttactcagccgggagcatgggcaagactcctgtctcaagagctgagctccccaagtgagcaattcctgtcccttttaaggtctcacaactctaaggggggtccacgtgagagggtcatgatcaattgagcaagcagggggtatgtaactgggctgcatgcaccggtaatcagaatgaaacagaacaagacagggatttttacaatgcttttccatacaatgtctggaatctatagataacataaccggttaagtcaggggttgatctttaactaccaggcccagggcatggcaccgggctgtctgcctgtggatttcattcctgccttttactttttacttcttctttctttggaggtagaaattgggcataagacaatatgaggggtgatctcctcccttaatataagtagcaaaatacatatgaaaaaatgttctgcatcccactccacacaaccaaaaattcatacgagggaggaaccaaattgtatgtattaccatgaactattacacagccataaaaagaacaaaataatgtcctttgcaacaacatggttgcagctggaggccattatcctaagtgaactaatgcagaaacagaaaaccaaataccacatgttctcacttataagtgggaagtaaacatggggtactcatggacataaagatggcaacaataaacactggggactatcagagggggcagggggaaggggcaagttttgaaaaactaactattgggtactatgcttagtacctgggcgacgggatcattcataccccaaacctcagcatcatacaatatacccaagtaacaaaccttcacatgtatcccctgaatctaaaataaaagttggaagaaaaataaaaataaaaggaagaaaggttaaaaagaaaacccagatgcattatgttaaaaaattaaataatagattagccaaatatagaaaatcttatgaaacccaatgttgatgagactggtaaaacttgtgtattcatatattgctaggtgttattgcaatttgaagcagaattttgacaattcgtcaatacatattaaaagccattaaaatcttcaagcctttcaactctgaaatgccatctgagtaatatattccaaaagaaaagaatgctttaccaaagcacgatctatacttgtgaagcaactggataaatgtaagtgtataaggaaataattaactaacttatatatgtaattaatattgtcatttacaaagacaattatgaatatgcttgcataacattaaatttttgtatgatatatcatttggtacaaaagcagaattacaaaataagaatgatatattgtataggaataattggggtaaatttttttctattttatattatggctattaatgttatcttgccaaaacaattgaaaaattaaaagtttcatagctaataaatgtatcttttaacattaggcattataggtatctcaaaaatatgaaaatatccgctcatttattttttatcttttagttaaattacaaaatggaagagatttccccctagaattaacatctattttaccatgatgttaaactagtaaatcttctcaagaatgaagactgaagtgaatgccagtcttcccctcaggccaactggaataccctctcttcctcagatctggggaacctttactaaaatgagtactgaccttttcacttccctgagatatctatcatgcctaatgccagaagagccttgtatttagtagctataaaacttgtaatttttcctctgtatggacaagataacattattattctggcccttaatgccctggaagaatccactgttcagctctgggttcccacaatccttgcaacatcccagaggttgtctctgatcagttacactggacccagagaagtccgttcctctctggaatccacttcaacaaagggatactccggaggctcaagaatattgagaatgtggactggattcaaaatctactggcaagtttgtgattttcatcttggtcaggagctgaaacatccaacgttctgaagtcatgatatttctaatttacgcatgagcaaggatagaatttttgcaaagtcaaaaacaataatggtagtaagaagcattcagatttcctgacaaatctcatgtaagtccatatcaacaagtcttctttctgcccaacaaatctcagaaaaatgatgtgctaaatataccatgtgtagaaacaggcttgtttttatctatggccactgtgattgaactgtgattatgtttccttttttgcttcagttgctaggaggctcagtcaattttgcagcccacttctactcttgtataggacttaatgttaggtagctctcagtcccattttgtgctgctataacagaataccacagactgggtaatttataaataacagaaatgtatttctcacagttatgaagactggggagtccaagatcaaggtgttggcatctggtgtgggccttcttgctgcatcctcacatggcagaagggcaagaaaggaatgaacgttgtgtcctcacagaggaacaggagagaaagaacccattcccacaagccgtttttataacagcattaatccatagatgaaggcagagctctcatgaccaactaccttccaaaaggccccacctccaacactgctgtgctggaagtcaagttgccaacacacaaattttgggggacacattcagaccatagcagtagttatcttagtgtttttgcctcactcttagctttatctcttttcattattttccctttgtttccatttcctcaactgtttatcttctatcctcttacagataattttataagctgattccaacccatttttgaaagaaagcacacagattaatcagatgttggattatgcttgttgccagagtgcctctgattgcatttcttttgacattagacaacccgaagaggtgcacctggagacaggtacctgggccaccctggctgtgtttggcatgctccctgatatgccctgctctaagaaacctaactgtgggatcaaagccatcgctgatttgagccctaataatttcaccccccacaaaaattaattaatttgatctctttaaaaaagtaggatattggccgggcacggtggcttaggcctgtaatcccagcactttgggaggccaaggtgggtggatcacaaggtcaggagatcgacaccatcctggctaacacagtgaaaccccgtctctactaaagatacaaaaaattagccgggtatggttgtgggcacctgtagtcccagctactccagaggctgaggcaggagaatggcgtgaaccgggtaggcagaggttgcagtgagccaagattgcaccattgcactcaagcctgggtgacaaacaaataatttcagctattcaaaaaaaaaaggtaggatattaacattttttaaatgccaactttatgcactggttttggatttagacctataaattttaacaaaggtatacacctgtggatcaatcacccccattcaggatatagcaattttcagcatcactccaaaagttcccttaagttcctttccagtcaatcctttgcccccataccctaccccatcaccacttatctgatctctgtcaccataaattagctttttagagtttcatacaaataaaagcatatatattgtctacattagaagttggattattggtactgttgagtagtagtccactgtatggatgctctacattttgtttaaatattcatctgttaatggacatttgtgctgtttccaatctggggcatgtatgaataaagctactataaacatttgcatgaaaatctttcttgcaggcctatattttcatttattttggccaaatatacaggactgaaattgctgggtcatatggtaagcatatgtttaatttcattaagaaactgccagacttttccataatgataataccattttacacatccttcagcaacgtatgagttccagtaatttcaaatccttgctaatgctttatattgtcagcttatttttcaatgttagccattctagacagagtatcatagcatttcattatatatttaatttgtatttccctgatgactaataactttgagcatcttttcatgtgcttactgaccttttgtatatcttcctttgtgaaatgcttgttcaaagctttgcccattttttcagtgagttttcatcatcttcttgagtcttctgaatgtaagccttttattattttagatagatttagattcacaaaatattcacaaatatatttgataaatacatatatttaaatatttgtgaatacaaataatttcatttatataatatgaaatataaatatatttaatatttatatatttatatttataaatatatatttaatatttatatatttttatttataaatatatatttatatattttatattgatatgtaaaatatatttatatatttataattttatattaatatgtgaaataaatatacatttatatataatttatattataaataaagaatattttctcccagtttgtggcttgccttttcattttttaaaataatttattctgaagagtagaagcctttagttttgaataagcccaatacttcaattttttgttagtggtgtagcttttttgtcctaagaattcttcatctaccccaaggtcacaaagattttcttcttttatgttttcctcagaagtttcacaatgttagtttttatgtttaggtctgtgatccattttgaatttttgcatatggtacaacataagattctaggttcatttctttccaaatggatatcaacatcatctgctaaaaagactgtcctttccccatctaattagtttttattgaaaatcaaatgaatgcacatgtgcggatctatttctggctatttattctgttttcctgatggttatggctatcattatgccaatactaacctgtcttgattaatgtcttgttaggcaggtagtataaaatctcccaatttgttctttttcaaaataatttcagctattcaaggtaattttgcattttcctatgaattttagaatcaacttgtgaatttctatttttttaaatacctgtaagaattttgatttgaattgtattgactctgctgatcaattttgggagaattgatgtcttaacaatattgacatttctaatccatttgtgtaaatgtcctttaatttctctcaacattgttttgttcttttctatatagagggtttataggctttgttaaatgtatacctaattatttcatctctttggatactattataaataaatggtgttattttaaaaatgtcatactactggttggtgcaaaagttattgtggtttttgccattgcttttgtaccaacctgatacaattgtttgctgctgctagaatataaaaatacacttaatttttgcatattgaccctgtattgagcaaccctgctgaactcaatttttatttctagtagctttttttgtagattctttaggatatcctacatacacagtcatgacatctacaaataaggacagttttacttcctgactcttcaatttgtatggcttttttttacctgattgcaccaggtagaatccagtataatattgcactagagttgtgagttgcctttctcttgacattaggttaaagtgttatctttcaccattaaatatgtagtgagatgcaggatttttgtagatgctctttgtgtaagtttaacttgacttatatgtagctctgtgcttatttctgaagacatatggagccatgaaactgacccttggccactataggaatgagatattttggctagtgatttataatgtgctatttaaagttcaaaactcccctagaaacaccctccatcggcttgtctgcatttttattgaaaatgtatagcctgatggctggaacctagtgtactgagtacacaatctggtttggctatatgaccgtagaaaaatgagactggcttcggatttttatggtagtgatggggttggtcagggtgagggttcctgtgcaaggtgaggaaagggtcttacacggtttgaactttccgccaatgacaaaggagacagcacttgggctaccaacttgtccagatgtggggcacaaagggaagagcaaggggtgaggcctaaaagctttcagcagccaaacatctaaaaatggtgccagactttttataatgaggggtggtcatattttctacacggtcaaacttagtaacataaaaatattcataatatccctgtattgtccttttgatgcctgtggagtgtttgtgatgtttcctctttcattcttcatgttgtcaatttgtgttttcatttttgcttgatttgctgagctacaggtttatctgttttattgagcctttcgaagaaccaggctttggttttattaattttatctattgctatccattttatatttcatcaattttcactgtctctcccattcttcacttttccttatatttatttgtatgttttgcttcttaaggaggatgcacagatcattcactttagacctttcttatttctaaatgtaggcatttaaagctaacactttcgccctaaagcattgctttagctgaaccccacaaattttgttatgttgtattttcattataattcacttgaaaatattttctaatttctcttatgacttgtttgacccatggcttgttcaggaaagtattatttaattcccaaatcttggagatttcctagatttttcttggttaatgatttttcactttgttgtggtcaaagaatatactctgcataatttcaatccttttaacttattgagacatgatttatgaccagcatatggcctacggtagtgaatgatccatttacatttgaaaaaaatgagtatcccattgtagctgggtggagggctctataactgggggcagctttagatggagtagtcaggaagggcttctctgggaaaatgacagtcaaaatttatcagtggcaaaaaggagccaacctggcaaagattgtggaaggagcaggctggacagagggaacggctcgggcagagaccctgagagaggggaggaggtggctgggtgagaaacttccagcaggccctgtaattgctgtcattagaggacaataacctcctcacaacttatgcttaggttttggggagctgctgttctacctggcctaattcctcatatctacaatcctcctttctccccagccctaccagaggcagtagggactgaagggctgggcgactggtcacccatgtgatgggcctggctctggcctttgccccaggtatgatttccaggaagctgccttattcccaagacccaccagaataaataatatttctaaaacaataatagcagttgtcataggtcatacagtgccaaacacacacatagcacatttcatttcatccttgtaactaactaccttgtggataagtatcattatccttttcgcctgtgaggaaagtgaggctaggggaggctgggaaattcacacaagttcacacggctttgaagtggctgagtgggggtttaaacccagatttgtctcacattgaagcctatgctcataaccattaggcaacaccgccttgactataccaccattgatccctgaattgccatcttagttcctatcttgatgctgccaagtttctcagcgtattgaacactgggacctgccttgttcctgccaactctcctgcctcaggcaccaccccatggccagaaccctgctctatgctgacaccctaaaccccactggcctggcctgcgccaggataccctatagtcacatcaggggctgcgtccgctttgctgtactggtgcgattccagtttctgcctgctggcctcggcgtccccccaggcctccctgaccagggaatggatccagttccaggtctcagcctcttattggcagcttcactcctctgtgattcaatagactggccccaggatctggcagaatttatgctgcccaccagcttccacattcttctggtgtttcatgtagttttcactcctgaggtttttggggactccccctgcccttcgcaccctgaacaacatctccagccataggctggagaaaccataggatggagaaaccccatcactgaaacatttttacactgttacatccaatatatgtatgtttagttatacaccaatcatagacatgcactattataccagtatagtagatatatgataaagcacagcattacacagcgagataaatgcaactctctaatgcatacagacatatttgtgtgtgtatagaatatacacaaagcaatatttttttacaggaatttgcatgtggtgcagatgagaggtacatccctcctctgcagaccccttaaccacaggatccagacaagcccctcagggcagctccctggctgtccatcctggaccccctctctcctaaagctgagcctccttctccaccccagcccagacctctccctcttccaggcagctcaccctccactctcctccatcccaacaccggttggggagtcagaacagcctgggattaactttggacggctgcctcccagctgtgtgactatgaacagtgtatggcgcctctccaggcttcagttctcttctgtaacttgggatcatagcaccaacttttcagggtggttgtgaggacagaaagaggaaacacctagaagggagcctggcccaaaaagggtggtcaacgaatggtggccatcactgttatcttgccagatgagttcacttctgcctccagccctgctgcatactgatccttccttccctgctgcgggccccttacctttcctccccaccactcccaatcctccaggctggtgcttcaggacccggttaaagtgctaacttttctaaccactccagcccactgaactactccccagattctccctatgccgggatcccctgaccggctgcccttaggcccaggaagccacagattgctgattaaccctttctgtctactgtcactgccccagctgcttataggctcctaaagggcagaggccacagagctccagtgtctttggtacccaccacagacagtgctcaggcaaagctgctgaagtggatcagtgccgtcaatcacagggatctgaggtcttccaaaaccctccaccccgttacattttaccaccccttgtccatttgctgaaatcacaaggctgggtctgtgggcctgtgaaatccctcaggcccctgtagaagaggccactccaaccagacactccagcaggttctgctgagcacagatcagcatctaatcacgtttccatcacaacacggtgagaaacgtgtgactggcccttagcaacggtctctcaagaaagctacccctatagagagctcattaagttcgctgcacacacgtgaggcaaaatctaaaaacagacctgtgctttctgaagcctcctgcagcacgtggcagaagctggaaagggcaaggacagagatttgctctaaataagggcagggaaagagaaagcccctgagcgggtccagatcccagagaaagatggcactggactcccttgctggggtgagcatctgcagagtggagagccctaaggtgaggccaggccagccacccccaccccatcctaccccaccccagccacaagctgctcccaggccccggtgctggggagctctccttcaccccagtaagcccctgtgtcgtttggaacccaggaaagagcatcacctggaattggccgtgatgagagtttgaaatagtaagataagaacttaacatttaaaacttaaaattcatttcaatccagcaaacctcaggaacttaccatgttgcaaaccactttcctgggtgacccagtcctcactgttaagaagtttacaagaacatgtaagacttacaactcatacccacaattcaggatgacacacagtgaatgctgtaatggagaagcaggcaatgcattctgaaggcagagagaaaggaaaaccaccaccaaacagggaatcagggaaggctgcatggaagaaacggcacctgcccggggccttggctcctaactcctggtacctgaaagttgtcttcttcagtgttcagttgcatgcagctagcgctggttaagtagttaattaagaaggtgtcttgagaacttggttaccacctgttccctggtttgctgagggaaagttgcggcttctgctaagttttaaacatagcggaaaccacttacaaattaatgatggaattaggctggggtgcaggctcacacctgttattccaacactgtgggaggtcaaggtggaaggatcacttgagcctagaagttggaggccagcctgggcaacacagcaagaccctgtgtctacgaaagaaaaaaaaaaattagccaggtgtggtggtggcctgggtctacagtcccagctactcaggaggctgaggcatgaggtccgttggagcccaggagttcaaggttacaatgattgcaccactgcactccagcctgggcagcagactgaggccctgtctctaaaaaataaaagttaactattaatggtggaattaaaatagaatgtattggtcctcaaaatatggtccccaaacctgcagcatcagtatcacctgagaacactgtagaaatgcatattcttaggccttacaccagacttactgaatagaaacttggggagtggagctcagcaatctcagttttatccagccctctggtgattctgatgcatgctcaagtttgaacagctctcatgtaattacttgaagctaagatgagaaatgattgatttctgtgccaaaaacaaacaaacaaaaaaaccaaacttgtagaaactgcccagcttgactgcctccctcaaaagagtatttgttgtccaggcacagtggctcacacctgtaatcccagcactttgggaggccgaggtgggtggattgcttgagcccaggagtttgagaccagcctgggcaacatggtgaaacgttgtctttagggagccaactggaaggtggctagagggactgggagcacagacaccaaggaccctgcagccttactccctgtgctggtcttctcccttccttatggagaccatggtggtaccatgggctctccttagctcactgtggtggaaaagtaggaaagccaactggggcagcataggctgcggagttagcttctgcttttaaaatggttttgaaatgcaaggcagtcccagccaccttcatggaatgctatccttgatgcaaaatcagcacaaggggtaaacactgatccttttctgtggagtacacacacaaaagacagtctttctgcattaaagggatagcaaacctggaaggtgaagcaaaaaggatgtgcgttccactctgacgtgtgtttgaaaagaatgaagaagagccggcgagggagtcagcgtcttcacctaaaggtcttggcaggccactggacaacagtaaatgggtctgaaaaataacatcatatacagctggagagggaatgtccaggagagcccagagtttgaaatacaggctatcagacatgcgggcactggagcctgggtcagaagtgtctgggtccacacaggctgcagctggcaaaggggtggcatgaagagggggagcctctgtgtagtgttagctgggagagtcctgcgccatcctcagagtcaccaggagactccattcccaggaggcagacactgaaacgtctttctcttagcaaggaggcagctgtcacaccttcttctgagagagccacactcaaagctggaacactatggactgtgcttctctttcagacccatgggtccggtaaaagttggcaacaaaggagttgctgagacctggatatggggatgatgaaaacatgctttgtgaactgcaatgcactatacaaatgttgggggttttttaaaggaaattagcatcaacatgaactacagtgtgagcaggcatctacggttcccaggctcttagtagctagagctggttgcctcactctgactctcctcactgaaaattaaccagttcatttatttcttcctttactcggtgcattggagtcacacttactgagcacctactatgtgctaggcactgggcctactaaaatgaagaaatggatgataccctcaagaaattcacagcttggtaaaaatgttccaaaggtaccagtcatgccaaatgcatggaaaagggtatgaaaggaaacaaaccagaagtggctttctctggggaggagggaaggagggggtactattgacttctttaccaataaaagactcagctatagcacccgtgtgtacccctgggtttcaatagatgactccgatgtgagtgggtgttttacatgcaaccagatgaaaatggctttgatttttgattttggaataaactgctttttcgattagtcagaagttctatgaaatgttcccagctggctcctgggtaaatgtcccaagcctgcagactacatgagctccagacaacatttaattatttcctatttcacactgcccatgcagagaatgaattttgcttcacgtgcacggagctacttgggctcattttcctgctgttttcaacttcccattgacccaaatccctctctggccctagggattgagactttgtgttccagttacataaattctaggcctcagaatagccacgcatgctggcagctctttaccctgtcgcctgggccctcacatcctgccgtggtatcctttcagatgaccacagctctcttccgccctcctgggtgggcagggccagaagggccaggaaatagccccaaatgggaggactaaaccccctagccaagcaccctgaccacagtgcccactcctcattacaggacacaggggaagaaggcttcctaagtgtcctccaagaagttttaaacatagcaaaaaccagttacaaattaatggtggaattaggctggggtgcaggctcacacctgttattccaacactgcgggaggtcgaggtggaaggatcacttgagcctagaagttggaggtcagcttgtgcaacacagcaagactctgtgtctaaaaaagaaaaaaaaattaggtgtggtggtggcctgggtctacagtcccagctactcaggaggctgaggcatgaggtccgtttgagcccaggagttcaaggttacaatgattgcaccactgcactccagcctgggcagcagaccgaggccctgtctcaaaaaaataaaataaaaaataaccattaatggtggaattaaaatagaatatattggttctcaaaatatgtccccaaacctgcagcatcagtatcacttgagaacaccgtagaaatgcacattcttaggccttacaccagacttactgaatcagaaactcggggagtggagctcagcaatctcagttttatcaagctctctggtgattctgatgcatgctaaagtttgaacaactctcgtgtaattacttgaagctaagatgagaaatgattgatttctgttggaaaaaaaaaaaaacttgtagaaactgcccagattgactgcctccctcagaggagtgtctgttggctatgcacaatggctcacacctgtaatcccagcactttgggaggccgaggtgggtggatcacttgagcccaggagtttgagaccagcctgagcaacatggtgaaaccctgtctctacaaaacattttaaaaattagccaggcatggtggcacatgcctgtagtcccagctatttgggaggctgaggcgggaggatcacttgagcccaggaggctgcagtgagctgtgattatgccactgcactccagctgggtgacagagatcctgtctaaaaaaaaaaaaaaaacaaaatacccaaagtatttgtaagtggcgattcctcagactttaaattctacacatgaactaagttttttgaggacatgagaaaaaaattgcattcctttgctagggacacacacacacacacacacaaagacaaaaacacacacacacacacaaagactgggcggcttaaacaaaaatgtattttctcactcttccggaggccagaagtccaacatcaatttcctcttcagggttggtgtcttctgaggtttctccttggcttgcagagggcgccctcttgtggcctctgcatgcggtcatccctctctgcaagaggccctaatagctccttgcaggttcaatttcctcttcttataagaacagcaggcagattggattagggctcaccctaatggtctctttaaaattaatcgcctctttagaaatccagtctctaaatacagtcacattctaaggtgttatgggttagggcttcaacatgagttttggggaagcacactgccacccatacaaggagtcttctcaaaatggacggtgtgtcagcatccaccagtcctctctgaaaccctttccttcggtgtgtgggaccaaggtgaggcacactggaccctctctttacttcccctcagctccctcataacctcacaccgctctccaagaggcagctgattctgtggacccaactgcctctccgaagagcagctgcgcccttggtaaaggagaaagtagaaaaggaaaaggagaagctcaggtgagagcattcatgagaccagcagggagaaggggcagcagagagggggccgcctgcctctgtctctgcgcgcggtgtcagagccccggcaccgggaagtggtcgactggggggttggtaaaaagaatttaccgacaacagtacagctttgaaaaaggaacgtttattagaaaggaagaacgctacaaaagggtgcagtggggcacctcagcgagaggactgagcgcaccctggtggattttccttaccagcatttatgaaccttttaaggtgggagttgagggttgtaaaatgagtttcagcacggcattccggagatgtatagaaattttagctgcttataaaagttgaaagaggattggaacctctgaaagtttaaagatgccaactttacttattttatttatttttttgagacggagtttcgctctgtcgcccaggctggagtgcagtggcgagatctcagctcactgcaacctctgcctcccgggttcaagcgattctcctgccgcagcctcccaagtagctgggatcacaggcgcgtgccaccatgcccagctaatttttgtatttttagcaaatacggggtttcaccatgctggccaggctggtctcgaacccctgacctcaagtgatccgctcgcctcggcctcccaaaatgctgggattacaggcgtgagccactgcacctcagcttaaaggtgacaactttagatactagagaagtttgattacttctaaattccccagataaggagttttgcctccagatggcctgtttggtggtcaccaggtggtctttgctcctttctgaattgttcagataattagtttttatctccggggcctgctcagtggtcaccaggtgattttcgctctcctcagtctccagaattgagacaggcagggaaccatcttaggggcctgctgggctcccccaaccactgtcccctgcccagcatggaaaaattttgagtcccttcaagggaaattccaggcacccaactagccctacggccagcaattagagaattgaataaataaccccctaagtgagaagatcataataacttttgcaatagccacccaaataagtcagagtcacaagatgtttgtttccctacagaaactaaagataacatcttgacatatgtccttgagttgtttttaagaaaccaggactcccacctgatggaaaatgccagctgtcttcacagtgatctcagacagactgaagccaagaagtagattttaaaagttccagaaattctctcactttggagacgatccccaacacaccacaccctgccacctttaaaaacccctgcttggaagccatcagggagtttgggtcttaagcgttagctgctcattctccttggctctgctcagtgcaataaatgtctcactttctctcactgcaaatcctggtgtcagtatttggctttttctgtgcattaggcaagcagacacaagtttggtttggtaacagaactagagttgaagtaacctctcaaccccacccaatttaaaaggctaagcagggtgcaagtttggagccaaatcaaggctaaaccacttgggagctgtgtggttatggatcagccacttaccttcttcatgcttctgttcattcatttgttctacaaaataagcataggctttcagacaccaccctagatcttaattacatgtaggtaaaatgggaataataaacccaattttctgagttgttaggaacattcgacataaacacctaggacaatgtctaacctattagtgattggttggggacttggtctgtgtttgtccacttctgtgtcacttcagtacaagggagagtaactgggactcaatcgatatttgagaaaggaaagagagacagaggtgagaggagactaggagggagaggagataaagaggtgagtgtgggggactgaatggtcggtgtcattactgctaccacttgggatcgcctggaccctgggcagtccgagaacatggtcactttggtaccaaccctgaaccacatcacttcctttcttccccagcagggcttctaggaacagaagactttgttctccgagagattccagattagattccaggttttttttttaactttatgtatacacatttaattagaataggcataaaccaaaaagaagaaaaaaatcaggataaagggtcactatcattttgtttgcaaggaggagtcagaaaatggaacaaattaccagaaaaatattctaaggccatcctgaagtagctaggttacataatcttgagtcaaatgccaaaattaagtattataccacttaatccaaatgaacaaaaggggagtcaaaagtttatcctgtttagggtaataatttttacatagaatatatagtgatttgtttctcacaaagtggtactggtccatgaagcaactgaaatgtccctctgacactctgtcacctccatctcccccgatttttgttccccctcacttctgacaccaggaccttcttgctactcacagactgcttagggcccctcaccctgaaggaaaaacaggagggagtgagaggacagagccctggaccctcccacattctccccctaaccctgtacaaggctggtccccttcttgatattcccagacaccaagtctgtggaattagctagtgaacaaattctcactgtggtgtggtcatcacagcgtagtgtgtgaccccttccaagggcagctgccgtatcgtggggccttgaggcacgggaataggaattgaaggtaaccaagggttaaggcttaagcaaaagaacaacaggtacagatagttctaggcaggattaggtagcatacagcccacatcgtggctcctctgataacaagacagaggtctccgcttcagcctctgattggtctcaggccaatccttcatagggaataaccaattggaggcctccaaagggcacctaggggtgttaccaaattcttttagcctaataaaaaccctaaatcagggggctcttgagctgcttgctcgagcctgctcccactctgtggaacgtactttcacttcaataaatctgtgttttcgttgcttagttcttttgttgctttgtcttttgttgtttcattcttttgttgctttgtttgtgtgttgggttcaacacaccaagaacctgcacaactcacagtcaagaccttccatctggtaacagcctgtgctttaagccaaagacaataattatagaaagttatccaggaagggacttttacagaccaactggcctgaacctgcacctccaatggcaaatctgtagccccacaaaaaatgcaaaaatgaaaactaagcccccaaacagaatgtctccttttcaccccctgacccctagtttctctataaaccagactgttcatgatggcctacatttttggcttggcagagacaagcaaaaaaaaaaaaaaaaaaaaaaaaaccaccttctgtctcattgccttctcagtgccctcaaacattgccaggcatgtcctattattacctctacatctgataactaatttcctgacacgtggagctctcccaagaagccattcccacgaccagaggcttcaaaccgggctgctgtaaccctagtccacacaggacattaggccagcacccccgccccagctccccttctcccccacacacttcctttgggccataagagaaaccaagtgtgccttgcttctccctggggcagaaatcaccagactgaggaaacagccacttccgtttttttgttgttgtttttgttttgttttgttgttttgagacagagcctggctctgtcacccaggctggagtgcagtggcacgatcttagctcactgcaacctccacctcccaggttcaagtgattctcctacctcagcctcccgagtagctgggattacagctaattttttttttttttttttttcagtagagacggggtttcaccatgttggccaggatggtctcgatctcctgacctcttgatccccccaactcggcctcccaaagtgctgggattacaggtgcgagccaccatgcctgagctgttttgatgccaggaaatcgagggcctgagtttcctgtatctcagcaaagtaggtggggattgaaaggccttccctgccctgctgcccaagctgagctgagagctttcctggtgcccgggcaggggcggggcaggcatgcacaggcctgtccatgcccacatgtgtctccagcacagatgttaaccacagagtatgacaggaagaccccacttcacttctgcagacccagtagcaagcagagaaggattaaccctgaagcgaatgaagctttagtacctcacttcaaggatctgggaagggccccagcaatgtgttcctatgtcatgtgtctttgtaaactgtatagatttaagctatcttaacctcagccagtgaagactctttccctcctggtgtcccctccatcacacagcgccttttgtagagtgacagaggatgttctgagcatctggttaaggggaattaaatacaggaaacatttaattgggatttcttgggatattttatatggtccacagttacttctatgtgttaagtaattgctagctgttgtgaggaatggcttcaggaagtctcaccgccttcttgccccagaggtgcaaggccaggggctgtgcagcaacagtgagggagaggcagaatttggaatggatggagccagaagcgagtctgtggaatattcatccagttctcacagctcacatgagaaacctgacactaggcttcaaacatttgacaacaaatctgaaaatgtacataacactgccaataaacagcaggaagaaactttggtaaaatagaataaagaaatgttttccaccatgtttgaggaaaagtgaattatctttctcttctctccgtaaaaaaaaaaaaggaatcacaaagttgtcatgtgaagaggcgattgaagagtatggaagaaaaaaaaaagatggggaatgaatgaagggaataaagtgttaatatagtgttataagggtgtttcaaagagttaattaataaaaatagtatgttgtttgaatttgatatttgtggaatttctgattcattgtgacttcttttctcattctaaataaatgcttttatacctagaattttaatgtgtatttttgttttaagaaagcctccaaaattatataagcttcaggccccacaaaacttggatgcagcatggcaggaagtcactaaggtaacaatttagacccatcagaaagaagtcaaccatgtaactaacaacagcaatggcattctgccttctgcaatcccagagagcttttatatataagaaaggcaatttagcactgacaagcgctgggttcataagtaatagaacctttcatttcctttaacacggttaaaggaaacattctcacttgcagatgaataatgcacactaatttctgcaatttggtagttcggacctcaaaaggaaggagagatccaatgtcaagcgaactttgtcattgtttctggtaaggtggggctggggggtctctggtggtcatggggaatcctgtcccactgcagggatatatgggaggacagaaacttcccctgacctcaattagaggaggggaagactcatatctccggaacaaatctctccaccggctcacccaagcctcaggaaaggtatgaatggttttaattttgagtctgctttggcagccatttttccttgactttcattttcttcctttcttttcaaattattttatatttggggaaatgaggcatcaaccaaaaaaatcaagtcaacaacatgcttgtgtctattaggaggacagctgggagcatgcactggtggtggctgaggctgggattttgacagggttctcccggttcccattgtgcctcctgagccacgacaaggtccccaaggaaggctgaacatgacaaatgtctcaccctgccctctgtttatttctttaaatgttcactacattatttagtaactactcttaaaaattattggaagattcagacttcaaactatactacaaggctacagtaaccaaaacagcatggtactggtaccaaaatagagatatagaccaatggaacagaatagagccctcagaaataatgccgcatatctacaaccatctgatcttcgacaaacctgacaaaaacaagaaatggggaaacgattccctatttaataaatggtgctgggaaaactggctagccatatgtagaaagctgaaactggatcccttccttacaccttatacaaaaattaattcaagatggattaaagacttaaaggttagacctaaaaccataaaaaccctagaagaaaacctaggcaataccattcaggacataggcatgggcaaggacttcatgtctaaaacaccaaaagcaatggcaacaaaagccaaaattgacaaatgggatctaatgaaaccaaagagcttctgcatagcaaaagaaactaccatcagagcgaacaggcaacctacagagtgagagaaaatttttgcaatctactcatctgacaaagggctaatatccagaatcgacaatgaactcaaacaaatttacaagataaaaacaaataaccccatcacaaagtggacaaaggatatgaacagacacttctcaaaagaagacatttatgcagccaaaagacacatgaaaaaatgctcatcatcactggccatcagagaaatgcaaatcaaaaccacagtgagataccatctcacaccagttagaatactgatcattaaaaagtcaggaaacaacaggtgctggagaggatgtggagaaataggaacacttttacactgttggtgggagtgtaaactagtctaaccattgtggaagtcggtgtggcaattcctcagggatcttgaactagaaataccatttgacccagcaatcccattactgggcatatacccaaaggattataaatcatgctgctataaagacacatgtacacgtatgtttatagcggcactattcacaatagcaaagacttggaaccaacccaaatgtccaacaatgatacactgaattaagaaaatgtggcacatatagaccatggaatactatgcagccataaaaaatgatgagctcatgtcctttgtagggacatggatgaagctggaaaccatcattctcagcaaactattgcaaggacaaaaaaccaaacaccacatgttctcacccataggtgggaattgaacaatgagaacacatggacacaggaaggggagcatcacacactgggccctgttgtgaggtggggggagtggggagggatagcattaggagatatacctaatgttaaatgacaagttaatgggtgcagcacaccaacatggcacatgtatacatatataactaacctgcatgttgtgcacatgtaccctaaaacttatagtaaaaaaaaatatattggaagaaagaaatacatgtttatgcctttaaaaatcccctgtctcttctggtagcaaggccttggagcccaggtccagatgatagtgaaaggtacaagagtagctgcagctggtacacccaggattctccacatgaggccaccagggcaccttttccaaaatcacctggggctttttaagatgcagatttccagggtctcccctctgaattttaccaaagtgcccagatgccatccttaccctgaaattctgaggtctaaccctgtgcccagaggagccaagagcaagtcccttggactagaagtatccttttgtggagtacaggaatcccaggtccctcactctctacctcaggaggctcttcggcttctgtagagcagctactggagtgtgatggttaatatttagtgtcaacttgattggattaaaggatgcaaattattgatcctgggtgtgtctgtgaaggtgttgccaaaggagattaacatttgagtcaatgggctgggacaggcagacccacccttaatctgggtgggcaccatctaatcagcagccagtgcagccaaaatataaagcaagcagaaaaacgtgaaaagcctagacggtcctagcctcccagactacatctttctcccatgctggttgcttcctgccctcaaacatgggattccaagttcttcagctttgggactcagactggcttctttgatcctcagcttgcagacagcctactgcggggccttgtgatcatgtgagttaatactacttaatacacttaatactccattatccatgtaacttctgtagcccctgcatcaactgactctgccggatgattccacagtagggcatggagtcattgaccagaagccagagctgatgactccatgcacccctctcagacttggaagaagagccacaccacaatgcatgggggatgaattcctcagcagtttctaaaagggccaggtgatggaaccccaaagtgtggtatatgaaactccacaggggatgaactctgatctgttgaggataggagtcaggagggattctgcagatcaagtcaccctctattccttcctccagggggcttagtgtcaggctcatgaagtaggaatgcgggaatccaccccgtggctgcactggtgcctggatagatagtcattagttgctgtagagatctaacaacacaacagcaactcaagtatctaaacctttctgaatctagcttggatgactccctactcaagcttactttgggccagaagtcttagaacttaaagaatctggggaatctcatagatgtatctaatacattattatgtgttagaaagaattgctgtctgggttctagagctgtgactgcctgtctgtttggtattaaccccacatcatagggcaaatcactcaacttctctatatgtagcagagggttaatggttaaaggaaatattctcacttggagacgaataatgcacatcactgtaggatgggtcagttgggatctcaaaaggaagttgagtcggggttagacttcagagcttctgggtaagaagaggcagttggacaccttgttaaaaatgcagcttcttggctctaccccagaggtcctgtttcagatctggggtagactctggaaatctgcattctgagaagccttcaggtgattctggtgaagatggcctggtgaccttgcttggagcataatggcattaacattaattcttttcttgccgggttgttataagacttaaagtagagtcacaaacatgcttagaatggtacttagcacatcataaaatactaaacaaatttcactctttttattgctcttgattttctgggctaggttttgaggatatagcagtgaatcaggtaaacgtgttgcctgccctcaagtagctccagggaggcgcagtgggggaggggtgggttgccaagatctgctttggaattggagaagctctcctgaacagcagccaggagcttcctacctttcccagggtgatcatctcggttctagaatttgaacatagaaatattctaggagtggctatcttgttggaaagggataggatacttgtcttaaaatcctgtttgcatggctctttacagaatatcaaaagatgcatgagatacatgtcaattgcacataccaaacactggcaggggaaggaggatctggttcccccgaccgcagaatgggaaaccaggcaggaagctgctgtttaccaggcatagcaccaggtcctttcacatcaattgcattatttaatcctcataatagcttgtcaagccggtgtggtcaccacatctttatatgtgagaaaaccaagtctcagtgagagtacattaaacctaaggtgtcatagctagagaatggtagtgctgtctaatgtcaaagctgctgttctttccaacacataataataatggactcgatacatcttatgagctgccttagactatttaagctctaaatccttccaccctccattatccatgtaacgtctgcagcccctgcatcaactgactctgccagatgattccacagtagggcatggagtcactgaccagcagccagagctgagactccatgcgcccctcccagacttggaagaagagccacaccacaatgcacgggggatggattcctcagcagtttctaaaagggccaggtgatgcaaccccaaagtgtgggatatgaaactccacaggggatgaaccttgatctgttggggataggagtcaggagggattctgcagatcaagtcgcctgctattccttcctctggcctgtccaaaaggcatctcctggggccatctgacaggctgtgtcttcgtgaagccttggccaggtcagcagcggggcccggcatttgcttcccatccttccctgcctcacactggctgccctactattgcacttcattaaaaagcattactacttcaactttgcctcagattctgttttccagggaatccagattaagccaaaaagaacaggaaacatttagatggattatctcatttaatactcatggcatccaaataaagtgttattatcccagttttacagataaagtaacttgtggttaaaatcatacacacacatgaacagtgcaaccggcatccagactcaagcagcctgactaggtcccactcctctaactctgcagcagggaccggagcctgattaggtcccacacctctaactctgcagcagggaccggtacactcctatcagcctcgttcatctgatcctctatatgcctcacctctagtaaatatttcctgtggaaacaaatgctagatatactcgactattcattctctctatcttgtaaaagaatacaacttcaggacactaataacatattcccagccttccttgcagcaaggtacagtcaattagttctgactactgccatgtaagaagaaatgaggtaaatggcttccaaatggtgccttcgaagagaaagagacagcttccccttctcttccccttctcccttggctagaatgcagacatggtaagtggagtcgttgctgcttagacaatcagatggaacccacatgttggggatggctgtggaatgagatgaaagagcctgggtctcccacaccattgaaccaggataccagccctggacttctaggcttgaacagttatggaagagaaaccaacttctttcttgctttgtccactgctgttttcgtctttgctatagcatccgaacttgcatcctaatatacttttcaataggcagttaattttatgtgtcaacttgactgagccttgggatgcccagattcaatattatttcggggtgtgtctgtggggatgttcctggatgagactggcatttgaactggtgggctcagtaatcccacagtggggactcccctccccagtgtgggtgggcatcatccattgagggcctgaatggagcaaaaggctgagaaaaaaggaattcacctatttttttcttcctgcctctctgcttaagctgggacatctcatctcatcttctcctacccttagactggggcttacaccttggctcccctgtttctgtgacctttggactcagactgaattaccttttcctgggcctccagcttgcagatggcagatcagaacctctcagcctccataatcacatgagccgcttcctcattttatatatatatatatatatatatatatatatatatatatatatatatcccagtgcttagcctccgtaatcatgtgaaccagttctttattatatataaatatctatatcctattggttctgtttctctaacacagacagtaagcacaaatggttaggaacagggctgcacagtcagacatctgggttcaaactctggaggatggctcacattctttcctactagttgctattcacctttgacagccactttctagaccttcctcagggacaattttctcattcatgtaccacacatatgcagcgtagcacaatggctgagcccaaggaccccggacatttaggctgaaatcctagttctgtatgttctaagtatatgacctcgggcaggttacttaacttccgtgtgcctccatttcttcatatgtaaatgagaatactagtagtgcctccctcacagggtttggtgaaagcaagggaaaccagagccacccactatgtgaatccagagcagaccagcttcctaaggcttaagggtccctgtcataggacgtggtatgtgataggcatttaacaaatgttagctggtgtccttgctgctgattattcttcttcccatatgagccttgtatataacaggtgtcaatcctttcagaaggattgaatgaatagatgcctaaaccacattctgtggagtagaagtcacaaacacaaaccagatacaaaggtgaggtgttttaccccagattgggtactgtgtgagatcactgcccaacagagggaacatggctctccagtctggcaaccgtcgcaagcatccctccagtttcaaatggaaggtttcagtgttgttcctgccaaatcctggcctaggtcgtggctcctcactgacctcctcggcgtgggtaggcattccacacagccctgaggaccccacaagactccatgcagactgtccacagtgctttccctctgggatgggccccctctatttggggaaaccacaagaatttgcaattatcattccaaaatggtaagtataattcttaaccaacgatggagttccaagtcagtcagtcctcagtccagatgtgcagtatgcaccctcccaggacaggacgccctgttgcaccggaggccgactccacagagttccttctcagccaatgaatatggctctttttaaagaaacagggcctcccagagctactgcagcaagcctcaacctcacaagcctctgctctcctctgtgcaggacagttggagtcaactagtggcaggagcatggagtcagactccctgggtttagtgttcaaattctgcctctgttactaattatatggtcaggttttcctctctgaaactcaattttccttcatctgtcaaatgggtataataatagtatctaccttcctggtggtggtaagaaataaatgaaaaactttcaacagtgtctggcacatagcctgaataaaagttggctgctattatggctctgtctattttttgatctggggcacacaagcaacaggcaatggtctgtgtgttttggtgtagtttcctctcctttctgcatccttacccaacctggaccagtcccttcggcccaaggaccc

SEQ ID NO: 590 - DNA, 40001 bp, Homo sapiens
cgagacctcagcttcaacttctttggctaattggcaatagtctttcagctttctagttccaaaatttctgcaagcaacatgtggttggttcagatggtcttttatccccagatcaccagccaatctgtggatgggctctccttgatggagtggaccacatttctctaaatagctgaggtcagtgacagggtgggatattatagagccagtacaagctacaagatacagaacatggtagtcaaggtctacccctttcttcagaggttgtgatgggttgggagaaagggtcagatgcctcaaaatatatcctatcaattgtggttcattgtcaccttgacaactggctacatggaagttcagaatttgagcctagaaatctagaagaaaaatggtgacattagccaaaataaggaaagtacatggggaagccagttttgtgggatataatgttattatgatattgatttttagagaataatgtggagatcttctttctctgggttttctcataaatggataaacttcctgaaacatgactaaattatatgtgtgaatcttcagcacattcttcctttttcaagtgtagctaaacagttgctgaaaatgttacctattaattaaatttcaaatgtgattaactaaaatccgtcttattgccaaataacttcaggtaaatgatgcccattaattttaaaattttggttatagcacaaaaatggcaaaagtgctgatcacattcttgaatttatagtgtttcaataatagcattatcaggccaggcgcagtggctcatgcctgtaatcccagcactttgggaggccgaggcaggtgttatcacctgaggtcaggagttcgagaccagcctggccaacatggtgaaaccccgtctctactaaacatacaaaaattagccaggcatggtggcaggcacctgtagtcctagctactcaagaggctgaggcaggagaatcacttgaacccaggaggcagaggttgcagtgagccgagatcatgccactgcactccagcctgggtgacagagcaagactccgtctcaaaataataataataataataataataataatagcattatccaggcatctcttaggtcaaaggagtaaattaaatttgcaagagataaacatttccttcattgtggaactgctataattctggataccttgacctagaagatgaggtaatggaataagaaactctgggcaggaagtagactttatttttaaagccatcttaaaagatacagtcatactgtgggctgatgatacttcaagtgtgcatggctatttcttgcagtaatgtggtctgattgagcaattctagagaaggaacacttaaatcacaataaaagagcccagtaagttttcaaattgttctcatcactggaaatgtcttccctaaagtaagtcaaattctgcttcctttgactacactcactgatgcaagttgttccctctgaagccatacagaataagggtcaggttcttccaccatttctcatctgacatgattttcagatccctcacattttcttacccttctgaatatactggtgactggttttgctgctttcttaatgtgctctgaagaagattcaagtaacacttacaaacacaatagactagagttacataactcaagagttaagaaagactggaactggctttttaaaagttatgtaataatagcttttttatcattagctataatttgataaaaccattagatgttttatcaaaaagtaataatggtggcaatgacaactaactcaggtgtagatctccaaagttcccaaagccctttcctagctgacatttttcccccatccctatttgcacaagccatactagtcttattcctaacaccaactcctcaggaactaagggaaagttgacagttactgtttgtggtttgacataagaaggacaaaaaaaaaacccttctatttccagagacagtctataaatatgtgatcttgtatgcaatttgcatacatgaattaaactttttatacacaaattgtagcaatatatccaatgtactctgctatcacagtttatttaacagctcaccttcttaaagtatttggttgtttccatcttattggtaacaacagtgctgcagtgaatatctttgtacatatgtttctgcccacatgtgcaaattataatgaaaatgatgtgccaaagagcatgcacattttaaattttaattgatgccaattaacttccagtgaacatacaccaagtgtaggggggagcgccagtttcccccatacccttgccaaaacagtttgttaccaaatctgttgatatttgacagaataaaggtgaaatatgatgagatgcatatcactttcattttaactggcatttttcttatagtgatgttgaacatcttttcaaatgcttagtagttgtacttcctttttatttctggactgtttgtatccttttacgattttattaatggtctttataaaaatttgtttctagcaatttttatatgtgaaactattaacattcagtatatagcaaaacataaatatcaccaccagattgtatatatctttggacttggctgaagaactttggacgtgttgatttttaaaatatattgaaagaaaagttttctcatctctgagcatacataaaaagctgtccattttcttctagtaataattatagtttcattttagtctttaaatgtttgatccatctggaatttattctggtaaaagatgaggtgaaaattcaacttattttcagctacttaattattccagaattatttattaagcattctatttttctccaatgatgttaaatttctcctgtattatttgctaaattttatttggagattctgtttataagtccactcttgtatctcactagtctatttgtatgtacatgtgccgttacaacactattttaattaccacaaatggtagaatgaatagtccctcatggctgcatttttctcacagaatcttcctgaatattcttgtatgcctatttttcattttgttttgtgtttttgagacagggtctcactttgtcacccaggctgtagtgcagtagcccgatcttggctcactgcagcctcgacctcccaggctcaggtgatcctcctgcctcagcctcccaagtagctgggattacagatgcgtgccacatgcctggctaattttttgtattttttgtagtgatggggttttgccatgttgcccaggctggtctcgaactcctgggctcaagcgatccaccaacctgggcctccgaaagtgctgggattacaggcataagccatcatgcccggccatatgcttatttttaaatgtgatgtttacaaatgtgtttagttaaaaaaaatctattggtatattattgagattgtgaaaaaaataccgattaattttgccatgattgggtatttataacataccttgtactgaggtaatgccttttttgtcctttagtagcattttaaatttgcctttatagggttttcacatttcttacatttattttcaggtattctatctttctgttgctattatattttcaaactggttactgtttgtttatagaatagcccagtgactttactaaattatgttgtcaagtaaaatgctttaatatatctaatcctattttattaagaacattttttgagatgaagtctcacagtatatgtttagcattttatcaactatcttttaagcatctgcaaatatgagtataccacttttctcctttgatttattaacgtagtcaaatatattatatttcctaataatgaaacattcttgcatttctgatatgagccttatctagtccaaatctattatattatgcttttaagataggatcaattttactggctcattttttataatttaaaaaatcaattctcatagtgaaatagatttgttgtttcctggtttcataatatctttctcgggttttagtcttggcattgttctagtttcttaaaaggaattttcctatttatttgttttggaacagtttaattagcattgtagttctctgttcttttaaatttcagaaaatcagtggcgaaatacctgggccctgtacatttttagggaggagagtggggatgaacttgctttttgtgagtttttgctatttttattatattttctacttctgtgattagctttatctatttcacagagcttatcaaattatttgtcatacagttgattaaaataatcctttataattatttaaatgcactctgtatttaggttactttcctagcttcattcctaattgacaaactccaccctttttttatcttggttggattagcgaatgcatctctgttttattgttttctttccttgttttcaaataatcgactcttagatatacttagtatttctattgtattttctgtttcctaatgcatttatttctaaatcttcatctttgttatcttaaagctgtaattcttattaatgtgcaaatattcttagaaagagacatattgaaactgttaataatcatttctatcttaggataaatgagttccagatattgtcgtgggcctaggttttggaaacgggaaaggatagttattagtcaagcaattacttgagtcctagagaaggggatgggggtgacaacaagtataatcatggagttcagagtctggggagatacacatttcccatgtcatagagcctctctttacacattcatcagaatgtgtccctgtaacatcaccacacaatggtttggtgttccagggaagcaaataacttagtaggtgttgggaaagtgcttaaataaaaaacatgggcttcagtgacataaattatgaaacataagtcatggtactttttgtttttccatagtataaattaaacaaaaccaggaaaacagcttcatagggaggcttatatctatccaataaaattcccagtcaggatatttattcactcaaaggcgctaccagaagggacagaacagatggatgacactgtgacagcccagggctgcctaagacagccatggagtcttccttctccctgcactgctctcctttttctaattgaagtttgaataccatcttgcattttcaatattcttttgtgcacttctatttgatcctaataacaacctcgtttattagacttttcttgtgtactctctcacatccaaccaaacacgtcttactaccctttttttttttttttttttttgagacacagtcttgctctgtcacccaggctgaaatgaagtggcttgatctgtgctcactgcaacttttgcctcccaagttcaagctattctcctgtctcagcctcccaaatagctgggattacaggtgcgtgccaccatgcctggctaattttttgtatttttagtagacacgaggtttcaccatgttggccaggctggtctcaaactcctgacttctttctcaactttttatttccagggtttccttctgagtttagaattttattgtttcatttccaaattcctgtggtagtcttccatcatcctggaggcgcgataggctagctgttgaaaaacaactcctgaatctcagaagtataatatgataaggctttatttcacaattacatcatagtttaatacaaggtatgagttggggtagggcagggtcaaaaattgtctatgttgtccttcagggacctagactttatatatctatggccccacccccctggagcctcagagttccccactgtatcctctgcctctggctgacagatgagaaatgagaaagtgtgtggacaattgtgcaggaggttttcagggccagagcctgaaggtggcatacgtggatcctgccacactctattggcaggaagtcagtcatatggctgcccctaactgtaagagaggctgggaaatgcagtctagttttgtgcccaagaggaaaagaaaatatattttggtgaaaactgcatacttggacacagccagcctctctgcccacctatgttgcatgttctaccagattagcattcattcagtcattaaacaaacatttactaaataccactatctgccagctactacgctatgcaccatgaatacaaaaatgcataacttctaattttgccttccttggaactcacaagctagtgggagataagaatactaaaaaaaaatgtctacattgagttaagtacagtggtcctcccttatctgcaggggataccttacaagacccgcagcggataccccaaacacagatagtacagcaccctatatatgctgctttttcctatatatgcatacctatgatgaggtttatttatttatttattttagacacagagtattgctattttgcccaggctggtctccagccctgggttcaagtgatcgtctggttttagcctcccgaatggctggaactacatacataatttacaaattaggcacagcaagagattaacaataactaataataaatagaatatttataactacatactgtaataacagttatgtgaatgtagtctttcccaaaatatcttattgtactctattcacatgacagtagtttcttcaccggcagactcagcctctccagtaatttttatatttttcagcccaaacatattcccgagtctgtataaccacccctcactcgcaataaatggctgatgtcacttgtttctggggatcccttgctgaagtcttcctacaggctcaatgctttctggcacaacacattgctgtgaatcggaacatgttgcattcatgtcttccacccacatctttaatgccttttccatcataattaagcacttattacacactgtggccataacttttgcagttttagatgcagaataaaactagcacaaacatctttttccttcttcacaatttcacagatagaggatttgtccttaccatagatccaaatctatggtatgaaaactaagcatacaatatttttttctttccttattaagtcaaggactttgatctttttatgtaaaggaagtacttgacagcttctctttgtcatacctaaattgccagcttcactacttttgtgctttgaggccattatgaagttaagtaagggtgtcttgaacacaagtgctgtgatgtcacaacagttgatccaattatccagccagctactaagtgacatgcgcaggcagcatctacagtgtggaaatgctgaacaaaaggatgattcatatgccagatgggatgaagcagaacctgctgccaagcaatgtcttagcctctagtaatgagaacagaatgaatattaccctgatctatccttctactttgctccttgcctagacatatgtaggttgcttactgagctgtcggggtcatgatttgacttacctgtaagtccaggttgtggtacacttcaggtcaccaaggacttttactgattcttcatctaacaatttcaacttcaaagctattccaagctctggacaatcattttggaaatgatctattggtggctgctgctggaaaagaccatcacacaagactatacccttcaatactggtatggaaaagtatatgaaactgcctttcctataagtaaatggcttctcacattatcatttggtattcaaccctgatcagcacaacatccatccctgagaatgtcatgggagctaaggagacatagcattcattttggtttacggccatcagtgttgcccaagtgccatatagggagtctctcaggccatgctatcagtgcccagggtgccaactaggaatgccacctattaagaagtcttttcagaaaaggaaccagaaaaactgcctttgtattaagataatgagtagacacgcaaccttaggaccagcagagtctacagcagcttctcacttcagatcaactgaatcataatgagcatatagcaacctgctcttttagatgggtttcaaatcaccaactgctagactgtcaataccacaaagttgatgtcttatactcctatatggatgaatatctggggtcttcaaaagccaacacatccaggagaactgtgcccctagagagcttagaggtaatacagtcccacatagaaatgaagggccaccttaggagatggcagcaaaccattgtctacatccaggaactccttctagaacccaggagtctcttaacttggcacctgaagaaaatatgggttagaagcttttgcttgagcaatagacctgcctcagcaggcaagtcttaagcccaattctttcatctgtcgtggccatggatctctagtgcagtgttcagaactacacagaaacttcaaggatgtgttagaagataaattttaatctgtgcattttttatttaaaagcaaagagagccaaaaagcctataaataatttaaaattgaatgatgaaaaacatttaattatcccaaagaagaaagaaaagaaggaataaaaaataattataaaatggtgaacatttcccaaacattaatcacattttttttttgtagctgggattacaggattgtgccaccatgcctgctaatttgtaaatttttgtagaggtgaagtctcactataatgcccagtcttgtcctgaactcccggcatcaaaagatcatcctgcctgggccttccaaagtgctagtattacaagtgtgagccaccatatctggactactttaaatttaaatggactacacatacctaataaaacatgaaaactgtaagaatgaattaaaaaaatgcaagactcaactatatatggcctataagagatgtactttatttattcatttatttttattgttattactttttagcttcctcgggctgaaagagatgcactttaaatataaagacaaatcgattcgaagtactttcttaagggaataatagaaagccaaaatcaatggaatagaaaacagacaaacaataaagaaaattaatacagataaaatttggttctttaaaaagacaaataaaattgataaatctgcatgtagccaaactgttgaaggaaaaaagaaagataaattattaatattgggagtaaaagagataatatcattactccagatcctacataccttaaggatgataacggaatattataaataacattacaccaataaattcagtagttcagatggaatagatggattttttgacaaaaatagtttacccaaactgataccatatgaaataaaatcttttaaaaatactatgaaataatagtaacaaacaacatgaatataataacaaatatagggttataataattataatatctgagttgtcttacatctattaaaatttttaattacttatcagaaagtttcccacaaaggcccagacagttttactggtgaatcctatcaaacatttaaggaaggaataacaacactcttacataaactatttaagaaaatagaggaaaagaatacttcccaacttgttttatatggctaccaaagcagtgataccaaaatctgacaattatgttcaaaagagaaaaaaagaggccaggcctggtggctcatgcctgcaatcctagccctttgggaagccaaggcaggcagatcacttgagcaaagaccagcctgggcaacatggtgaaaccccatctctacaaaaaatacaaaaataagtcaggtgtgatggcataagtctgtagtagctagttgcaaggctgacgcgggaggatcacttgagcccctgaggttgaggccgcagtgagttataatcacgtcacggcactccagtttaagcgaaagagcgagactttgtctcaaaaaagaaagaagaaagaagagaaagagagagaaagaaagagagaaagaaagaaagaaagagggagggagggagggaaggaaggaaggagagaaaaagaaagaaagagaaagagagagagagagagaaaaagaaagaggagggaggggaggagagggaaggaaagggaagaaggaacagggagaggaaaaggaaggaaaggggagggagggggacattaaagagaaacaaaaaaattacagaccaatattcttcatgtatgtagacacaaaattatttttaaaatataagtaaatcaaatcttgaaatacatgtaaaggatgatacactataaccaagaggggtttatcctagggcttcaataaatgagagaaaaaaataaatgtaaaataggtgagcaaatcaaatgtatacggtaagatggcaaaagtaaatacaaatataaataattaaatgaaggtaattgaccgaatattaaaaaaaaattcggacttccagaatggactaagaaacaataacaacatacctcataaatgcaatgtatattaagaaaacagcaaccatatgtagtttcctatatataacaaaacagaaaagttgaaagaatgggaaaaaaatcacacaaattaaataaaaagaaaattggtgtaactctactacgggttgattatcacttatctaaaatgcttgggaccagaagtgtttcaaatttcagatttttttgaattggggaatatttatatgtacataaagagatatcttggggatgggacctgaagctaaacacagaatttatttgtttcatatacactttatacacattgtattttgtacaatgttattaataactgtgtgcatgaaacaagcttttcactgcattttgactgtgacccatcacatgaggtcaggtgtggaatttcctacttgcggtgtcatgtcagtgctaaaaaactttaagattttggagcattttagattaggggtactcagcctgtactagcaatgataacagactttaagccaaaaggcagtagtagaattaataacaagaaagcttcaattcactgggaatgtttaacaattctaaattcatatgtacctataatatttacatggcctcaaagtatataaaacaaaaattaacaagagctacaaggagaaataaaaaataatgaatatttgcctcattttctcacttgtttttaattcactgaattatgttgtattttgtgctcatttgttagttggtttgaaatttttttaggacaaacagggatacagcttaattaattgattttaaaactctaatagtgagacctcacctaaattattaaaatttatcatcatggtccctaatccccttctgagaaggaactggaagtgtgttgtcttggtaagaaagcccctcctttgggcctaggacctctcaacaaatgctactttttaatgagactttcctcttttggtcaatagattacccgtaaattaattgaagccttaggccttggatataaagcaagtaatgtgacttcattaaaatactaaagttacagtgacaatactatctttgaaattaaatgtaggagttgcatctcttgtttttattttcattttaaatcttatttattcttttatttgcttcttttgaagtttatttaatggtaatgcacacaagagatacaaggttgaaaacacatgaatggaaatattttttaaaaattcatctctttggcctccgctacccaagccccagttctaaattgtacaggtaacccatgttacagaaagttagactacccaacaaatgttcttcacctcgcttttttttttactatttaccctagtcactatttcatatcagtttatcgagtgggtaccacattttttttaatgtcctgcatcctgcataacattcctgcatggatgaagcacatttatcttacctgcccctttgctatcacagacagcattgcaatgaacagcattgtatacatacctttgtgttcttgctggagtgtatttaaagagaaaattttattaagtgagttgggtaaaacggtacaaatgtgcgtttaattttgataaacattgccaaatcatcccatagttaaaagttctacaaatgtactctcccaacaattactgaacgtgcttgtgcccctgaactcttgccagaacggtttattattacaatgtttatctttagcattctgattggtgaaaaatagtttcttgttgtcatttcaagaaggactattcttatgagggggttgagtatcttttaaaaatactataaaataatattaacaaaaatatgagtataactaatatagtgttatgattataaacacaataaatctatcataaatatgaaataagtaatataagatatactatttgtcaaaaaaaattgcattaccaatcagatgaaagccactgtatacccttccctagttgaatttctctatctcgttatttcagaagtatttgctaccttgaatttaacatttatcattttcaggtatttatgtagatcttgcaacacatttatttactcccaaattacatatatttgtgtatatgtgtgtgcatataagtagttggcatgtttttaaatttcatatagtgtcatattgcaagtattcatcctgcagtgtgctttttgtcctcgacattattttgtgataattcactcatgatatttatgcagctcagattcattcactttctactgctcagtaatccattgaatgaatatataaccatttatttattctactattgatggtccatttaggctgtttccaatttttgctctttgtgacaatgctactatgaacatcattgtaaacatctcttcatcgacataggagcagacctgctgggacctgctgggtcacagggtttggattcttcagctttactacatattgccaagttgctttcaaacgtaactgttccaatgtatgctttcatcaacagtatagaagagtcctcttgcttcacagttttgccaaacttggctttagaaaatattaattttttgccaataggatgcatttgaaacaaaatttcttacagatttagttttcatatgcctgattatgaataagactacacatcttcacagatgtgtaaaagccatttgtgtttttccttatgtaaactacctgctgtggtgttagctcatttttttctattaggttattgttttttgtcttatttttaattgctttgtagaaagatttttattttaggagattaggtacctgctaccttaactatcattttttaccatcaatagtttttctagattttcttttttcttgtgtccttatttatagtacctttaaaaccaactatttaaatttatatattttatatatatttacataaatataactttatataaatgtgatcacatataggcattttgtatgtgtgcaatgtttttccactttttatgtggttttctccttagtctctcctacttttcccctcatgtggcttccctgttccccctacaaagataactcatattataaactttacattaattattccatacttttactgcattcaaatgcctctatacgacttgtacatttatgtacatactctgcaggatattttaattttgtcattatttggtttataaacatgcaattatgctaatacaaattttttttgctttttatattttcatttaacaatactttgggaaaatacctctaagtaaaactgtgtgattctaactcatttttctaatggctcctaaattttgttgtatcaacaaaaattttgctaagcaaaaatcacagcatagaaagttacagggacctaaagaaggaaaattgtacttagtcaagattttataaatatattttggatatgtatatgcatgaactttaaagtgacattaagaggtacattttactccataaaatttgttgttgtggaaattaaatatatgaatgtatatgtacttcttttgcttatatacttatgtatctatattatatataattttgtatatgtattacataaatatattttttatatattagagatacctatcatatattatatatttatgatatttatttatattatttatatatcttatatgaggtaaatatatatttatatattacataaatgtatagtatatataagcatatactatatatgtgtaatatgtgtatactatatattgtgtatatatctatacacacacatagagaaagtgagagagacagagagaacagagccaagtgataggaagtacactctattcctggctcagtaacagactgtgtggaagtgggggaataatttcactctgtggacttcagttatctctcctgtaaaatggaggatagagtcaggacatagacggctcttccgacgaggtcagagttcctcaaggcaatttaggaggaatccaaggtttgccaaggctttgcattcaccagctgacatggcgccaccacgtggtaatagtgtaaacaatttaaaatgtattggatccgtcagcttttaaacatgattcatcaatgtttaatttgaggaattaagattatttaaactttggtgcataaactgagactttattaatatgtttatttttcactatttgaaatttgcataaaatgtgactacactgtatagacagggaagttttgaaatctaacattgtttctgtaacacagagtaacaaccaactacatttaaaaatggggaaaatatgataatagaagaattattcacatcagaaagtatattttaaacaacaatatacaacatctttaatagccatatggttaaaaaaacttttcaaaatgcctaaagttcctgaaattagtttagtgagtggggtaagcgcagagttgggtgaaaagacacaagagtacctcaagaacttttattgttaatattatattatcgtttagacttcaaaatatttgggatttacactaaactgaagcacattacacaatctagtagtgagatagtaagtagaatcaaaatagagtatcaattttgtttatttaatatttacatacgtattgtcgtttattgaaataactgtatcaactcttgctgcttttagatatttgattcgtttttttagtaaattattaattttagtacagttttagattcacagaaaatttgcaaagaaatgaatttccatataccccgtacccaattttctatgttagcatctaacattaccatggctcatttgtcataactaaataacaaacattgatacattattattaattaaaatttgtactctattcagatttgcttaattttaatctaatgttctttttctgttccaggatggcatattacatttagacattatgtcttcttgtgttcctcttggctgtgacaatttctccgattttccttatttttgaaggctttggcagttttgaagagtattagtcaggtattttgttgaccgttcctcaatatgggattgtgagatgtttttctcatgattggactggggttctggttacttggaaggaagacaacagaggtaacgtaccattctcttcacagaacatcaagtattcatactgtcaacatgacctgttactattaataaccatgatcttctgttaaccttgatcatctggccaacgtaatgttttccagatttctccattggaaagttactctttttcccactttgcctgtaataccctttggaaggaagtcactatgcaaaacccacacttaagaggtaggtagagagctatactcacttccttaagtaggaactatgagcataagttacccagaattccgtatatttgtctcttttccacatttgtttatttattcagctatttatattggaagaactcatgaatatttattttatactttggattacaatccgttactacactatctatcttgatgctcaaattgttctagtttgggccattgggtgttccttgaggttgacttctcctttccctttgacacactcccatcgttttggttttgaagcacttctttacttcctgacactacaagatgctccaagctcatcttgtatatttcctgccccagtcttagaatcagctatttattcacgttctggttcatttcatttgagaatggtattagaaaccaaccaagatgtgggcacgaggcgtgacttttgttgactttggatcctccctctgtatgtatttacataaacgctttcctctccatgtcctgatcatcttaaaactgagcttgttttaaatagagctttgaaatttttaagaatagtttagtcaataagacttcttgcactcttgctaactattgtttcaattattgctactgttaacaccactactccactaatggtaaagtttgtcactctcaaatatgaattccggataaaagctttctggagaaaaatatatgaattatttacgcacttttcctcactacattccttttcactaaatcagcagccaacaaatatgtgtctctaagggaataaacagagctgtgtgtacatatgcatacaggtgtttccctttaggcttcttattggagcacattgctagaagaaatctgccaaaattattagactttgattcacttgcaagcaacacctgtgtgttctcttcatctttacatttccaaggcttagctcaatgcttgatacattccagaggtttcctaaaggtttgccgaataaattgcagagccccctggaacatggtgaagtttaccatcaatcatttaaatgcatctcagggtttgttttgttgttgctgttgttgttgttgttgctgttgttcttgttttgggggggattttttgtgataagtttttgttgtactttatctgcttgtttttgcttaggaaggcttcagtgacagtagttaaagaaattgtggtcactatcacattttttttttttttggtagaaactgatttcatctctctgatactgttttatctgagccatggtaaattaatcacagttttaggcttcttcttcactggtaaaataaagcccaaactgctcatttaagagaaaatgcttggccaaaagaagcctgtaaaaccagagtgtgcttttccttgattcacagtaaaacatgaaccctttatttgagctctttatgacatggaaaagcatttctatgtattgtgttgaataagctattcttcccccggatggtattgaatttaattagaagaaaatatcttcatgaaaataaagctttaatgatatactgcttcattttaagaccataagtcatcgtatcctctaaatggtgggataatgatgctgaaacaaaacactaaagagggaaaaagttattcatttggtgttcagtctttctgtggaaaacgtgtgtttttattctttatcttccttatatttttacttccaatttcccacttaaaagaagattctcttgtatgttctattttaattttactctagattcagtacaatttcataaaatgaaattcatttaaatataattcaggaaccaagccatcttgaatgaaagtattttgagacagcactcagggtttcaatataaacaccgccatcatccatccattcattcattcatccacctattaaaaatctgtgtgtctgttgccatcctggtgctgagaaaacatgagtgggaaagagagattcatcacctcagcaattcgcagggaagaaggaaaaagaaactgaataacgtagtaggatggtcctagctgagtgaaagagagcatgagacctggatatgacctgaagtctggttatataagagtttgtatgagatagcctccaaagataaagtattgtgcacaagtgtacaacaaacggggtaggtgagaactgagacaacctgcagtcttgtctctgggcactagtgtttttctttttctgtcttctctttttaaataacaattaacatttatcaagtgtttgcccaaatctggacactgatctgaatattttgtgtgttcttagttaatacttcattcttcacaacagctcgtcacaacacttggtgcactgagacagattctgtgttgcctggagtaggcattgtaactctcatttccattttgcagataaggaaacagaagcacagagagtttacataatttcactaagatcatgcatccccaagtgttgtagccaggatgtaaacccaggcagcatgccccagagccttcctcctgctctaataatggtctgcactacttgagctttaaggagaggggagcagcaggcacaagcagaaggagttgtttttccaaagggcttcatgagacaggtagaatcagtgaagaggggagtgtggggtgcacacagtgcttcttaggtctgtcaggtggcaacaggtgacctagagtcggagattgaatctagcctcgctccttgagagtgacggggtcgggagccctgaaatccacacatctcagaatggataccattatcatttggaacaatggtggccctgagacattctctggaaacttcagaagcccaaggatagtgacaaagagggagagatgttgggaggaatcagggtacggatggcatggatcaagaaaataagtgtaacctagaagatactctctgggaactgttcatgatgctgggtgtgttgatacagcttaaaggttatttcagtgtgggggacgctttgatggccttgtcaaaagtgtgtaagcattgctttgttagttattgatttgttttcccaagcagtgcatatgacatccctgaacctttctctgctttctaggtacaccatgattatgagagatttatgtttttcacttcattgagcatggtttaaatgtttataggtctgtattactttcataaactgaaaataaaaatctctcataatttgatagaattgggttaactgctaagaaaataacagtgctttattttaaaaaaaagcttcaaaatagtaatcatagtttaagaatattgttgacgtgagagagacatgtcagaaatttaattgagccttactatgcagtccagatttaagaccaagggatcatacaggtggaccaaatagtcaccttctcagtgtctttaaggcatagatgagaaaacttgaggtgtttcactgaagatgcaggtgaactctcagacatgagcagatgtattgcttggaatgactgatggccttttctgagatgagtgagtgtagtaagctgatttcatgactgtgcttctgccaaaggctccagcctagttctcctctcatctctaagccccttccctcttagactaccactctatccgtgaaggtaaaaataataggttgagtttttctcaaaagcagggcaaaggagttcattttccccttacctagcaatacaaattgttaaaagaaaaagaataaactggaataaggctgtattcaaatgtctcatcaaaatgtccctgccttgggaaatgctttgccaaagtgaccatttccaagtctctgaagtcaaaacagctgcatcttagtggctgcctcaaaatcgtggtatgaaaatgactgtcaaaacagccccatcaaaatgtcatgtacttggagcccatgtgagatgctctgtagacatctctgggcataatgggacaggaatctcataatgggttcccctttgtatccacagtcccttgaagcttcgaaatacccgtattaaaatgatcacaccacgaaataatctgtacagccaactcccacgacacatctttatctatgtaacaagcctgcacatcctgcatctgtgcccctgaacttaatagttaaaaataataataataaaataaaattatcccaccaactaagcatcagggaaaaagtaagcagaagcttttacaggaggaaaactccaggaggagaaagcttcctgtgggaagggacatggcctggggattggagagatgggggtgccttggagaaggggcaacagggaggaagaaggtattccaggcagaaaggacaatgaacacagagacaggaatgagaaactgaatgggacgatggccacaacatacaggtatttcaggttgctcactatccaacctttactgagcacctactgtatgctttagcatgttgtccccatcattttggagaggacatagtcaatctagtacatggtacaatcttttttccttccactcagcaacagcaaaatacatctggctcccgaaacagtatggttttccctcagatatttttctaaatcacattgatttgaattaaatagttcagaaaaatgattttttctctttgttttttgaaatcactttaatcagaattaaatacagagaaacgatttggtttcttctgaaacacacagttacactgcaaatataaacatacaaaaaactgctgaccacttaagtattaaacattcacttggtatgctacagcttttggaaaataaaataccaataattactcaattttaataataatactttgcattctatagaatcaaaaagtgtgctgaaatatttgaaatactatgtcaatcttctttaaaaatgaatcttaaatatggattaagtacagattattttccagtaacattactattaacctgaatgttcccatggtaacaagacatctaacagaatataaaacagataactttcaatatttaaatcataactcataaataaaaacatgtctgtagttgtgtgaaagttacacattaattccattgataagggatgcagaaatctccttagaaatcatattttttaaattttgcattaattttttataaccaatttctgattataaaagtaaaaatgctttctgtaaaataaattgtaaaaaatagcaaaagaataattaagcctgagatgagaaccactaatctttgttttaatcatttttgtatgttgttttatttataagttttaaaaacaaaatttggttcagagtatcaatttagttttgttgccttcatttgttacttcttcccatatcagttatttttaaaatttgctttatagatggtagattcatgatagtctctacaatgtaaccatatacttcctgcttcagtcatttttgttttttagtcttgtccacaataaatctaatacttggagttgcgaagtcatactccatgccctcaaaaaataatgactaaaatggtgttaaatttctttatgtccattttttttttactgattttatcaggtgatctctataagcattcaaaattgactaaggatgttttagactaattagccctcactacacatttcctatgtctaaaatacagtaattgagaaatgttgtaggaacacaaccaacctaaacaacctaacttgtgaaagagaatttagggagagaaaatgccttacacgaggacttctttgttattaaatacatctgatttccataattttaactttgaaacagtgtcaaataccagacacacacagattataactgtcctatcatggtccatttaatagcacagggaccgtaaaatctgacagacccaatttactggaatgtaacctcatggtcagccagggaaatgctgactttgccttttggttgcaactagcagcaaggaagataaatttacactaagttgaagaaggcctccatccattaggagaaacgcagctggggaccaggaactgtgggaactaggaatggaaagatttgggaaaatgggaagtcctttttttcccccagaagtctcatgtcagccgctctctatcccttgatgtgtggttgttcctctgcctagagagcgccttctctgctcctgggtccatagggcaagggaagatggctgcccacaggtctgggactcacgggaagattcacgccctgtacatccaggaatggattctccctcgctcccgttcacgaggtaattgtctcagcttgactcaggtgcccaattttgtgcccatcggctgtgaccagggagcagagtcaccttgtaaaagcctcagtgctctgatttcccactgattattgaaggcaggagatggtatgacgctcctgattttttctgctgtcatcatgtggctgaaccgtaggttctgaattcatacaaagtatgattttccttttactattttttaatttttgagaattgtattaatagtagctgaataaattttccttgtatcttgtgtataaacttccagaccaaatttttctttgggggatcttagtgtaggtgttgttctgcaatttgtttttgttttgatgcttaaaatgtcatacatattagagttacatacttttaatgaattaatttttagatgtatacaagtaatacatgaatgcatttttattgttaaaatctaggaatacagatcatatggatgaaaaagtcaaagttctctttcacacacctggactatcattttttaccttattaggactgtggtttatatatattgctctggaacttgaattaatgtataaatatatactcgttatttaacaatacatagctttaaaacagtacttaaaatacatgtccagaggaaaaaacaaaatcctctttcaacatcctccttctacaagaattcaacttactttccccaaattgctattaacagtttgatgtgtattctggattttttttctacgtatttaaatacacacatccatgtaaaaatatacagttggggattttttaacataattgggatcacagtgtagagattaaatagaactctgtttattagaaatttacagatctgtgttgaagatggtttcatgtcagtatctgtagacaacttataaagttctgcaaagcattccatatcatagatgtttcataatttaactattccttcattggtcgatatttatcatttccatttttcactattaaaaatatcgtgatgatgaaactatttgtatatatttcttcatagccatatgaggatatttttctacatcaaagaaacaaaaatattacaaaaggatactccagaaaaggctgtaaacatttcatttctgccaatagtgtatgaaagtgcacatttccacacaactttgccagtcttgggtatcagcaatcctttttaatttttgccagtctaaagagttaaaaatatatagctgaactttcttttgttataatttgtgtttcctgataattagtgagaatgggcatttctttatatattcgttggtcatgtatattttttcttctttgaattgcctactgatatattaatatgttctttttttctcttgaagtttttactctatttttaaaaaatcaatttgtaggaataatttgttgatctgtcatatattttgcaaatatttcccagttttaactttgttcatggtgtttcatcatatgaagttttaattgtttaagcagtcaacactattagtctttttccttatggtttctagatgttctgtaatgtttacaaagttttttaccacaccaattttataatgtattgtctaatttgtaaataagttgatatattttctaaatgtccagcttttaaaactatctagaattatttgtgtatgttcgtattgtaaattggaagctattttactctaaatagccaattgtcttatttatgtaaatgactaatatttacccagcaatttgaaaatctacctttcttataaattaaattctcatatataattgatctgcttccagatcttattttctacttatctatcactactcttatgacagtgctatactgtttcagctatcttaacttgatatatgttttaatatgtggtttttcttttttttttttcacttttcctgaagttctcacatgtttttcttctggatgagtttaaatatcttccagtgaagttccacagggtgtcttttgtggatgtctttccaatttccttccagtttcctataggaaaaattcccacatgttggaaaactcacctgtaaaaccatctgggactggtgcctttctgagattgatctttggctatcttccaggctctttggtagttattgatctattcaggttttctatttctgcttcattcaaacacaatcatttgtattttttagaaatccttcccttttatctagattttcaaattttttatataaaatagtcttccttactcatttcttatgctggtaattttctcttttcacattttttgttgttgttcttttacttttttcttaattggacatgacaaagattagttgaccttatccatgtggataaggtctcctctgaactgtgttgctttgcttccccaagtagtcccttctccaaagcaagacctaattgtgtgctatataaagtcggcagggcattctgaccgccaagttccattctgagcaggaagaagtcaggcaggctggtgacctcccctgtccagttaccaaaatcgagagggctttaatctggggtgtagcccattggcattattgatcatatgtttcctttttttttcccctctgtatctgtggtggagttccaggggagtcatccccagctctgctcagcttctccagggcaggataattctctgaggggacctcggcctcccatggcagattattcaccctccagagagggtttttctgattttatccaggggcaaacactgctaatccccgccactcagcttaagtggaaagggagaaaggaataaggtgcccaactggcctagctatttcaagaatgtgttgactctgagctcggataatcactgaaattccttcaacactgtaaaattttctcttacccgtgttttagcctgaggttttctctaacctcgtttcttcgtcaacctgatttcatttggtttctatttatcttcccagcaaatttcattttctgggcattctttctcattttctagcactgatatagatttactcttgagaaacaaataaataaaagcatttctgccatttccttaagggtttgcaagtgagaaagggtgtatacatgtgcactcttccacaacttttagtctgtcttttaagagtttgtttacaccgaactaaagaggatagtccaaataagttatgatcaaaataaagactgaattaggaacccttgttgtgttctcatttcactgtgtacttcctttcttaacagttaaacctgtgtaattgttaagtcgcggtgacaacaaggactgcatccgtctcgtgtgtcatttgtatccctcgtgcacaacgttgcctcaaacaaactaagcattccataaatactggttaaatggagaagtggatcgattatttcatgcacaaaccaaaaatggagaaaatcactaacacgatctctggagggtttggtgcaagtttagctagtgacaggaccagagccaggacccatgtgactcctcctcgggtgctctttccactgactttcttgggctatttgctttattaatgcctttcttccaatcatcacttaaacaaagacaagtgaaaagaagtctgactttagctgacaatggcagaaatcatcactctgctgaataactaacataaacatcaacttcctacattagcacttcaggacatcagctcaaatagctccatcccttctttccctgctattgtgtcccttattagaataataaactgaagctcatatctcctctctgattatgttgtaaactttattagcatttctggcctttaatgcctttgcaaaggaaaagatggtggttagactctgtgtgggtgtgtgggtgggtgagtgtgggtatgagagggtgggtgtatagagctcatttgtttgttgttttaaaaatttaacatctgagttagggagaataatgaattggtaagccactggtttcctagaataagactgtttctttccagagaagagtaaactggcccttttcgattttgttctagcaacacagtaaccatggatctgtgaacctaatagctaaattgtggtaatcacagaacacctttctaaaatacactttgatataatccatttgtccaccaacagcttaccacaggtaaatagatgttatttttcttgccagtgattatgctgcttatatgtctaatgtgaacgatgggctggacatagcaaaaatatttttgtttgcttttattgtaatttttgttttcttactttctggtaaactctggacatagtttttttgttaggagtttgtgctttaatttttttcttctacagattaacatgaaggtgattattaccatagaattatttaccaaaacacttattataatatagataaggccctactgagcttgttcctgaaaaggcttatgttatgaataaaatgttaattgttatatacagtcatttctatggaatctgggatgttttcaggttgtaggtcccgataaaattaaatatatctaccttatattaagtaaatagttaccaataaaatttttaaattggcattcaccagtttctatttagaatggtttgtacatgaaaaaaaaatgatcaactattttaaaagataggatatgcaatttcagtttagccagaaaatacttctatagaaaacagggcaacctgccacagtgtctcagattgggcttgtcagaatagcatcgtatcatgaaatcatggaatgctacagattgaaattactttgaagatcttttagtctgcttttatatgtacagtggtgtgaatttgctccatgacccttgaacataagaaaaaataatgtttcttaacttttctgagtcaaatcaaatcttgctaggccctcacctcttaggattgttgaaaatctgttcttcctcatttggaaaggtgggcctttccttgagccctgtaaaaacccagggtcatacacagtgtagagaactctgggagtgatcttctggcctgctatcaaggtccctgggatgtttaatttgtcacttcagctaggctatggtgtccagttgttcagccaagcaccagtgtagatattgctgggaagatattttttagatattagcatttatcagtagactgaatataacaaattgctcctcagaatatagggaggcctcatctaattgaaggccttaattgcaaaagctgagacttcccaaagaagcaattctgcctcaagactgcaacatagaaattccgcctgagtttccagccttcaggttgcagactcaagattgcaataccaactcttccataaatttccaggcagtgggcctgctctccaaatttcaaacttaccagccccctacaatcatgtgagctaattccttaaaataaatctctctgctttggttctgcttctctggggaaccctgattaatacattcccttttgagctcttcactggccacgtgttgcattcaaagttggaccactctgctgctctcaacatcctcaccctctttggtaagtccttgcccctgtgatgcttgctttggtcgtcaaagcagcagcccttaaggttcagtcccaggactccacatgctgcctcgccagaggtcctgctccatcctgaggccatgtgatggcagagttctaatttgtgtcactttggggtctcactacttttctaccttctcaggctctgagaatccagctcttccccaaggttgagtcatgccccaaccaacaccttcatatccaagcattagaatctatccttttccaccgacctcaactctgacaccttaggcagaaccaactacctctcaacaaagacctgagtgaggatatattcaagaaggattttaaaatacacacaaagctgtttctttctctttgggcaacaaacccagaacacaaaagcttgacattatgtactaggaaatttactcttttattcctttgattattctatatcagtaagaacagacacgaactaattttcgttaaactatcttgctttgaatgtaaggagccaagacccagaaaagttaagtggcttcctcaagtttcccagaacactcctttaagatgaataagatgctatctgatgccctatccctcccacttcccactccttcaccttacatctggctataagcgactgcatgtttctgcaagttcatggaggaaccagtgttgaaactgctttgctacttcggtttgaaatggcaggttggaaattgatgcatcacagtttctggggctgttggctgccagagcctccccatattattcagccacaggctttggagggaagagggacccttctgaaatatgcaacttagtgcaagcttgaaattcagtgggcgccacttggcattcatgattagaaagttctaaaaagcattacatgaagtataactgctttatccctccttttgataagtaatcctctctgtttttgtttttgttttttagtttaccagctcagtagaggaatgatgcaaaatggggctttgggctgcggcattataacttgggttcttcctatcgatctcacaggctcattatgtaagcttatttcttctgctgatacaggagcaaaaaaggctgacttgtgacatttttgcagttgcactcagttgtctaaatatactcagacattcaacagtacatgagtagccagccatttggttttgcagccaagaaggctgtggctgaggattgcctgagaaaatatctgcttttgatcaaaataaaattcaaaccgtaaaccaatatatatatttcattgcctataataatctttgtcccttagggtcataataaaactgtcagctttatgtgtcactggatctcactcacttctccctttccctcacttttgctctcattattcacctactttgtagctaatgatttctaaattctggttggtttttttagagatctgctttctgtagaggttgtcgtatgatgtccttgaatttttttatgtttaattctaagagagtggcataagttcatcaggcatgaggacatagagtgtgaaatcagaatatgtccccttgtcatggcaccatgaaatacatctgccaggagcagaagtctcaagatttccccaaaatctacttctgccagattagcacctgtgaccactgccttgtggccacacattgcaagtattataaaaagcacattgtacaaaattaaaacaaagctcaaatcctagctctactgattgcagtctgtttataagtagtgtgtaagttacttttcctctatgcctcagttgcctcatgcataaaattggagatttaaaacaaaaaatttacatcacagagttgctaagaggctttggtgaattagtgcatgtaaagcctgcagaatggtacttggcacattgtaagcactgaattagggttacagcagtccctgcttatttagggggaaatgttccaggacccttaattgatgccaaaactgtggataacactgaactctatgtatcctgtggtttttactgttcatacctatgataagttttaatttataaattaggcacagtaagacattaacaacaataactaatgataaaataaaacaattataacaatatcttgttgacatggtttttctgtgtccccacccaaatctcatcttgaattgtagctcccataattcccacacattgtgggaaggaccagtgggaggtaattgaaacataggggtgggtctttcccatgctgttcttgtgatagtgaatacgtctcaagagatctgatggttttataaaggggagttctcctgcacaagctctattgcctgctgccatataagacatgcctttgctcttcctttgcctttcaccgtaattgtgaggcctccccagccacgtggaactgcgagtcaattaaacctcttttgtttatgaattacccagtctccggtatgtctttatgagcagcatgagaacagactaatacaactgtaattaaagtcacatgaatgtggtctctctctctctatctcaaaatctcttattgtactgtactcacctattttcggaccatggttgaccttgggtgactgaaaccatggaaagagaaactgtgtataagcaaagactattgtagttattattaaccagatttttgagagacttttgttctgttttactgaagactaaaatagagtttacaagaaaaaaagtgtatgtattatatttggctctgttatgaacactgatctagaacatagtaatattcctttggtttcctttggataaaagctgtatgcttattctaaaaaagtctttgctttcaggcaggagtatttgagattcaccctcaacaagtggtttttgagatcactgtagcttcaaaaattcttcagatgattgtctagattcacaaccatttccttatggtttggaaagaaaacagagaggagataaaagtaataagcttggcttaagatgtagaaggtttaaattctaggctttctttggctgcgtaaaagaaagtctctgagatttagtttcctcatctgaaaattgaaggtgtccctgcaaagaagctatttaggaaacaattctgttggagcactaatttataacatacaattttaagttctagatatttaaagagttaaatgtgagagtaaaactatttaagtattaatataaagcatagatgaatatctgatatggcataagaaaggtctttctgtttagggcaatgaatacacaattcaaaacaatatgtttacataaatacatgaatgcatgaagtgtgtgtgtgtgtgtgtgtgtgtgtgtaaagcttacctctcgtgggggagtggagagtaatgtgatcaaggaggggtccttggcgacatcaactctaatgttagttttttaatttcttacatcgcaagaaacatctgaaaagggaaaatcgagttatcaaaatttttaaaataacttctataaataaaaaacttaaaatataaaggcaaatactacaatagcatttttaacaatgtagcagggaaatatatatactatataaacaattcttaaaaactaataagaaggatgaaaataccattataaaaataaataaaagaatacaaagccaatcacagtgtgtggacctgatatggatcttgattccaagaaacaaactgcaaaaaaaaaattagaagtataagacaactggaaattttaacacgatatctgctgaaaacaagaattattgctaatcttttcaagtatgatcatggtactgtagatgtgtttaaaagcatccttaatttttaaagatacattcgcagtcatttacagatgaaatggtatgatatctgggttctgcttccacataatacaggggtggggttggtggattagaggtaaaactaaaggaagattgtccatgagttgataattgttaaatatgtatgatgggctcgatattctgtcaacttttgtgtagtgttcaaaatcttccataacagaaggaaaacaaaaagcgtaatactgtgtaggatgatgaataaacaattcaatatgtttacatagatacatgaatgcatgaagtgtgttctctgtgtgtgtgcgtgtgtgtgtgtgtgtgtgtgtgtgtgtgtaaagcctacctgccaagggggagaggagaggaatgtgatcaaggaggggtccttagggacatcaactctactgctaatttttttatttcttatgttgggcaaaacataaagtggtggttgttatattattttttattttattttgtgcatctttgttattcctttatatgaaaagatatttttaaactattctgtctccaattttttttcaaaaatagaaaaacatgtttgtttctgtttttttgtttgtttgtttgtttgtttgttttggagacagaatctcatgctgtcacccaggctggagtgcaatggtgcgatctcagctcactgcaacctcagcctcccgggttcaagttattctcatgcctcagcctcccaagtagctgggattatagtcatgtgccaccaggcccagctaacttttttgtacttttagtagagacagggtttcaccatgttggccaggcaggtctcgaactcctgacctcgaggtatcagcctgccttgacctcccaaagtgctgggattacaggcataagccactgtgcccagcctaaaaacatgttttttaataaaagaaaaaaataaagctaaccattagctattaggaattttagctaaaaggaatacaaatttagataagattccatgttgttttttttcccagcagattggaaacgattaaaacattataataatcagtgctggctaaggcatagtgaattagatatccttacacactgctggaaataaaaattattttctaacattctggaaggcaacctgatgtacaaagcaaagtaattccattcctaggtagttattccatagaaataaccagagagaatcacaagatttatattcaagtttgttcattgcaattctgttttacaggaaaattggaaacttcagtgtctaacactagaatgtagttaatacatgtatgatggtatgttcataaaacagaattctgtgttggaattaaagagtcatgtttctaatgacatggaaaatatgcttgacatattattaaatttcaaaaagcaagataaagactgtgcgtatagcatgattccatctttgtaaacaataaacagcatctgagcgtgagtgtggtggcagggctgtctcagtttgaaattgtgtgctgccttctgagatgtaagcaagtctgggcaggcctaaataactggtaggtggccttccgggcttttctcagtttgcttgggggaatgaaggaacctcctagaaaataactcattctaagcaaaaagggagttgtagaaaacagtgtgactgtaagactaggccctgggatgagagactaccctaattctagtccaggggtgtctgaatcctgcatctgcctgggctcaacctctgggatctaggataggagctggtcttgggagacagaggacggtatgcaaaggcaggaagagctgcttaaaccaaaagccttgcaacacatcagagcaccaccgtgttttggtgtgccacagcggaatgtaacacagatgtgaaggagggctttctttgctgcctttctgttggcctgtgcccagcttggaaccttgaacgcttcagtgtgtgagggccattcttgattgtaaaaagcagccaggggcctgccatgtgggatccgcctgggctagtgcctgggcacctgtacattactctctagaaaccacagaaacatgttgggagcagggcaagattttccaggggactaaggtcctgcatttttacaagccagtaaaacagaggtgacactatcgaagtgaccctgtgtttaactccagatgggatgacttgaagaaactcacattacacatatatgtatatatgtccagaaaatgaccaaagaaaataaatcagaatgttatttgttcttattataggtgattttagtttttctcatttctgtgtgggttgtgatggtatcagtttaagattaaatatctctaccactgagatccagatatgacggagcattcctgaaaaccttctggtgagtgttctatgatcactatggtgaaagccccaggtttctggctcactgaaggcctgaggattactctaagatattttactctgaagaaaaagaaagcagatttgatgtttattactactgttattaggaaaatattgaatatgctatctccattcccttttaggtcaaatattctatattattttataattctgtgaaaatgtttataggtccataattaaatatcttagactcatctaggaatatgaatgtataataaataactcctgttgtacaggttgcgtttggctcacaaaattctctttatctcctagtagaattcactaaaatagtcacggagaccattgatttaagtacattcttaggggctgggtgtggtgattcagacccattatcccagggatttaggaggccaagtaagaaggtatgctgcccaggagtttgaggctgtagtgagctatgatcacaccactgcactccagcctgggtgacagagtgagaccctgactctaaaaactaaataaataataataagtaaaatattaacataagagatccaacagctagaaatatctataacaataaaaaacaataaaataatttacttaaattgtttctatttctgccagtcttttcaatccctcacatatctggaagtggctctgtctttattttagctattagtgtattaaactgttttggatttctcagtgaagctgaaatatgaaaatgatgcttttgcatatatcagggaaccatgtctgacacaacagcagtttcatgtgatataagataaatgcattaaggtttcaaggggaggagaagggaaagatggatcttctgagttacaaaatttgacaaagacaatttgaatgggatactaataacttgtattttaaagctgtcaaagtcctgcatttactatatataaagtactcacagtctttgtctagaagagtaccacattaagaatattgtttttagttaagattttgagcttttagaatatctgttgattatggaagaaccagccttttgattaagattattcctacattgttcccatatttttccatcagcattcatagttcgttattaatatggtgatcatgtttgtttgggtgaatggcctttatcatatttcagtaatttcctttgttttctactttacatttagcattaagagaattttttatcacaacacttttggtatctatgatatattcatggctcttctcctttagtttattgatgtagtcattagactgaaagaattcctagttttgaatcattcacacattcctggaaccacctacctgattgtgtagccttcttttgatgtactgctgttctatttgttaataatttatttagaaaatttgcatatatatctgttagtaaatttggcctacatagcttttgttcttgttgctctactagctgtattggatgttggtattaaggctatattgattttataaaatgagctagggagatttcctttccacccctatgagttggcatcattaaaataagtattatctattcttccaacatcactatcagtttaaaatcaatatgggcctgatgctttttaaatggttaagttttgtcatctttccaaatgcttataaaggttttgtttttgtttttgttttttagtcaagtttctttttctttgtggtcaaatgctgtagatgcattagtccggatgggttatgctaagctgaagtaacaaaacatgcaatctcagaagcttaacacagtaaaaatttatttctagttcacatcacagtctgagatgggtcgtcaaagagccatccttcaacttatagctatgctatccggaatattctaaaatcatcattaaaaagggctaaagggatgagcaggctatgtttaggtcctaggccctgaaagtaccctgtatcacttgtatattctcacatctttcaccagatcccttcctcatggtcttagcctaataatgaggcgcctcagtgcctgtaagaagaaagagtgagaaaatgaaatagcatctctctaccatataagttatattttgccaggaaattatctagttcccctagattttaaaattcattgccatataattgatgacagtggtgggccatctggagcagcggctgccatcatgccagctgcaggggggaggcgtgagtggtggcagcaggaatggctgtgggagcagcggtggtggtggtgggtcccctgtgccctgtatcccaaggcagccaactgcaccacccccacccttgcatgattgggcagggccagctcctaggtccagagcctctaccgcagcctcaacctcactcctccactgtgtcccaggggcccgcagcaccttgctgaaggcgaagctggggcccgcggggcccaccctgggagcatgaggtggtttctttgtacaaggttggccagggatgccatcctgggagctgctgcaatggggctgggctgagttgcccaccagcagtggagcagtgcagtcgggcatgggggtgcaggcagagagggtccctgaggtgaagctgggcccagggcgatgctgtgctccatggagctggtgggagtgaggaggaggtaggaggccccctcctggcatggctgtagccacccaggttgcggctgtggacctaggcatctctgcactgtcaggtggccccgggaaggtactcccttgcccctgaaggctcggaagtatctgttcctgctgcctggcctctcctcactgtcagtgcccactcagatcatggagcaaatttgaggccaatcccgggtgccgtggcaacctggtcggatgtgtgcacactgggagcagcactgacataccaggcaccagccacctcggccccctccagactttgcgcaccagtgagcacaggagagaggccaagggggtgctgaaggcagcttgattctggcttgcaggcaccccttggcacaaacagcctgggcaccatgaagagcagcaggaggcagacaggggcagaaggagcaggtccctggtgaagccccaccttcaaaccagggaagacctgaagcctcggggctaggcttctggtcccgtggggaccagagtgggaaactgtggtgccttttctgggcccgcccttggatgcccatggaccaattggtgcacacttcctcccctctgaggcccataaaagtcctagactcggccagactcaagaaggcaatgggaggaccagctgcagagaggaactgcccacctcagggtctcctctctgctgagagctgaggagatgacagaatgaccagctgcagatgggagctaccctctctgctaagagctggatactcattgggaggaactgcctagcagagaggagctaccccctctgctgagagctgaacactcatgggggcaccttggctatggagaggagcgggtctcctctgagctgttctattctcagtaaagctcctctttgtcttgctcaccctccagttgtctatgtacctcattcttccctgatgcaggacaagaatttgggacccattcagcagggctaaaagagctgcaacacaaacaaggctgagagactccccttgcctgccacgttgcgggtgtcaaggagagaagagacaaggagggaagagctgtggcccttcaggtatcccagacctaggagctcctggagccagggctgtgaaaccctctttagggctctgcggttcctggcgtctccaagcttccgggtgccacaatcacattccccagtgtcagctgtggaagctgatttatggtactcctggtccagctgcagcctccccgggagctggtgcccaggccagcacctggagctgcccacaccaccgcagccagtgtgcctggctgtgcacagtggccggaccccacactcgctcacgcaccccctcacctctcagtgcctggcttgcccttggcaggtgtgggatccaggccggtagtggggtctaggccagtagcaggagccaagggcaggctgccaggccgagtgggcggaatgagttcagcaggccagagcaaaactcagtcaaaggtgcacccaccggccatagaggtttcaggctggcagagtgacaccgcgaagatcccagaattgtgtataatgtataatcattttaattgtatccctatctcaaattatatcttctttgtcattcttaattttgtatagtttttttctcttttttccccttatctggcttacctgacatctgtctattggtctttgtactattccaaataaatgaattagtggcgataagcaaaagaaagttcctgctcccataaaatttttatcctcctgcttttgttcaatctattttgttgtttcttatataaatcagatgacttttaattttttttttttttgagacggagttttgctcttgttgtccaagcaggagtgcaatggcaccatctcgcctcactgcagcctccgcctcccaggttcaagcgatcctcctgcctcagcctcctgagtagctgggattacaggcacccgccaccatgcctggctaatttttgtatttttagtagagacggggtttcaccatgttgaccaggctggtctcgagctcctgaactcatgatctgcccacctcagcctcccaaagtactgggattacaggtgtgagccaccgcgctggccttaaattttttttttaatttttaataaaaactttgaattttataaaatttattccagccttaatgtattccataggttttggtcttaacagttctcattttctttcctttttagatcactattttcctttggttttgatgttttgattttctctttaatttaggattttaaaaataaaatggcacattttcatttccaaggaattaaattttttgatgattatatcttttttatgttgaattattatcagataatgtggcctgtaaagtttctactttttagaattgatttaatgttttctttgtggccaagaacacgattgattcttctaatgttccacagatttcagtacagaatatatgttctctgatggaagacatagttttatacaccttgtagattgtactattaaaataatctatgttcttatttattatttatctacttgatctatcaaattctagaaaaagtatattaaattatttcactatatttctttaaagatctagctgcacttatagaacctttgtacgtatttgatgactacactattttgtgcattaaattttatgcgtaatctatggaaaaaaactttcttgagtctaggtgaactgcatctctcaccattaaacaatgcctctctcagttctgtttaatgtttttggccttgttgcttattgatattttcacacctgcattcttttttttttttctttttttttttttttttgagacagggtctcactctgtcacccaggctggagtgcggtggcctgatcttggctcactgcagcctccggctctcaggttccagtgattctcctgcctcagcctcccgagtacttgggattacaggcgcacaccactgcgcccagctaatttttatatttttagtagaagcggggtttcaccatgatggccatgctggtctcaaactcttgacctcaagtaatctgcccgcctcagcctcccaaagtgctgggattacaggtgtgagccaccgcacctggcccatagctgctttctatttgcctgttttgctggtacaggttgaacacccctaatctggaaattcaaaatatgaaatgctccaaaatctgaaaattttgagtgccaacatgatgccaaagtggaaaattccacacctgacctcatgtgtgggttgcagtcaaaacgcaggcaaacgatgaagatgacattgttaacactgcagaaaaagtgcctatagatgacatggtgaaaatgtgtgatggacttattgaaagaatagagaagcatgcattcatagagaacagggcattatgtcagttcataaactcaaagagacttctaaaacaaaaactgttattaatgaggcagatgactctggagcagacattttaaaaagccatctggcagaacacctccttatccacagaggacccacttctaggccctcacctgcctctgatgtttattctcacctaaaacagaagaagaatgcagtgtacaacaacctttaatcaaaacacagcattttagttgcagttgcagactgaaagcctgccatagtttgttgttgctgttgtttacagctgaaacagatattccatgctgcttagttaccctgaacacattagtttttcactgtattaatggtaggtcatattttttagtgttaagtacttgcttgtgaataaatgtaagaaaatgattgcttattggtagcatatacattcagagtcaggagtgatggtgttgccagacaaccacagattgtccacatgtatggctgagatagtaacatcttccctttctgatggttgaatgtacacgaactttgtttcatgcacaaaattatttaaaatattgtataaaattaccttcaggctatgtatataaggtgtacatgaagcataaatgaattctgtgtttagaattggttgttgttcccaagatatctcattatgtatatgcaaatattccaaaatctgaaaaaa

SEQ ID NO: 591 - DNA, 20001 bp, Homo sapiens
gttaagcttgtcttacattaaagagcatttacacgataaaacccatagcagtggatcaaaaactcgacaaatcgctgtacatttgcctcagtttcctcatctagaaagtgaaggggcggtctggatgagctctaaagttattcccgttgcttaatttctcaggattctgaactctgtgataattcagagccccacatcctgaaggcttaaatcttgggtctctcaatgttttgagtaaagaagacagtgatagcgaatgtttactgtgcatggattacacgccggacactgttttaagtacctcatatgtcctaatttatttaaccctgaagcaattcattgaagaaggtgctcttgttttcaatatcctcaatttaaaaatgaagagactatgactcagaaggtcaacaaactcacctaataaatactgctaataaatggtagagatggaactcaaaccatctacctgtagaactccaattcttaaccactagaccctatttgcttgtgaagttaggggctttgcctagaaatgttgtgataaagcaaccctgtccattcaagtagctgtagacataaattgccacacgttgtgagacatgatgcagacctcaaccaaacaatctgctccacaattcagatcagccacagcactttaacttgtcctggctacatttttggacttttagccatttcgttttcatctatcatgcataaattcccttaggcatttgaatcatttccttcatacaaattcagaaatcttgcctatatatgaattctttagctcagggactggcaaactttttctgtaaagagacagataggaaatactttaggctttgcaggcagtaaaggctgtcacaactcctcaactctgctgttgtggtttaaaacctggctgtagtttgccaacccctcctttagagaacttggaattctctgtaatggtttctttggataagccaaaggtgtaatagttgaagataaatttccctgttctatatgtgaattttttttttttttttttacaattctggattttagagcctaccctaagcatatgatcccttaattttttaaaaaagttcccatttatatcaaaagtaattctttaaactttgagaaaaaaaattcacaggtacggttatgtatcttatataatcaaaaagaggcaaagtgctatctaattttgaagacattgctttaaaaatttttttttaatttcctctggttgtttcagtatactagtagatatgccagtttttttcttctgcttctgaaagaaatacgtactttttttctcctaaggagggctcatatacatgggttttgatttacttaagagtaacgctcaaggtcatatttaagtactgttagtattgcattatgttggtactaaagtgcttaatggacgctcagcattattttttgtatcctgatttagcactaatgttggattattgctgatctatgcagctttacgattaattgtccaaattagttcaaggcaagcctgtgtgtgaaaaaaaagttcaaaactctgtatgttatcagagtgccgagggcacgttcacaatcaccgtctcctctaaaggaacacagcctatcacctgaggctcttgttcagactggggcagacagaacctgggctggaggcgagggatcaatctagacaaagagttaaatatttggtatgctgcatagcattgaagacaacgtctgcatgcagctgtattcaatttttagttggattctggcacacagggacaaaggcatttgtctgaagataagagtgacatacttttggtaacctaagatgtgttgtgatgaaaatgagagaaagcaaatagtatgagttaagagcagtctgatctttttggcttctttacaatgtatgctttaataaatttgtttaaacttgacttgcattcctttatttttatataaaaattcatagtgcctaacagtgtcatgaatgctgtttaaatgaatctggaatctagaggaaacatatgtatacaaacctagcaagtgttatggtctttggctttgcaaagacaacatgacatagaatgtacttattgcgttaattaaatgataacataccaagacaatttattatggacatatttagcctagtttaaaaaaaacactatgataaagttagaaaatctaggacttgctagagatgaaaattaactggtttttaaattaaccggcagagggctgtatctaaaattaaacttatattactttcactagaggaaataccatgtgagagcttttctaaatgaaccctttacttataggaagttaatatttcataatgccaggagaaatacagcagtaatacattttcagcaagtaggcacttttcgccttaagaaaaataaaaataacttgtcagttacacaatcctaaattttgtgttgttttgattttaattacaatagtcccctattatccttggttttgctttcctaggattcagttacccaaagtcaacaatggtctaaaaatgcaaaatgaaaaattccagaaataaacagtacgtttataacattcaaatctcatgccatcccaccctgtactgcccaagataggaatccaggaatccttcctttgtccagcgcctcagtcctgtttgtgctatgcccatttagtcaccgagtagcagactcggtgagctcagatcagctgtggcagtatcgctgtgcttgtgttcaaaccacccttcttttacttaatgggccccaaagtgcaagagtagtgatgctgacctatggttataattgttctttttttttttttttttgagacagagtctctccctgtttcccagtctgcagtgcagtggcgtgatcttggctcactgaaatctctgcctcccagattcaagggattctcctacctcagcctcccaagtagctgggattacaggcgcccattgtgccaggctaatttttgtatttttagtagagatggggtttcgccatgttggccaggctggtctcaaactcctgaccccaagtgatccgcctgcctcagcctcccaaagtgctgggattacaggcgtgagccactgcgcccagccaattgttccatttttataatgagtgctgttaatttcttactgttcctaatctataaattaagctgtatcatatgtatgtatagataagaagaaaacatagtctatatgggggttggtactgtcctcagtttcaggcatccactggcagtcttagaacatacccccctcaaataaggggagactacggtattataaggttatactgaattctgaatcttaaactatttcacagaatcatctttgaaaggtaagtattatttagaaagcaaaacttcaaggtgaaggcttgtgaatagaacctcagtgtatatcacagagtacgaagtggtcatgttctgcctccttagctcaactcgtaccacctcttgatttttttatgaccaggctccaggtaattatttcccatctgttcttggtttaacactcctgaaaatcaaggaatacttctgacttagacttttaaaaaaattttgagaatatatttactatccagagagtactgatagataattaaataagatcaactgtcccctccagccagccttaaatctgggagcagatggccatcccacaggccacattagtttgggtattccaataaactgcataatgaaaaagaatatccagatttttttatcccccaaatttaatttaaattgtattaggaaataaaatattgcatgtcaatacataggtgcttttctaaatcatgatgtagttttactcatatacgttatactcttcaggacaaaagccagcaattgcttatagtccaaaatacaattattagtcaaatatatttttcagtatcataaaactcctaaaataaatctatacgtactgtatttttatatttactagcatttgttttgcaaggccctaaaatttatagaaaatgtaaatcacttttatagttcataaatattctcaacattacttgatatacaagtatttatttatctggcatatataatgtttccataaatacagctgtatttatgtaaataccctatccatatatactacatatggatacctcaacttatggtccatatggacctttatatttaaactcagtaaaataaataatgtcaacaagcttttaaagtgccaccaattaataatattggtatatttttattcagacatatttgaagacctgagaataattacgtggtatttcctgagtatttgcacattgtattatgaacatgtgtttgattttttcagtaaactcttggtacccatatttctaataataaaattttctatctaaaaaaaagttgattagctgggagttttaccattaagactgaattgattaaatgcaaattaatgcaagatacaagtaatagtgctttaaaataagtacagacctgcattttaattgaaaaatacccgcaaagaactgcttcatactctatgctaaatctcccagtgattttatcagtatgctacataacagaagaggagtggtcacgatgagcaatgaagataaccaatttcttaaattaaaaaatactaaggagatagcaaagaactacccttttcttcctgaaccaacacatggctcttttctgttgcctctaggccatgcctcccatccattcatttgacttaaattacagccaatttaactaatttgttaggaatattttaaagcataagtgccatacacaacttttacatttatttttcataggcccttaaaacattcgatttgtcatcttttctacattagaagaggtgactcacttccggtttactggtcaagaatcagtaaggcagaaaacaaacctatattccaaagtttaattcaagctttgttagattgtacagattctgatgtctccttcagtttccttctaaagaatggtaaagtttgaagcagtgctctctgacaggtcaaatctgccaagccaaggaaatatatagatgccctggtgccatacatttctctcatggcctctttcctctaagtctcagtaattggattgtcacttgggtgcctgacacaggaactctaagaaaagatggcttctcaaggaagggaagggaaagccctgtgaacgattagggtgataacacctcccatgctttgggctcctttgaaactcaaattccagaatgtgagcctgtgaactgtagcaggaagctaaattaatatcaagcaggagctaacttagggttaattctccaccaccaccagtgagtagacctgttaggttatattcctgatcagatcaagcagaaaagggtagcgaatagtatattttcaaaggtgtgtcaaagtaatagaagtagcaaagatccaaactgtatcaattgtatccaaataatactttctttttctttaggtaaattaccttttgaaaagcatgagaattttttttttttttacatatcaattaatgtttccttccaaaagcttcattcattaatttcctgcaaaagaaaaactttgctctgttggatatgtttcttaatgactctgaccttttagttaacactgcatatggataaaatgctttatcatcgttaatgaatttttccgtgtaacaatccctttaagttgaataagtaatattattcattatcattaatagtccttactgtcagaaacaaacagtacaggtaatatcaaaacaattctaaatgtttttaagttacattccattattgctttttaaaaaaatcaattcccatttctattgaataagtcgattgcttaaaaatactcattaagaaactattatgcaccacacattattctgatttaactagtctagacatgggcatttctaaaaatctctctgggtttttaatatgtagcctaagttgaaaatcatcgctcaggaggcctgagtctggaaggaggacaggaagctttcacaggataggtgacatttgagagagaaccaaagagaaagtaggaatttcccagaggttgaagaatggagaagaaacaaagaggcttgacacaatcttggtgggactggaccaactgttcttgggcaggtaagaaaggaagtgaccagaggaaacgagaaggtttggtcaggaccacactgaaaagagccttcagagccatgctgacaagttgaattttattcagctggtcacagggacccactatatcttcacatttttaagaagcaaatatggcctgagctgatctctgtttaagaggaaaaacctgcgaagtggaggatgaattagagtgtgagaactttgaaattagcagaggtttgcatcattcaggtgagagatgatgacagattatgattgtcccaaactgacttgctctattgtaccttggatcaccaaataaacatcatcgcttcctgtactcgatttttaaatgttatcaacaatgctgtaaatatcatgttaattctgtgcccagaagataaaaatatttggtaaaaccacaattacttttgaaccaacctaataatattcttgatccacaaggatttcaacaactaattccttggtactaaagaagcagaaaagaattaaaacataacaaagatagcatttaataccaagtgtccttttaaaaaaatctagtatttactcaacagatttgaataaatgaactaatcagtagttgtacctactcacttattactcctatagtagacactatagagaatgtacagggagtgtactactgggttggaggaacaaaattagcctaactgaaataacagtgcacagttttgtactaatgctgtgatgcagatcacaagtataggtggcattcagaagaaaatataaaaagttttggaggcttcagggagaataaggatacattttattttactcctagtggatgctcaataagtatttagttactactgcattatacggtataaatgtttatttattgctgaatgactaagtgaaatcagtcttaaaatttgctctaaagatgggcaagattttggattgacgacataaaatagggcttttgagataaaggaaataaatgaagacgctgatacaacatagaggttataataaccatatcaagaattttagttttaatgctatcaggaccactggaggaatattttgcttacagaagataaaatttaaaatgagaaattgtgtgtcttcaaatatctgaaagcgagggaggctttcactagaaactctatgactttccagaaagcagaattatgccccaagagcagatgccaacactacactttcatgcaaactgaaattatatcccttgccagtaaatttttttcatcacttttggtttttactcaaaggattaacttggtgagaatgttatagaagactttcaagcataaaataaggcattgcactaggagatcttcaaagtttgttccaactcttatagtttaagcagcaaatattagaatttgtttgggttcacgtggctaagtttggaccaaaaaaataaaaaaataaaagaacccagaaggcttctgcttagcttagcatattaataattaaaaggcagagtttctcacattggaataaaaagcacaacccaactaaattctgcctataaaaaacaaatttgaaagagaaagacacaaatagattcaatgcaataccaccactttggaaaatcctctggcagtttctttaaaaacttaaaaatacacctaccatatgatccagtcattccactacaagatatttatccaagaaaaattgaaagcatatgtctgtacaaaaacttgtgcatgaatgtacatgcaaattgtatttgtaataaccaaaacctggaaacaagccaatatccatcaagagatgaatacatgagtaaactatggtatagcgatacaatggaatactgctcagtaataaaaaggaatgaactgttgatacatgtgataagggatgaactcaacataattatggtaagtggaaaaagtctataacacaaagatgtgagcatattgtaaaattttatttatataaagttctagaaaatgcaaactagactttagtgaaagaaagtcaatagttgtcaacgggtgggtgtggtgtagtgaatgcagatgggaatgggcaggagggagaaatgacaaaggagaatgatgaaagttggggtgacgcatatgttcattatcttaattgtggcactaatttcatggacatgtaagtacatatatcaaattgtatgctttaatatgtgcagtttggcataccattgtgattttaaaaagtcaagaagttacaaagtagccatataagaatgtaatttcagaatttattcataaatgttttctttcaagagatgtaagataggacaggatgtgtagagtagaagagtgaccttacacttgataggagactctcaaaaatgattgttggataaaggctacttggactaccaccagaaactatctgcatgatcaacagacactgtgctagatatgctcgctgagccaaaggatccaaagctggcttaataggtataacccatcttcctccttttaaccgtcagcagtccaagaatctagtgctttttcattgacattttcaaaatccacccacgtggcttaatgacttagttttctgggggcgcggggggggggggaagcttgtgttaagctttaagctttctggaattctgtaaggatttttttagtagcaaaaaatgtcggcaacaatgcatcctgtgttaatgtgaattagcagagggtgattagcttcccttttccattgagttctgctctcacttctgcagggtgaagagaagtagcacaaagggagctaagaaaatgggtgccaatggatgccatctaatcaagagattcctgccatcaatatttaaggcagagcagacaactactaccagatggtaccaaccactgtagagaacaagacacagttggaacattaagccagaaccccagaattcccagtcacctgccactcaggctcatttcggtcactttgtttgcctaataataatgcaactatgggccaggcacagtggctcatgcctgtaatcccagcactttgggaggccaaggtggaaggattgcttgagtccaggagttcgagaccagcctgagcaacaaagtgaggcccctgtctgtaccaaaaaaaaaaaaaaaattagccagtcaaggtggcatgtgtatgtagtcctagctattccagtggccgtggtgggaggattgcttaagctcaggatgtcgagactgcagtgagctatgaccatgccactgcattctgcactccagcctgagtgacagagcaagaccttatctctaaaaaaattatataatgataataatgacaatgatgtactgtgcattttatgcattaaatttcttgggccccatttctgccaatataggtaggtttactgtactttggcataaattgtatcatgtatgtatgcctgtaaatgggctataaacctcaccttagaattttttcttcttttttttctttcatttgaaatatctttattaggaatcaacactatagaggggacagcttatactttgtatagttatcaaaatatgtacaaagggctaattaattggcataaaatcggtaaaataataattttccatgaagtttacagcaaagaactttttggataccactgcccttacaggcaagccccaaagccagatacctttactgtcacctttgaagtctcgagatagcttattcttattatcccttccttgggttctgtccccagtctgattgttgcctcatcccctgtcagaatatcatcatatatgcctagggcaaacttttcactcagggtgctctcagaggcatttttgtggctgccggctaatgaaacagtggtacttttagcagaatttggaggtaagcttgccttggtcataactaaccaattgtaatcaagttttggaggggatctgtagccccctatttgcctctgatcatggtggtttagcatacaagatatttcctaaatgaacccgatcgctgttgcctgcgcatattgccattggtcagttagcagcactttgttaatagaccagattagaatttgcagtccactcccataagtgctagtatacttcttgggccttcttcaaatattgctctctgttttcatgcatcttcttaggttgctctgtttgatgcttttggtaagaattgtttaatttgggctttattattctgtcctctttgagcaatttattgtattagtttagggccactggaggcacctgatcctcccctagttgatttatgaggtccttagatattgtacacttggataatgcttcagaagtaattaagcaaaatgtggctttggcagttggaggtaatcaattctcaaaaatgataaagtgcttataatgtacagttgatgatagatgcttgactgggtggcctagagaaacaatcacccatcagctcttctgctcactcattaaatcgccccatcaggccttagaaatatttaagctaagtgagaactctactcgttccatcttgtaaattggtcagaagctgtggcatggtgaattcacttctcatgcttaacaaggaaagcaagcacaagtctttcctctgtagttcattgattcaataagtaaatattcagtgcctaccatgtgccacgcactattctttgggaatacagccgtgaaccatggagtcaaaagtccctcttgggatttgcattctggatggaaaaaagacaacaccataataagtacaatattagtatgtagatatatattaagaaggaaaaacaaaagcagggaagattgaaacctcaatgagggagtttctgtttttcactaggggccagggaggacctcactatgaagatgacttgggagcaaagacctttgtgttttgggaattgtcgagtaaagcaatgtttactaccctcggagatgggcattcccccaggtgtgcttccatgtccccaagtggagcctccctttgtgcagtaatctactgcctgagccaaaagcatagggggacgtgatttactatatagcctgtcaacactcttgtcctggttagggctgaattttctggcttactttctacctagatctgaagcatctggccatgcctaccataggaaacaattgaaagaacaaaggcaaacaaaacaaattcgtttcaaatgacatcatgtggcttacagagagagaaaaatgtgtctagcatagccctgttaaatactgatgtctgctgatttaggaaaagctccttgtaaggaaagatagaatagagatgatgagactttgttggctttcctttataagttgacacgtgagtaggcgaaacattagtggctaaaagataaaacaattatccagtttttagataaactttgtaaatattcatttgcctttgggtttcactaattactgtccaacaagagaacccagggtgataagtaatcaataacacaacacacttaaaagcattttcttcattaggttgcatgtaacctaatgaagcgtacagttcttactctgttttttgggttttttgtttgtttgtttgtttttgttcttgtttttagtttcctcaccaaactgctaaaaatttatctctggcattcatttactggaatttagggcaattacctgagcataggtcagataataacttgtgtctgtccatatttaaatacaatagatgttacttatcaggcaccaaataaagtcagttttctattatgcaaattaactatcaaacttgttttaaaatatttaacctagtacatttaatgtactagggctgccatagcaaagtgccagagattgggtggcttaagacagctgaaatttatcgtcccacagtttaggattctagaagtctgaaatcaagttgccagcagggccttgctctctctctctgaaggctccaggggaggatcccttcttgctttcttggttgctggaaacccttggcattctttggcttagagatgcatcactctaatctccgcatggactgtcacatggcattctccctatgtgttccgtttgtcttctcttttataaagacaccagtgatattggactaaggtccgccctaatcccataaaacttcatttgaactacatctgcagagaccctatttccaaataagatcacattcacaggtgggagtggtggttaggactttgacatatcttttctaggaacatagttcaacccataacaactaatatcttagtgactccattgcacgtctttaaacaggtcaaatattttaagccactcatgtattgatattcataaagatgattctttactttgaagtccttggaatttgaataaaatccacctgtgcatctttgaacagtaaagatttcactagttgccagcaagagccttaggagctatcattcctcaggctgatcacatccccacatgcactttggatgaattggaaaagaagttggtgggctagatacgagaagcttgacctaatacctgcttctaataggaacacaagaattaagaggatgacaagatagctttcttccataaaactatgttctgtgttttgttagcttgttttgtcaaaaccttacttatgactttttttctatgaatggattccataggaatatgtcatttcaaaatggaaagaaaatgaattatttgaatcagctgagtcatatttttccatctccatatacaacaataatgaagagataacaggaatacgtggatagttgaactgtagaaaacatatgtatagtgatgtaaaagctaagatttcccttgccatagtaggctcaacagttgcaaaaggaaagcagaaattaagtcactggcctttcccgctgacaggatgaatcacatctgtagtgggtctttccagctccaatggttagcagttggtggtgcacacagaaagccctttctccatttctgcagctcactgtgattatttcttttttttttttaatcagagtctcactctgtcactcaggctggagtgcaatggcgcgatcttggttcattgcaaccttcgcctcccaggttcaagcaattctcctgcctcagcctccccagtagctgggattacaggtgcccaccaccctgcccggctaattttttgtatctttgctagagacggggtttcaccatattcgccaggctagtcttgaactcttgtcctcaagtgatccgtccgcctcggcctcccaaagtgctgggattacaggtgtgagccaccacgcccaacccactgtgattatttctaaaagtcacctggcgagtcagaacctcagctttccctccatcacagcccaagatacctgcccgcacttacagtctaggtttctaggtagaaaagacaaactcattttcattagctctcaatttgaacctgatgctcagggcccaggaacactttttctattaccagatttctttaaaaccatcaaaaggaaatgtaggtttctgttggactgggaaggatttctgctggtgcctccctcgggtccacttccataccctgactttcctttccaggacccatccttaaagcccaagggaaaatatgccaaaagaaagcccaagaagtagaatctctgaggggatgcccctcatgtgaacttgggacagatattcctttctggctctgtgacagcagctgttattctgtgacactgaggtgagagcagcccagctgagcatagcgccttgcacataaatagatacattttcattcttcctgatggacatgacagctcagaaagggggaggtccagttttgggccagaaagtatcctcactaagaatgttctgaggctgtcctttggccttctgagcttttaccttcctttatttaaaaattgagcagataagtccattcaaagccaccatacgcgattgacaaatcagataagagatgggatttgtttcttgtttagttttttttttaaatagataattatttttatggttatctaagtgccctggaaatcaggttgagtgttgcaaggaggccctcattgcctttctccctcgagagtatgtttctaatgcctgtcatctgtggtggaaaacttaactcatgctgctgttcccttactggacttcaatactgcctggaaatcctatcctttgacagtttctaagccaaagctctctagaatttatcagttctcttgattgagtctggttctcctttatatattttatttcttgagggttctaaaactgcgtgcctactaccaagatgaaaagaccctgtaggggatgtggagctccacgcaccccctctgctctctaggatggaccctggcagcctccggatatttcacttgcaccccgggagctgggagggattttgaaaggccagatgtgagggaagagcagttgcttgttatttacaacttatttcctggtatcaaatagtgtaacaaatttaccctaaaataagtatagcatttttatgttatcaaatagagctcacatgtgatagtacattactattaaacagaattttgtggtcagcaaaattcataactccctattcttgtcacttccaagaatagcctctttaagatctcaaatgtgaaattgtctgattttgcattttaacctaaatgtgatatatgttctctagaaaggaggtttttttttgtggtcagattttagtctgagtctaaagaaaattatcaatatagaaactgcccattgtactgaatgtgtttgactattagtcttagcttccaagagtatttccaaaagcacaataaatgtaggctggggaatcacagcaaggggtacggaggagggaatgagaggtcacagcaggttccaacatatttttaaatgatttccccttacaaattgatcttatttacaaggatttggaggaagaaatcattcacttggcaggatccttgtcataggtaaagggtcataatttcagaagcaatatttcttgacatactggaaagtaaattcagagactgggcatctttacagttttgctgcattctccaaactcacgttggggacttagaggtctaagtttacacaggccctcaggaatatctttttagaattgagtcacattggtaaagaaaactggcaggggagactgggctaccctcaaggaaacccctctctggtgtattataactgtgccctgatttgtaagataagacataactcttcaccaactagaaatcataacaagtttcaaaacaccttcctgcctctcattatgatgtgaagttaaaagattttgttacctactatgaaagccactgaagcaaaaacttaagtagaaggttgtttatcagatagctgtgaaatggagttaaggattaagctgggtaacatcttccccgacccccttttctccccttttgtctcttttatggcattttttttttcaggcagacatttatagataacatccatgtcatcgtttcagataggacccaaggtctgacctttcacgatgaacctgacatcatagtatcttggtgtccatcccccaccagtctttaggttttgtctgtcactcaaacacttgcctttggaaggtggaaaagcagccagttgtttcttttcatcatttcactttgatttctttccactttttttttttttttttttttttgagacagagtcttgctctgttgcccaggctggagtccagtggcacaagcttggctcaccacaacctctgcctgccaggtgcaagtgaatctcctgcctcagcgtcccgagtagctgggattacaggcacgcaccaccagacctggctaatttttgtatttttagtagagacggggtttcaccatgttggccaggctggtctcaaactcctgacctcatgatcaacccacttcggtctcccaaagtgctgggattacaagcatgagccaccacgtccagctggagaggtttgccaccaaacagcataaacatcatcttcacctatgtgtgtggagtaacttgaattttcccgccctagaaaatgttctgtttgtgttttatgctgagggacctggctaaaaatgtcggtttcactgttcgagaattcttaagagaaagtgtcagcctctaagtgtacttaaagtggatataatttggtttcacaaatcttctcctgttttcctttaaaaatattctgaacataaagaaatgatttggtcaataaataaatgcagttggtaaaccgaccatcttgtgctacgtctctgagcagtgctccacacagtaacatcccagaaaggtgttagaaatgagatgtcctttacaggcatcatttgggggagatcttagaataccatattagcttcatagatgccaggaaggaaaagagcaatgccagaccttttacaaaacctattaaatcagagatctgcaaaggaatcctgtgatagacgagaacctacagtcacttttatttaattaacttatttgttgtggtgtgtgaatataagccttcatgttttcagtttttcaggttatatcatttttataaaacaagctcaaagggtcctagagagaaagatggttactttctgaaccttatgatatcccacatatgtctactcatgatatgtgatgcctcctaatcataaggtcctctgtgctaagtatcattgtctgtgccctacagctggtagtgtatagtaaataaacacacacttccagtttaaaacattctggagccaaaaagttggaaataggcttcacctatgtaagtgaaacctgcaagatttgcaagattctgcaaaaattcttccagagcctttactatgctaatatgtatcaaaaacctccattagggaagtaaaatatattgcttcccaaacttatttcacctaacttatttcttttcttctgggcatctgttgaggccagtgttccatgaatcatattctttcttactttagagtgaactgatgagaatcagtggcaggtatgtcaagacttattcacacagagtgttgggtttcaccatatatgatagacacagactgtgatgtgtgtgtgtgtgtatgtgtgtaggtacatgtaggtatataagtgtgtgtatatgtatgtacatgtaggtatataagtgtgtgtgtgtgtgtgtgtgtgtgtgtgtgtgtgtgtgtgtgtgtcatagaaagagggagagagatagagagggcaaagaaaaggggaaaaaaaggaaagatgaattggccccggatcaggccacctgattgtttgaacctaggatttatataacagctgcatagatgtaacacatttgcaggctttgcctctttattccaatagtaatttagcagctttgcaattctaagtattgacatgtaatacattttgtgtgaattaatgaatgcatgaatgaatgcctcaaaggtccccgttgttgtgatgctttcctgacattttctgaaatggctttgaataagggtttttcttggggagccatggatgccaactgaggacgattattatgaatatttgcaaagctgagccttcaatgtccacttcaggggtattttaaggcaaaaggaaaaagaaaactctctttcattttgttttgctgacacctaatatgttttgagtaaaaaatccattttacacaggtaaataactggttatttggagcagaaaatgcatttatgccaattaataacctatttaggaagaaaatatattttccaaagcatatttgaatagtaagcacaatataataaattttaaagcttttccaactggcttctacttctggtttttgattaaaatacacacttgaaacctttatgtttttaatagcactgaattaaaagaatcaggttttcatttatacaattatttttaacattaatttttaaaataatcattgtatcttagtgagctgaaatttttttttttcccgataaactacttccaagaatgcggaaataccagggtgtgtatcatacacctccaaccagacatacacatagacacatttatcttgttgatcaatttataacttgtccactgctgagcagaaatcttagggagtacattagaactagtttcttgaattgccattgctgaggagtttgaagcttcattacatgggaaggatacgtttcctttgtgttacaccaacaatacatgtggttttgatgaggaataagcattccctccaggaagacaggtcagatgccaagactacttaaaagtgttcgcaatgtaatgaaaagtgggacggtaaagatactaaactctgggaggaaagatcctattatataatggtgcataggaaaaaaatgaaagtacgccaaaatgccaataagattatcattggttgatggatttatgggcagttttaattatcctctgtatacttttccttatattccaaatttttacaatgagctatggttactcagaaaacaaatgttatgaaaaaatacttagctctctcttttacccactcaatttcactaccctcttcctgcaacctggtaaaatagtcagtaaacccactgtatataactagaggtattttatacttctgcatggtgtagattctggctaaaatcgttttaaaagaataccaaatacatcgtagacacaaaaaaagaaagagagaagggcacagtagcattctatccatgtgattctgttgggcttatttcctttaaaagcatatgacttgaaattttgttaatatatattgttcatacagagctgttaaagaagaaattgagttattttccagtgtgagaaagtctgtatgagaaggaaatttacatggacaaaatgctaaatagcaacaattttatgaatgctaagatccaagctaggaaaaggaaaattttccgaatattaatctctctatccagataagagtgaactataatttacaaacacactgctgttggcctgatgacggtaaaaacactttgccaaatatttcttccctgtatatatgatatgtctggcccgtgctactgttatatatctaattcactcttatttactttctcacaattctgggacaattaaccatactgtagcatacttggtcaaaaaggttttttttttttttttttttttacttaacactgataatgtttttatactctaaaatatgccacctgtgaatatatggagagagaaagatatcttcggacttggtgaaaaatcagaaaatttcctgtgaaaccttggtggaaagattttttttcttaagctttagaaataatatgtaaaatgccttttaaagaagttcgtgataagggcagttcatttgtgatgggatggaatgatttctatttttgaaaagaaaaaaaattaagtcttcccctggctgaccctgcgtctcccctctcccaaccactttatatcatgcgatgcaatcagccgaggccaaggggtctcctttctattgcctattgatttattttaatagtgtcatagagattacagctgtagtgtgcacattaagtggctaaggccaaaggaggattggtccttctagttggcttttaagtttaggtttaaatgacctcagtattgtacttccatcagattcactaagattcagccccaggaggtcaatgtcccaaatagtcagcttaaaaaattggtggctgaatattctgtgtcttccttattgctaaaacaaacaaacaaacaaaacaattctattccctctggggtgttctcatcctgaaaacagaagcctagaataagaatgttttaaaaaagattctccactattaccaatgtgtttaatattaaaaatttacttatccttattgcataattctttatgttgcaagagggttggagggaatgtgaattatatactttttacaagatgttgactgaagctagaaatatcattagaaaacttattttggaacagattgatttccctttacaactattcaaagctga

SEQ ID NO: 592 - DNA, 40001 bp, Homo sapiens
gccctgagccacctcctgagaggctgatggaacaaggccccagcaggtccccagccaatccagccacccaggctgaggcaccagacacatgagtgaggccacctgaggcgttccagttccaaactgaggtcccagatgaatgctgtcaacacctgtggagcaatggctctagctaacaccccacagagcagaagaacctcccccgcgagcccagacagcttacagaaatttgagatataataaatcatagttattttatgctagtaacttttgagatgacttgttacatagcaatagaaactgagacaacacataaatcctacttctccagcctcgtgcccttcctggcactccatacccttggctccatccacacacccttgaacacctcctcctgatgtgcctgacaaactcctacttatccctcaagacccagctgaaaccttcacatcctttgacgtcctccctagtcactccctctcactccccgaaatcccttcttccacctgttccttggaacattcctttattagagcctccattcgcagagagtttgctttttctttgcttttgtcatggccgcctccactaactagcctgtggctctgtgagagcagagatggtctcctattaatctgtggacctccagttcctgatgaagtgcctggtacatgatagatactcaacgtacatttgaaagaacggatgaataaacatatgaaagaaaatgaaggaatacaaagtacattgttttttctttacaagccctcatctgagtctagatggaggcagggaggcaagtcttaaaacttgcctccatccccacttatggcttctgttgagcactctcaaatgtgtgcttgtctacaagcctgggaacatgaaggaacgggtcttagcacagctcctgagcacctttcacctggactgtgaacagcacactctcccaggagttgctgctccttgcagaactgttgctgccatctggaatctgcaagcagaggctgcgtggaccctgcatagcctggccaaggactggcatgtctgaactgaactttggagctcctggaggtttgttttaagggtcctcaggatttttgaaaaatcaggtatggtaagacatgcagatataaaaatgactgtcatggatgaagaagtgtttactcacaattccctggaagcaggtgtcgataaaaagagtcaaactctgtaaatatttaaggagagttattctgagccggccgggcgcggtggctcacgtctgtaatcccagcactttgggaggccgaggcgggcagatcacgaggtcaggaaatcaagaccatcctggctaatatggtgaaaccccgtctctactaaaaatacaaaacattagccaggcatggtggcaggcacctgtaatcccagctacacaggaggctgaggcaggagaatggcatgaacccgggaggcggagcttgcagtgagccgagatagcgccactgcactccggcctgggtgacacagtgagactctgtctcgagaaaaaaaataataataaagagagttattctgagccaaatatgagtgactaaggcccaaggcacagtctcaagaggtcctgagaacatgtgcccaaggtggttgggttacagcttggttttatgcattttagggggacagaagttaaacccagccatcaatcaatacgtgtaaggtgtagagtggtagtttggtccaggaaggtgggacaacttgaggcagtcacagtgcggggtgaggaggacttccaggtggattccaagattttctgattgacagttggttgaaatgtaacttcccaataggttcgtcttgcctgctgcctagacagagccaatttattaagacaggggaattgcaatagagaaagagtaattcatgcagagccagctgtgcaggagactagagttttattattactcaaatcagtctctgagcatttggggatcagagtttttaaagataatttggcaggcaaaggcttgggaagtggggagtgctgattggtcaggtgggagatggaatcatagggagttgaagtgagtttttcttgccattttctgttcctgggtgggatggcagaactggttgagccacattactggtctgggtggtgtcagctcatccatcgagtgcagggtctgcaaaatatctcacgcactgatcttaggttttacaatagtgatatccccaggagcgatttggggagattcagactcttggagccagaagctgcatgacccctaaactataatttctatcttgtacctaatttgttagtcctgcaaaggcagactggtccccagacaagaagggggtcttttcaggaaagggctgttatcaattttgtttcagagtcaaaccatgaactgaattccttcccaaagttagtctatgtcttcccaaagttggtctatgtccagcaataaacaaaaacagcttaaaggttagaagcaagatggagtcggttaggtctgatttctttcactgtcataatttcctcagttataattttgcaaaggcggtttcagaaagagttaagttattatctaaagaattggaatcaatagaagggagtctctgggttaaaagaggggttgtagagaccaaggttcttattatgtagttgaagcttccaggtagcaggcttcagagagaatagatggtaaatgtctcttatcaaacctaaaaagctaccagattcttaacctctcctggatcaggaagagacctagaaagggaaggggattctctagagagtatagattttccctgcaagaggtagctttgcagggccatttcaaaatatatcaaagaggtcgggtacagtggctcacacctgtaatcccagcactttaggaggctgaggcaggattgcttgagcccgggagtttgaaaccagcctgggcaaaatagtgagaccctgtctctataaaaatccatttagtcggttgtggggctttttatttttggtttacacaggagacagggcacactgggcagggccacacagggatgcactaggttggtcgaaatgcatgggagtgggtgggtgaggtgtgaacaagaaccttcactgcgccttctgtaggaaggcgtgggccaggcagcggcagcgggctgagggatggacagtgaataatttcagcatgctgtgggcataggggctgtccctagctgtctggcatctggccctgagataagggcaggtggatggtggcctggagtgtgagggccaatggaagaggtggttggggtgcgggtgctggatgagttcctttgaataagaaaggcacaccctgggtgagttgtttactgtctccaggaattggccccagggtcagtgagaccctggatgctgaagcatcagagaaacagggtagaaacggctcctctcctccccgtgacacggagccctgcaggcatccaggacagagcctttcctggggctattgaatgtgacaaatctggttaatcaagagacatcccaggaggactccattatgccctgcacataaaaggcaacacctatcactaaagacacctctgactctgcgctgccacccggcagtgcgaggaccacatactgaccaggtgtggagccgatgcccagacccgtgatggcaggtgaggaatgccttcacggccttcacagctgctctacatgccttagttttaggcaaatcagcacggagtagcagaagaatagtgcatgcttcagccatagataattaaaaagcaagcaggtcttgaacactatagtgtattattgctataaaatttctaggagaaaaatttcacgcgcgtccatgtgaagagaccaccaaacaggctttgtgtgagcaacatggctgtttatttcacctgggtgcaggcgggctgagtccgaaaagagagtcaacgaagggagataggggtgcagccgttttataagagttgggtaggtaaaggaaaattacagtcaaagggggtttgttctctggcgggcaggagtgggggtctcaaggtgctcactgggggagctttttgagccaggatgagccaggaaaaggactttcacaaggtaatgtcatcacttaaggcaaggaccggccattttcacttcttttgtggtggaatgtcatcagttaaggtggggcagggcattttcacttcttttgtggttcttcagttacttcaggccatctgggtgtatacgtgcaagtcacaggggatgtgatggcttggcttgggctcagaggcctgacattcctgccttcttatattaataagaaaaataaaaatagtgttgaagtgtgggggcaacgaaaatttttggggggtggcatggagagataatgggcaacgtttctcagggctgcttcgagcgggattaggggcagcgtgggaacctagagtgggagagattaagctgaaggaagattttgtggtaaggggtgatattgtggggttgttagaagaaacatttgtcgtgtagaatgattggtgatggcctggatatggttttctatgaattgaaaaactaaatggaataagagaaggagaaaaacaggtattaaaggactaagaattgggaggacctaggacatctgattagagagtgcctaagaagattcagcatagtcctgccagcaaagattattgatttacttcaagagttaagagtggcagtttggggatagcaccaggagatatcagctgtgatggcttggagaaacagtgtaaaccggccgtgtaaacaagagcagggcatgtatgagtagttcagaatggtgaataggagtatgactagacggaagatagtagggatgacaagtttttttggggcacagtctaagttggtctggtgtctggaatgagactggggcctaataaaaaggagcatctatacaggagctcaaatgcgctgtaccctgtagcattctgaggacaggtctgacttctgagaagggaaagtggtaaaagtattgtccagtcctttttaagttggtggctgagcttggtgaggtgtgtttttaaaagactattagtctgttctacttttcctgaagactgaggactgtaagggatataaaggtttcactgaatactaagagcctgaaaaactgcttggctgatttgactaataaaggctggtctgttatcagactgtgtagaggtgggaaggctaaactgaggaattatgtctgacagaagggaagaaatgactgcggtggccatcccagaccctgtaggaaaggcctttacctatccagtgaaagcgtctacctagactaagagatattttagttatctgacttggggcatgttgagtaaagccaatttgccagtcctgggtgggggcaaatcctcgagcttgatgtgtagggaagggagggggcctgaataatccctgaggagtagtagaatagcagatggaacactgagaagttatttccttgaggatagatttctacgatggaaaggaaatgagaggttctaagaggcgggctagtggcttgtactctagcatagcctgcctttgctggtgtgtggcgattaggcctggtggaactgccatcaataaatcaagcgtgatcagggtgaggaacaggaaagaaggaaatatggggaaacggggtgaatgtcaggtggatcagagagatacagtcatggaggtcaggtgtggtatcaggaataatgtgggaggccagattgaagtctgggccaggaacaatggtaattgtgggacttaacaaagagtgagtacagctgaaggagccggggagcagaaagtatgtgcgtcaggtatgaggaagaaaatagattttggaagttatgagaaatgtagagagtgggttgagcatagtttgtgattttgagggcctctaaaagtattagggcggcagcagccgctgcacggagacatgatggctaggctaaaacagtaaggtcaagttgtttggacagaaaggctacagggtgcggtcctggctcttgtgtaagaattctgaccgcactaactatgcctaggaaggaaaggagttgttattttgtaagggattgaggtttgggagattaattggacacgatcagcagggagagcacatgtgtttttatgagaattatgccgagataggtaacagatgaggatgaaatttgggcttgactgaagtaatggggtctgtctttgaagccttgcggcagtacagcccaggtaatttgctgagcctaatgcatgtcagggtcagtctaagtgaaagcaaagagaggctgggatgaagggcgcaaaggaatagtaaagaaagcatgtttgagatctagaacagaataatgggttgtagagggaggtattgaggataggagagtatatgggtttgacaccatgggatggataggcaaaacaatttggttgataaggcgcagattctgaactaacctgtaagccttgtctggttttaggacaggtaaaatggaggaatggtaagaagagttcataggctttaaaaggccatgctgtagcaggcgagtgataacaggctttaatcttttcaaagcatgctgtgggatgggatattagcattgagtggggtgagagtgattaggttttaatgggatggtaaggggtgcatgatcggtcgctaaggagggagtagaggtgtcttatacttgtgggttaaggtggggagatacaaggggaggatatgaaggaggctttgaactgggggaaaaggcggcagtgaggtgtggctgtagcctaggaacagtcagggaagcagataatttagttaaagtgtctcggcctaataaggtaactgggcaggtggggataactaaaaaggagtgcttaaaagagtattgtctaaattggcaccagagttggggagttttaagaggtttagaagcctggctgtcaatatgcacaacagttatggaggcaagggaaacaggcccttgaaaagaaggtaacgtggagtgagtagcctccgtattaagaaggggacggacttaccctccactgtgagagttacctagagcgtctgtgatggtcctgcaggcttccgaggcgatcgggcagtgtcagtcttcagctgctaagccgagaagatctgggaaggagtcattcagagagccttgggccagagttccaggggctctagaagtggctgccaggtgagttgaacagtccaattttcagtggggtcctgcacagatgggacacggcttaggaggaatcctgggctgtgtgcattccttggcctagtggccagatttccagcacttgtagcaacctcctgggggaggaggttctggaggaacccctggcagctgcggttcaggtgtttggagttcttgtgtgctggagatgtggctggggtttgtctcacagtggaagcaaagaattgcaacttagaaatatgttgctgcttggctgcctctactctattattgtacaccttgaagatgaggttaattaagtcctgttgtggggtttgagggccggaatttaatttttggagttttatttaatgtcaggagcagatggggtaataaaatgtatattgagaataagatggccttttgaccttttagggtctagggctataaagtgtctcaggtttgctgccaaacgagccatgaactgggctggattttttatatttgatgaaaaagagtctaaacgctaactgatttgggagaggtcagataaagaaaaaggagaattaactttgactatgcctttagctccagccacctttttaagaggaaattgctgggcaggtcggggagggctagtcacggaatgaaactgtaaactggaccaggtgtgaggaggggaggtgataaaaggattatagggtggaggagcagaggctgaggaagaattgggacctagctcggcctggcaaggaggggagaggtcagatgggtctgtagaaaaggaagattagaaagactcagcgacgcttgtggttgggactgaggggacaggcgggagggaaagaaggaagatttgggactagttgcattgcgaacagagactagggagggactgatgtgtaaaacagtgcctggatgtcaggcccctcagaccattttcttatttttcaacaaaaattatttaggtcttgcaggatggagaaatcgaaagtgccattttctggccatttagaaccactgtcgagtttgtattggggtcaggtggcattgtagaagaaaataaggcatttaggttttaggtcaggtgagagttgaagaggttttatgttcttaaagaacacaggctaagggagaagaaggaggaatggagggtggaaggttgcctatagtgaaagaggcaagtttaaagaaaaggaagagtagagacacagagggaagcggttcgggggttcttaccctccagaaaagcaggaaaggggtcagggcgcagagatacgaggtcgggggcgtggaaataagggatcagggcacagagatataagaggctggggcatggaaataagggatcggggcacagagacacgaggttggggtacttgcccttcccctagaaaagtgggacttgctgctaagggtgaaggagaaggggttgggggtttcttgcctcccagaaaggcggagaaggggtagagacacggagagaaggggttggggtacttgcccttcccctagaaaaatgggacttgccactaagagtgaaggagaaggggttgagggtttcttgccccctagaaaggcagagaaggggtagagacacggagagaaggggttggggtacttgcccctcccccagaaaagtgggacttgccactaagggtgaaggaccaaggcaggtgtccttgcgtggtctgacacctctgaaacatgggtgaataattagagaggcgtccctgcaatgattaaacaccaagggaagcctgccttcccagtccgtgactggcaccagagttttggatccacagataaaacgtgtctcctttgtctctaccagaaaatgaaaggaattgaaattaaaagaagggagagattgaagtgtggcaccaagattgaaaggagaaagaggtggagggatagtgagggaggttggagaagagagtaaaaagaggctgcttaccggatttgaaattggtgagatgtttcttgggctggttggtctgaggacctgaggtcgtaggtggatctttctcatggagcaaagagcaggaggacaggggattgatctcctaagggaggtcccctgatccgagtcacgcaccaaatttcatgcgcgtccatgtgaagggaccaccaaacaggctttgtgtgagcaacatggctgtttatttcacctgggtgcaggtgggctgagtccgaaaagagagtcagtgaagggagataggggtggggccgttttataagatttgggtaggtaaaggaaaattacggtcaaagggggtttgttctctggcacgcaggagtgggggtcacaaggtgctcagtgggggagctttttgagccaggataggaaaaggactttcacaaggtaatgtcatcagttaaggcaaggaccggccattttcacttcttttgtggtggaatgtcatcagttaaggcaaggaccggccatttacacttcttttgtggtggaatgtcgtcagttaaggcggagcagggcattttcacttcttctgtgattcttcagttacttcaggccatctgggcatatatgtgcaagtcagagaggatgcgatggcttggctcaggctcagaggcctgataaaaaatacccaaaactactgcagcaatttcagccactactgaccttttcacctacttggtgtgaacccaaaataccagagatgggtctcactcaattgagaaagtttattttgccaaaggttaaggacatgcccgtgacacagcctcaggagggcctgacaacatgagcccaagggggtcggggtacagcttgcttttatacgttttagggagacataatacatcaatcaatacatgtaagattgacattggttcgatctgggtgggacaacttgaagtggggaggggggaactttgaattgtatttttggtttatataggactgcctttcttccttttctccccatgggtcctgtaggatctatgatgagataataggtattttatgctccaattttctcataaatcaaggacatgaatacccaatgatctcagcttctggtcattagagataagcagtgtttccatggtgtctctgtttaattctagtcaaaagcaaaggaacatgatgtattggttagcctgtgtagcatcattgcagcctgatgggtgacacttcacaaacttgtagtatgctaaaaataggccacgaaacccaatggactcaccctgttactggtggaaggtgtccaagttactagcagtgaatccatacgggtctgcaccaacctcaattcttgcctcctcagaagaaagaaattggacttaggggcacaaggcagaaaaagagaccgaggcaagtttcagagcaggagagagcaggaaagaaaggaaagtacacttacttggaagagtctcaagtgggcaacttgaagaacgaatgtggcatttaaacttgatcctaggactttatagcctggcccacctctggtatcttgcagccctttcccataattcttcccttagggtgggctgcccacatctacagaggggtcctgacgcctgggaagtgagcatgagcagtgggtttacgacgttgtatgcggcatgctcccttttccggtggaggcccccagaaagtcatactccaccattttgtcgcttaacgcgcatgcctgagctcactagcccaataactgagactttattggaagtcctttttgcttctccctggcatctgcattaaattaactctttaatgttaacagccctggatcttcaggagattgtctcgccctggcgctggctgctgaataatcacttttagaagggcagtgtgaccattgtcacaccatcacctgacaccatcacctgacattcctggtgggtaggggagagccctctcctgccctgctcaggcctaactacctgtaacagaccccagtgacaccctagagtcaggatgtgtgctttggaacaatggaccacagctagaaaaactcagagcagttgaacccaagtaccatctgccagctccataagagtaaagataacctcataatgtaaccacccaatgggcttttcttgcctgctgcccaggtagagccgatttattaaggcaggggaattgcaatggagaaagagtttaattcacacagagccagctgaacgggagactggactcttactattacccaaatcagtcttcccaagaattcaggggctagggtttttcgaaggtagtttgcggaaaggggtgggggtggctaggcaatgggtgcttgctgccaattggttgggggtgcaatcagaggggtgtgggaaatggtcctcctgagctgagtcgcttctgggtagggccacaggaacacttgggggatccaggtggagccattatcagtgtgagacatgcagaaaacctgaaaagacatctcaaaaggccaatcttaacgttctacagtagtgatgttatctgcaggaataactgtggaagttgcatatcttgtgacctccggagtaatggctggcaattgtttatgtctccaccttagccaaattcaggttcctctatcctcctagcctggtggtctctcattagctttacaaaggaggttcaatttgggggaaaggctattatcatttaaactataaactaaacatctcccaaagttagcttagcctaagcccaggaataattaagggcagttgaagactaaaggcgaaagggggattggccagatcagatctcctccagagccataattttctcaatgatataattttttgcaaaggcaattacaataaggataatagtaatatccttacatgttccacataccacgacaagcatttcctatgcattgcttcagttaattttcatatcaatcttatgaaacaggatcctagagatgaaagccaaggtcctgctgaatgggaagccaggttgagaacttagtcctttctgacttcaaagcttgtgctttcactcctgtgttatgttggaatgcgagctttgaggatctctgaaaaaaaaaaaccatattaatatgctcagactgcataacaaaatgccacaagctgggtggcttaaacagacattggtctttttacaggtctgcaggccctacaggtgccctcagggttggtttcaggtgaggcctctcttcctggtgtgcgcagggccgccttcttgctgtgtcctcactcagccttttctctgtgcacctgcagagagagagacagagagagagagagagcgtgctccggtgtctctttccctttttttttttttttttttttgagacggagtcttactctgtcaccaggctggagggcagtgacaggatctcggctcactgcaacctctgccttccagagtcaagcaattctcctgcttcagcctcccgagtagctgggactacaggcacgcaccaccatgcccagctaatttttgtatttttagtagagacagggtttcactgtgttagccaggatagtctccatctcctgacctcatgatctgcctgcctcagccttccaaagtgctgggattacaggcatgagccattgcccccagcctctttctcttcttctaaggacaccagttcagtggattaaggcctcatttttagggcctcacttaaccttaattacctttttataggccctatttccaaatactgtcacactggggggttgggcttcaacctatgaatttgtgggggaggggggacacaattcagtccattccaaaagtccttgccgttttgtcataggcgtgtgaaccagagcaactccgtcttgagtaggagctaggtaaaatgaggcagagacctactgggctgcattcccagacagtgaaggcattctaagtcacaggatgtgacaggaggtcggcacaagatacaggtcataaataccttgctgataaaacaggttgcagtgacgaagccggctaaatcccaccaagaccaagatggccacgagagtgacctctggtcgtcctcactgctacactcccacaggcaccctgacagtttacaaatgccatggcaacatcaggaagttaccctacgtggtctaaaaaggggaggcacgaataatccaccccttatttagcacatcttgaagaaataaccataaaaatgggcaaccagcagccctcgggtctgctctgcctatggagtagccgttctttattcctttactttcctaataaacttgctttcactttactctatggactcgccctgaattctttcttgtgcaagatccaggaaccctctctttgggtccggatcgggacccctttcctgttacatttctagtgtgtacatggccaccttcttgctgtgtcctcatgcggccttttctctgtgcacctgcagagagtgagctctgctgtctcttcccctacttctaagaacaccaatccagtgaattaaggcctcgtccttaggacctcttttaaacatttgtgtgtgtgtgtgtgtgtgtgtgtgtgtgtgagagagagagagagagatggagtttcactctgtcgccaaggctggagtgtagtggcacgatctcagttcactgcaacctccgcctcctgggttcaagtgattctcctgcctcagcctcccaagtagctgggactacaggcacccataccaccatgcccagctaatttttgtacttttagtagagatggggtttcaccatgttggctaggatggtcttgatctcctgacctcaagtaattcacccgcctcagcctcccaaagtgctggaattacaggcatgagtcactgctcccggcctggcctcgtttaaccttcattacctccttacaggccatttcctaatgcagtcacactggtgggcagggcttcaacctgtgaattctgggggggacacaattcagtccattccaaaagtccttgcagtttgtgtggatccactcgggggccgctgcctagggcaggccggtgaggcagcctggctatgctcctctcctccccggagtcacactcacctcacaggtccagacacctggtccctgggcttacctatatggaaagggtggttttttcattattaggcagatttttctgggatggccttctttgttcttccagaaaaacaccagtttgcaagcagaaacgccctcagcttggaggagtgtggtcacatgttgaaaatgtgggagcttgattcaggcagctctgaattcaaggactggttcagttgcctacaggccacgtgaccttgggtaagtcacgcaatcttcctgagcctcactttttccatgccaagattcgcctcccagggttgctgtggcagaggcgtagatgagccagctctatactgcacgtgaccctaaaaaggattcagaaaacattaggccccaacagcatctgcggggaccatctccttagggtccccaaggcgttgccctgcccattttgcagaccttttgttgtcaacattcagttaacttagagccacattcatcctccaggacctgcagggtggtggacaaaggccgcatcccctgaaaagcaggccctgatctgacgactgttctgagagccagcactggccccaggttaagagcagaaggtcccactgctaccctgagaggctcaaaactagccatttccatccctgggcttctgtgtcatcagctctaaaatgatgttgagacctttggttcccaagggggaatgagggtttcgtgtgttgcctaaacactgtcctcacccccttgatctgagagcagaccaggagccaacagactgatcaatgccagcttcactttcccactgcccaggctggcccccagggaagagcaggacttggagggggactggcaggcaggatgggcactggtgtatgtaaggcagtgctgcccagtgaaagaggtgcccctttcagatccaccagcctctgatggaatctaagctctactttttgtttaactggccccctgagggcatgcttcaatcctggaggtactgcaacatacgtcaatgtgtgaagtagactcagcacgctcctatcccatctccctcctccaaaaactcatttgatatatgtcctctagtagaggatgtattgatataggagctaaaaaagaaattatttaggcagttagtgagggtaagagagtccttggtaaggtttcccttttaataaaaagccgtccccaaatcatttcttttctaacaaagagcagcccgaaacatcaagctgcagacatagaaaagcaagctggaagcttgcacgcttgaataccggcagctgtgccaataggaaaaggctacctggggatcaggcatattcaacatggaggcttcatgttcccttctttgtcaaccatgtgtgtagtaaaggaacaggccacatggcaccaaccaggtagagaacccatctgcataataaaatattaggatggggcagccagctttgtgctatgtaaatggcacacctgctccaaccaatctttgggccctgtgtaaatcagacaccgtctcctgaagctggtctgtaaaaccctgtgcatttcaccacgaaaccggaagacccactcgggagcctctctcactgcaggagagaacacttttctcttttctctttctctcacctattaaacctccactcttaaactcacttcttgtgtgtccgcatctttgatttcctcggtgtgagatgacaacaccacttcaagtatcagatgttaaactgataacagatactcgacttgatcttagccaaaaggcccagaagctgttgagctctccttcctgctctgtgtacctgggtgagtgtctgggtatctataggcctcagttttccttgtctgtaaattgggcacaataccacattttctgcagtatcacagaaggagtagatggtccatgcagagcacatggttaacattaatatgtagctcttaataagtagtagttaccattatctctgccatcgtgatgtcacttatagctctcctggagatggctgcaggtgtgaagagaactagagcccagtccttggaatgctgcagaattgcagggtgcagaggaagagggctgaccacacctgggaacatgactcctgtgagctggcatctcccagtacgcgacgacagggtcctcccacacacagaatcccctccttgaaattcctggtcacagacatagaacaggccagcaaggcaggcatggtggccaggcaatgtttttccttttgcagtcagcatatttgcctcaggaagaggggacttttcggcaccctgatgtccctctgtttgtcccttcactggagagcaagcaggtatgattgaggtcactgggggaggaagggactgggagaaagagcatttctcatatgctttccttcctaacctctgatggacttcacaagtgtccctttaactcctccaggttgataaggttctaatggcacctctgagacctcgagcctaggttctcacctaggacagggagccacccacaacatggaagccagaaacaggctaactggtggccgcttcttgctcatccatggagaggaaaagcgaagcaagggtgaggcatggtggggaaaccctggtcaaaactctctcgccctgaatattccccttagagggcagctgcctggatgggggcaccctgactggcttggcctggattgacgagctgaactctggccagcagcctgggtccacggatcgcgaggcttatcggagtcttccctgagacagggttctgttaggaaggaggaagcagatggaaggtgggcaggcagctgacggtgtccacaacaccatcatggaaatcttaaatctaaagagaattgatttcacctgatggctgagcagaagcatgtgtgaccagaaaagacccttgtacgaagctggcctgtgcctcaaaaaaggatgtcagtccaggttctttgcacccacagcggggaatgcaatgtcagagctggggagtggcctggcaggctgaggggagcggctcatggacaagggccattgtcatcacccatagctgtggtggtacacaggatatctgctctgccaggaggggcagggaatcagctgtgtcctggcctctccctgtctctcattctctagcccagccatttacccctattgcttatggaattcagccctggaagagatgttctatctgccaggagctccaccagctcatgcacaatctggcaaaggtgccagaagacagaggtgtccccagagggagccctaagcaaccagcatcccaaatgaccacagatgtctgcttcctgcctgagtgaattttcctttctcagaaatgcaatacctcattgacttgtattatctttggaatgacaatggcctaactaattgggaatgcgtgacttcaataaacagtttcaccaactgctctttctaaaactgttttccaggtcaactagtgtgtgagaagcagttaatgctttgagttttaggagagaacaggtcctcttcattctctgccctaaggtatctgccaacatctcgtaaatccaggctcacatgatagcctgggccctaggatgaccacgggaatttatcccttgtgtctacactgatggatgttggtaattttctggaatattgggctgagaggcattctgaggccacaccagaaagagccctgtgtgtcattcacaatgtctgccatgtgcagaggagagaaacggcacagatgccacacactggatatcccaaggcgaagtggccttccatatataccatatatattccaaggtcaagaagcaggtactggccaggcacagtggctcacgcctgtaatcctagcactttgggaggctgaggcaggtggatttcctgggctcagaagttcgagaccagcctgggcaacatggtgaaaccccatctctactaaaatacaaaaaattagctgggagtggcagtgtgcacctgtagttccacccactcaggaggctgaggcaggagaattgctagaacccgggaggcagaggttgcagtgagccgagattgtgccactgcactccagcctgggcgacagagtgagactccgtctcttaaaaaaaaaaaaaagaagaagaagaagcaggtatctatctaccagaaggacacagagtcccatagaaccacgcccttacccaggctgaaagaattgcggccgtgaataaacatttcccctccctatgccttcctcacgctcagggacacaatcaagaacatttttctgaattaagcgttctttctaattggatactgatggcataaagaatgtcagtttgggctgggcacagtgacgcatgcctgtaatcccagcactttgggaggccaaggtgggtggatcacatgagctcaggagttcaagaccagcctgggaaacatagtgagaccttgtctctaccaaaaatcaaaagaattagccaggtgtggcacacacctatagtcccagctccttgggaggctgaggtgggaggattgcttgagctggggagattgaggctatagtgatgtatcactgctataatcaaggctgtaatgatcacgccattgcactctagccagggtgacagagtgagaccctgcctcaaaaaaaaaaaaaaaaagagtaaagaaaagaaaaaaaaaagaaaagggatatcagttttatctgtgtgtgtttttgttattctcttttataaagatttgggatacgtggcctataaaaagaaaaaaaaatcaagataaagcctaaaaagtaggcattttggctcctctgtgtatttgccatgggtttcatctgagagaaaagctcaaattacattaaactcatgcgtaatttgatggtgtgcaaaccaaggaatgaagaaatcttgcaacacagttttgttttccagggctgagtttcccaaacagtgaattagagcaaccctcatgacgaaattggtcagccctggaatcccagctgatctgacccaggctctgcagggagaagcctggcctcggagcagcaggggcgaggctcttttcttgcagcctggaaaatagccccacccagtcaaagaactagtgagccatttccccaaaaaaggatcccaggctctccccagtcagaagcttaactgaagccagagctgggtggaccctcgcccaccaggaatagcggctataatgacaagggtcattgtgtgttttgctgcttaatgaagcagagacattcctcaggcattttgtcctggacacaggtaggaaggagggaaggcaaggtaagaagaaggtggctaaggctgcctccaacccagacactaggaaacatgggggaagagagcaggggacccaaatgtttaaaaaaccatcatgccggccatcacgttttaagcaactacttaaggccagggctgtcttaggttcttttttcatttatagtcacaatagccctaggtccactggatggacaagaaagctgtggctgcaagactgatgctgcttgcccaggtctcacacctggagtggcagggctgggctcatgttgaggcagccacgttcttcctgtggcactgggaggcgagccgttgtctgctacggggagaccagcaagagagaagtggtcaaggtcttttcacaaggagggagggatgcttttagcatgagcgattttactttgaaaatgttcaagcttatatggttttctagggaggtgttttgttttgtttttttcttagtgcattacattctaaattcaatgccctggaagatactgaatagatgggacaaaatccattaggctggatgatttatggcttttcagcatttagcaggagtggctttcaatgtgaaattggttgcgtgcagcaaaccattttagaaatttgtctcacgttgcccataagtgattcatgccatgcttcccatgcctctttttgggaaaaggggaaacaatatcaacacaaagcaaattcagtgtccagtacctctgtcctttgcgaacccctgctcagcaatcccatgcccgtctgtcatctccgcacttgctgggctgcattttactggccaaacagcaatggctgtgacacctgatccatctagccagcgttcgtcccttggtttttttggtgtttgtttgtttgttttgagacagggtcttgctctgtcaccgaggctggagtgcagtggtgcgatcatagctcactgaagccgcaaactcctggctcaacaatcctcccatctcagtcccccaagtagctgggactacaagcatgcaccaccacaccagctaattttcattttttgtagagatgagggtctggctgtattccccagcctggtctagaactcttgggcctcagactcccaaagtgctgctattacaagtgtgatccaccccacccagcctagctaagttactctttatcattcctgctcctttaagtgaaagaagcttgtgctcggctggcccgccctgctcgggtcagagtgcatgcctgctctacctctcttccagcctgaggagggagaagtacccccttctcccacaccacagtgcccaccccctgctcagagccatggctccacccttattttatttactgcctggtgctcactaggtaggaagcatccagaaggaaaccaggttgtaaggaacagtcttgcctctgcagctcctaacaccaaggtcttacgcacaggaagtgctccataaatgttttcttgaaaaagtaggtcacgtgcaaggaactgaggctgagccgggcgtgtttaaggatgggccttcaaagcatagctatagaaatgccactcaggtttggcatgagcctcttatttttttcaaagtcttttttagttttattaaatgttttatttttatggatttaggggtacaaatgcagttgttttacatgaatatattgcacagtggtgaaatcggggctttcagtatgctcattacccaaatagtgtacaatgaacccaagaggtgatccctcacccctcccacctgcccaccatttggagtctccagtgtctattatttccctctgtatgtctgggggtacctacatataagtaagaaagtgaagttttggattttctgtttctgggccatttcactaaggataatggcccccagttctatccatgttgctgcaaaagacaatattgcattcttttttatggctgagttgtattccatgatgtatgtatgtaccactttttaatccaatcatctggtgatgggcacttgggttgattccaggacttcgctattgtgaatactgctacagctgacagtccaggtgtcttttttatataatgatttattttccttcaggtatataacaaccagtagtaggattgccagatccaagggtagttctatttttccttctttgagaactctccaattttccacagaggttgtactaacttccattctcaccaacagtgtatgagcgtttcatttttcccacatcctttggggtcctctttgagctcagatcctatatccctctttctctatgcattctaaaaagacaccatggcaagaaacatataacaggctttatcagcatagagaaattatccatctatggtgagtgtagaagtcttgaattaaaaaataaaagctagattggtttggtgtaattcatcctagacatgtgtggccaactactttacggaacaagtgaaacaaacatgaaattgctttatttttctcataaacgtctagtcccttagggatcctattctgattccatctcttggatgacacagggttttttttttttcaaagtcttgtccaatccattttaattcacttccattgcacatcctcacctcctagcagaaggagtagtaggtcccagcctcagagccttggtttgcagaggggtgagagtctctgcccaactccttcttcctcctctcttttctccaatgtgctgtgaagggaagaagggaggcagaggagatcaaagtctttattcacgcagtgccactggggacttcccttggccattgttgcctgctgggtggcgggccctttctgtggaagtttcttaggggcctccccagccacaactccctgatgaggcagtgtgctctggcccggcccactctgaccccatgcccaggtcctgcccgcagggtgcatcccactgcagggtgcctcttgctcccaggataatggcagaaaagctcccgaacctcccagaatgtcctcaacccaccattgtgctcacttctaggtgagagcgcagtggcttaaccatggacccatcctctgccatgtcaggtgggcacccctggaatgataataaaataaggtttatccggagaggctccagaagcaagaaaatagacattgtctctacccttttccaagctcagggtaaaatggtctcattctttcataacaattacagggttagccattatgttaatggagaagagccaaaagccagaaaatacaaaataacagtcaatcctaaagcacttacacattatcttggaattaagccaaggacttaaagacagcagcaaacccttttaaactctggcagacacatttggctcaggcgtgtcttttcctgcctcagtctcagtctttcctggcactgagtgacgataactcaattagatgcgaaatgtgcttagaagagaactcagcgaagatagtgctgtgacagcagtcgcgattagaggagagacacacacaccgtagctcagtgatgctcaaaggaaggacggtgtgaaggtgaatttgagcttccgaaatgaatataaaagagtcaagatggccgggcatggtggctcacgcctgtaatcccaacattttgggaggccgaggcaggtggatcacctgaggtcaggagttcgagaccatcctgaccaacatggtgaaaccccgtctctactaaaaaatacaaaattagctaggcgtggtggcgcgtgcccataactccagctccttgggaggctgaggcaggagaatcacttgaacctggcagatggaggttgcagtaagccaaaggttgcagtgagccgagattgagccactacactccagcctagacaacagagtcagactctgtctcaaagtgaaaaaaaaaagagtcaagacttgagcctcctcattcttggatgttcttgaatattcattagcatgtctggtcgcaaggtttgctatatgaaatgctacatgaataatgaaggatgctgttctcctttaaagataaagagctctccccttccaaaacactacatcccttagagtcgcaaatagaagaaccctaatatcctaatgtctggtgttgtacactttgttgattgcaactagaatccatcctcccctttccctttcctaaggggtttcagattttcatttaagtagcctctcctgcctcatgcagcccatggctttgggagaggaaggcccctccctcaggaaggccctggttaatctaaaacagagaatggagcgattgtatctcacaggggtctacagtgatgggtttaggcgttgagtatggcattcagacaaatcacagcattggttcagcaatggcctgggacccagctgggctcatgagacacaagcaaagatttgctagaggagtccctctccctctgaagtgtggatacaagctctgggactgtgggacaacattgtcaccatgagagaaggcaggccaagggtgacgctgaccctctgagaggcagagcagagaaataaggagaatccagggttgtgaagacacctcacagcccattacccagctgactgtgaagctgccctgcctgtggcctctttaggaaggcgagctggagatccccttactgccaaaccagtctgtttggggttgtttaacagtatactgaggcaggaggacagcttgaggccaggagttcaagaccagcctggttgacatagcaagaccttgtttctacaaaaacaaaaacattgtaactacagtgatcatgtaattccttgcctgaacccagacatctttgagtgaaaggggcactattaataattatagcaggggccaggcacagtggctcaagcctatagtcccagcactttaggaggctgaggccagtggattacttgaggtcaggagtttgagaccagcctggccaacatggtgaaaccccacctctactaaaaatgcaacaggtagccaggcatggtggcacacccctgcaattccagctactccagaggcttaggtgggagaattgcttgaacccgggagacagaggctgcagtgagccaagattgcgccactgcactgcagcctgggcgacacagcgagaccccacctcaaaaaaaaaaaaaattatagcaggaccacagacataaaccaggattgtcccaagcacaccggaatgcagcgtcatgctaatcttaacggataggcaccatcagcattctccaggtgaatcaccttaaacttgaagaaataaaatcagttattcaaaggaataaaataaccggattcaggcccttctctaattgctcctccacactgcggccagagtgatctcaaaacccagatctgattgtcgtctgccctgcttacaatgctacaatggcactgcatttctctaggacaaagcctcgctgcctttgtgtggcccggcctgtgtgcacactctgcagggaaccctcttccccaccgcggctctctcctctgacctcccgtccactcctcccgctcggtgcacctcctcagggaagctcgcccttcgtctgagtcaggctgctttgctggagaacttcgtggaccgaggttctttccctccttcccgcccgtcctgctctttagtgcgatgcaagcgaccagggatgtgtctgttgttgttctttgtggtgctagcaccttccacagtgcctggccacgtagagatattcaaaccatacacattgatggagtcccaggaatgcaacaaaaatcctccaagacccgtcttccaagttcaaagtgtctgggctcagaaggagagcctttctgggtcctcgaggggaaaccagctctcctaagtcctcctttgggtccaggggctgaatccatagcactttcccatgaagcccgttcctgctgggtccccggtttccaaggctctcctgcaaggggaactgggcgccaccggaattcggtaaaaccctcaagtctgatgcagatgctcccaggttatagaggtgaagtgttttcatgttttcttcctaaaccctaagctgaaaatggggtgattttttcttctattctctgtcatccaaaggtcaaatctgcttctccaataattaccttctctttttggccggcagggtaaaaagcacttcttttgttatcctcatctgacaataagccctctaaccaccatttcttttgcaatattggtataagtgctctagacacaggatgtgaggaaaaaccttaagtcttgcctgagccggtggtcacagatgatctcaagcctgtattccagaggccacaggatgctacgccctctagaattattttcggtgcacattcacttttctctccatgttctcttaactccaatgatgactgtctgtgcctccacagccattttgctccagcctacagcatttttagcaaagcgcttctctgtctttcctcgccttaaggataggcaggaggcggatgaatcggagctcgcgtaaagcagaagatgaggtatcctgcaaatgatcctcactcagtgtttttatcctgttttttaaaaagcttttatatccagggccaggcacggtagttcatgcctgtaatcccagcactttgggaggccgaggcgggtggatcacctgaggtcaggaattcaagaccagcctgaccaatatggtgaaaccccgtctctactgaaaatacaaaaattagccaggcgtggtggcagacacctgtaatcccagctccttgggaggctcaggcacgagaattgcttgaacctgggaggcggagtttgcagtgagtcaagatcgtgccactgcactccagcctgggtgacagagcaagactctgtctcaaaaaaaaaattatatcttttacaaaattactagagacatttttcaagccccttgtatgaggacacacacacacacacacacacaaatcctcataaaattcagcacctgaaaatatccatctctctagccagttttctttaatcaagcaatgtgaacttcataatctgtccaaccacccttatgtcctgaattaataacttctagaatgagcattaaatttatccatctcacccttgacctctctgcgctccttctaacctctattttcactgacctactttctacacactttagtattttaagccacctctaaactcttttaaaagtagacagggcacaagtgattaaaaaaatcttttcttaatagtcaaagtttccttaatcttaggaaacaacattctcttaacagagtagttcagaatcacttaaaaaaataatgcctgagcctgcgagagctaaactgtcactgtgaactaataacttcaggtctgttccacagcaaactcggtttcttgtcatttaagtttctcaagctctgggtttttccctcccatgccaaatctatcattcaggctcagcccttggaggttttcttcaggctccaagaaaaccaacctcacagaaactgctgaagcgtggcaagcttgtcttgttcgggtttggatgaatattttatacaaaaaacctctggatatccttccaaagttgagcccaaggactcaagatcaagggagaaagaggtttagctcccaatacaatctaatagcaagcacattttagtcttgggaagcctcagactgaattagggacaagggaccaggctgagcagtccctccctttgaactattttgactcacaacacgtctgagaccaaatatgtggattttttccttcaaaaccagttcccaatctctcagacaccaactggttgtcctgcaattcaattccattctgctgataacttctggagtaagcacagaccccaccagttgggggctcggccctgtaagaccacctggattgcatgcaccaggctgaactccaagccaccagtgcttctcaccaactggctataaagtggggaggggttcccacaatcccctctgcaggttcaagaatttgctggaacagctcacagaactcaggaaagtactttacttactattaccagtttattataaaggatctaactcaggaacaaacaaatgcataggaaaagggagggggcgtggagcttccatgccctctctgaacagccgcccagcacttcagtgtgttcacaaccccagaaggtcccgaggctgttgtttaggagtaagtgaagcaaaatagcttggaacagtctgaactatgcgaggtatgcaaaatgtaccaggcccagggagacctgagtcccacagcatatagctgtaacttcagcttcttagattgtagatcaactctcttcctccttgttcttgttctttaaatgactaggagagatcagaggccagacctcccctcttccaaccactgacccttcttgtagattaactgcctcctttactgtcttgtacctaacttcaaccagatggtgcaaaagaccccatgacacatcttccatatggaatgtgaaatatgccttccctgaaagaaaaaaacaccttgactaatcagaccatttgtgactacgcattaagccttgtatagaaggatgctgacattctactaagcaccccctgaatttgtctatataaatgattccaaacttccacactttggaacattgactttcattctttggaatctgtgcttcctgggcagccatcttgaaacttggagcttgaataaactttctttaaactagattctgacccttttgattattttaggttgacgatatcattttatatcagggacgtgagtatccaaggattttggtatcctcaggggtcctgaaaccaatactgctgaggacatggagagacatgataattcaggtctgcgggtgataaattctttcatcttttatatcttcaacaaagtttagcattcatttctgaaagatgttttcagtcgatatcataagattcctggttgacttttttttcccgatacttcagatgttgctccactaacttctcacttgcattgtttctgacaagaaatctgccatgagtcttgtctttgtttctctgtacataatgtgtcttttttctctggttgcttttaggatttcgttcttatcacgggttctgaacagtttggttgtgatgtgtctcgtggttttcttcatgtttcttgtgcttgaggtttccttgtgtggagctacttagatctgtgggttggttagttttcaacaaaattgcacatttttcaactcttattttttcaaatatttattctgtccttcctctctctcctccacttcagggaccttaattatggattaagctgattaaagtttcccactgatacagaacagctgggcttctggctaaacctcagccttgagcttggaactgtggccctaagtgaaaacagctgaccttgcttttccacccaaaagttgctttttggcctgccacacccctattctgtgcccataaaaagacttcagctggcagagcaacacaagcagctgatgcaagcagtcagggatgcaggccgccgagtgtcagggatacaagtggctgagtggcaagcagaaaggcatcaactgaatgtcagagattacggatagacgcagataacttcagacagtgcggcttcagggaaaggtcgccttcttcctgcacccttcttcccataccatcccctttccaactccccattctgctgagagccatatccatcacccaagaaaatcctccacatacactacccttcaatccgtttgagttacctgattcttcccgaacaccaaacaagaacctgagtgccgagaggacaggggtttggatgctgccacaggcctgcacagagcctgctcccaccagagaggagtgaccagctggttccagtgttcattccctctgtttcccacgctcacttgctcacacactccctctcacgaggagtggccagcagcaggctgaaggaaacaagccactccagttcccacccacaaagggggtcaaggtcaaaggaactgtcccatctcaccacactcagtgatggaccatttattaaattcttctttctctgtgtgtttcctgttgggtcatctccgccattgtcttgaagtttacgaatctttcttctggaatctcttccatggtcattaatcccatccaacgtatttttcatctcagccagtgtagctttcatctctgaaagtttattttgggtcctttttatatcttccatgtctctccttaactatttgaacatacagaatacaggtattgtgattatttcaatatccttgtctgctcattctaacatctgtgctagttctgacttggttttgattgatttagttttcacctcattacagattgaatttttatgcttctttgaatacctggtaattttttattagatgtcagacattagggattttgccttgttgaatactggatatttttgtattcttataaatattcttggacaaattaagtgacttggaaacagtctcagttttgcttgcttgctttgaatacttcttaggtgggactgagccatgattaatctaggactcattcctcctcattactgaggtaaaacctttctgagtgctgtacccaatgcccaataaggtgaaacatgaagttttctagtctggcttatgggaacaggtgctactcctggccctatctcactgtttaactaaaatatttaaaaacaacacaggagtttaaaaaaattcagaactgtcacaggttgccataattagaaattgcacatggatctgataaaatgttgttctatcagctaacactggagttccactcaggaagaggatggactttggttttgaaaataccttgagaggtcactctagttcggaggtgaggcttcaacagtttatctggaaggaggcagtgaaaaaagagagccaaaatggtctgtgtaagaggttaggagaaatctgggtatggtggaaggaagtgaattaattaaggcaaaaggtcgagggaagggagacaggaggccagattgttcctggaaccgagccgggtctggctgtgttttctcgtggcccaataacgagaagcagacaaactaggaaagaagggaatttcttgtagtaaccagatacagggagaaggtcagagataattccactagaccaactcaaagtgttacaattttcttagtgcttatatagattggggtcatatgcctatgtgcagtatcacattcacctaagtctatgggtaactaatttcgtttcaactagaagatcagaggccaaaaaatgctttctaagtctgatcaagctgtgagggccccagtaccttcaaggcctgtctcctaaattctatttaatgaggactgtggtaccagagtgattattcctatcttatctcatttgcagtttggtccagagagctgccttaaactctcccataaatctattcaaacagctgcctcagttaccttgactcatctcagacttcattaacctgagatgggtcctggcacgaggagtgtaaggctgtctccatcatcttggcttgctccagctttgggagaagactgtgtaggaagtgtgtttcatttctggctttgatgtctgggcatcaatttccctgggtttaattattagcttaatgttgaggcagtgctgtggaaatgtgtctgtgtagctggggtgctctgcaggcctgtttgtgtgatggtcagggagaattgacctgccacagctggcccagaagcgggtagagatataggcagtgaaatagaaactcttcatgagatggacaaaagaccgaagcaggggtgtctaatattcaattttaggtttgattcatatctaacattagactgagattcagatgtggtggtataaacctctccatggcctcaagttgtcggtaaaattcagctatttatgcagccttggtcgatggcttgtcaaaaaatgaaattatcaaaatcatggccagttagggcagcgaggtgcaagctgggatgaagagatgttccattagctgaaacgattttgcagaatcaggatttcagagctagggatgacctggaaaaatgtaatacatatgcccttcaccctatgaatcccccaaagagtttgaagggaactctagatctccaggtacacctgggatggaggttcaagtcaatttcactcaaaacccaaaggacagggtcaacttcagttgacatgtcaattaagtatgattaattctcaaactagtgacaccaacaacgggtggtaagcattcagaagagagtctgtcaggaggacctggttcagctgccttaaacatgtgtcagaaatcgacttcgacctttgccttcgcatctccccttgggacaatgggcttttgtactccagtgtataaatttatgatgttatctgttctccgcaacaaatatgacatcatggtacagcccagaagcaatgttatctttttccccctcaaggttagattgtccctaccattcctcgctgcagtggcagagctgcagagggattggctgaggtttgcttcaagtgtcatactgctatttacagcaggtgaaacagttccttctagaagggacctctgttatctcccccagtgcccactggtgtcctaggaaagcacagttgacactgggctttaagcagccattaaagataacactgggctttaagcagcctttctaggcagggcacagtggctcatgcctgtaatccctgcactttgggaggccaaggtgggtggatcacttgaagtcaggagttcaagaccagcccggccaacatggcgaaaccccatgtctactaaaaatacaaaaaattagccaggcatggtggtggcaggtgcctgtaatcccagctactcaggaggctgaggcaggagaatcgtttgaacccaggaggcagaggttgcagtgagccgagatcacaccactgcactccaacctgggtgacagagcaagactccatcaaaaaaaaaaaaaaaattaaaaattaaaaaaaaaaggatctttctgtctattcatcagtgaacctaggaatgcattttaaactttgcccttgggtattttccctgttgcagatgaaggctattgaggctatttcttcttgccggcttgccttcacacctccttcaaaggtagtttctttaaaatgttttattagaaacctaaagttaaaacttttagttactcccaatttttactgagccttgagcactctgcattcacagttgagggtagctgcgcctcccactgtccccaccgcgcagaactaggatgtgggtccaggtcccagcaaccctgcaccccagtcctagaaggtactgcagaatccttccctgctttgcctttatagttttaagttggggactctcttgagtaggcagcagagagcgctgacatatataatagaatgtagaatataaaaaagatagaatttctgacagtgcagaataaaaggtgctgaaaaaaatggatggtgagttagaataaaacaaagttgcattcctcacttactttttgcttatataaaaatccagggccatgcaaggtggctcatgcctataatcccagcacttcgggaggctgaggcggatggatcacctgagttcagttcgagaccagccaaaacaaagcattaaaaattaaaccataaaaggatgaaaagaaaatgtaatagattcttccaataaactgaacatgaggaacttaactccccttgcccccactgacctatgctacaaggtggataagactcacacttttagctaagtgaaagtagccagagacataaagtatggaccactgacatgaaatatctagaacaggcaaatctgtagagatagacagtagatgagttgttgcccagggctggaatgggtgtgggggcggggagttggggctgagagctaaggggtgcatgcaggggttcctttttggagtaatgaaagtattctaaaatgtattgtgatgataaatgcataactctgttaatacactaaaagcaattggattatacattttaaatgagtgaactctatgcagcgtgaattatatcttagtataactgtttttttttttttaaaaaaaaaaaaaaaaaagaatgaaggagccaggcgcggtggctcatgcctgtaatcccagcactttgggaggccgaggcaggtggatcgcctgaggtcaggagttcgaagaccagcctggccaacatggtgaaatcctgtctctactaaaaatacaaaaattagccgggtgtggtggtatgcgcctgtagtcccagccactctgggaggctgaggcagaagaatcgcttgaacctgggaggcagaggttgcagtgagctgagatcgtgccactgcactccagcctaggggatagagcaagactgtctcaaaaaaaaacaaaaacaaaaacaaaaaagtagataagtgaaatgaaaatgaaaaccatccattagccctctacctagaggtagtcactattgaaaatttgacttatgtcccttagttcttttttttttttttttgggtcggagtcttgctttgtcacccaggctggagtgcagtggtgcaatctcggctcactgcaacctctgccttccaggttcaagcaattctcctgcctcagcctcccaagtagctggaattacaggtgcccaccactgcacctggctaatttttgtatttttagtagagatgggttttgccatgttggccaggctggtcttgaactcccagcctcatgtgatctgctggcctcagcctcccaaagtgctgggattacaggcattagccactgtgcccggccttacctacattttcaaactttttctctaataaacaaatgttactttgtcattattattattattattatttctgagaaagagtcttgctctgttgccgaggctgaagtgcagtggtgtgatctcagctcacttcaacttccacctcccaggttcaagcaattctcctgcctcagcctcctgaatagctgagattacaggtgcgtgccaccacacccggctaatttttgtatttttagtagagacagagtttcaccgtgttggccaggctgctctcaaaactcctgacctcgtgatccacgtgcctcgctcctgaagtgctgggattgcagatgtgaaccaccgggcccagcctctaataagcaaatgttacattagaaggaaagaaggcaggcaggaaggacgggaggcaagaaggaaggaaaaaaggaaggcaggagggaaggaagaaaggaaggcaggcaggaaggaaatatttggtttcttttcctaagatgcaacaggtggaaaccatgatctatgtctgctcatggctccatgacctcctgctcattgtgttgaagaatgtttcttttccttggttcttacatgagattggattggtttccatgttaattaagaagatgtttgctctctgaatgagttaacaacttgtgaagtcttcatctgacctcctgtagttcacctggaattgctcagatcaagtagtgaaactttgggatgatcccctgaagttcagatcccttcgactactaaatatatttaatccctcttctatgtgtaagaataatctgccgatctattacaaaaatctataaaggatatcattcccctctcaaagaccctcttactctgtcctgcattaaactaggcacttccagcttggagcccaactaggtttcctattggagatctcagtctgatggatggcagtctaatcggaatgatccctgtcctcatggagcgcacagtgctggggaacatcctgggactgctgggaatgccagtcagggaagcaggagcccaatcaccaaaggccaagtccccaggtcaacagtttgaactccttcctttggcaagagggcagggaagagccctgttgaggggtttgaggcaaaaaaggcctattgatagttgaaagaccaccttggctaccaggtaggaaggaatttgtgtgggagagcctggaggcagggagggcggccccttagtagttccagccttgaggtcagattgcagacactacatggtcattggctgtaagcctctagttcctcccactaagaatgcaggacatcacagagccattctcacagcactccacgccttctaacattctgcctcaggctgcatttactaccacatcccagctggcttaggcctgggtcacctgctcagccccagcaggttgtggataaatccctatttgaagaggttcttgtttctttttttgacccctaatttatttcctcatctttattaaggtatacttgacaattggaaatcatatatatttaaggtatagaatgtgatgactcaacatacatttacattgtgaaacgatggctacagtcaagttaattaacacatccctcgcttcctaccgtttccattttgtgtgtgtggtgataacactttagatcaactctcttagcaaatttcaagtatacagtagtgtattgttaactatagtcacattgctgtatataagatccccagaacttattcatcctgtttaactgaactttcctaccctttgtggatgttttgttttgttttgttttgtttgtttttagagaggaggtcccactatgctgcccaggctggccttggactcttggactcaagtgattttcctgtctcagccttccaaatagctggggttatacgcatgagccactgtgcccatcttctttgtacccttggcccaacatctctccatttctgccatccttgcccccgcccttggcaaccacaattctactctctgctgctgtttgactttttcagattctacatttaagtgagatcgtacagtatgtgtctttctatgcctggcttattttatttggcctgacaccctctaggttcatctgtgttgctgaaaatggcaggcacagctccagccttctgtggccacctgaggggacttccagcgtttcccaaggttccgactgtcctaggatactctccaagtacattgttttgagcaatggcagagcccaggctgcaacactggcttacaaaaatttgcctggtggggccgggcgctgtggctcacgcctgtaatcccagcactttaggaggccgaggcaagtggatcacgaggtcaggagatcgagaccatcctggcaaacacggtaaaaccccgtctctactaaaaatacaaaaaaattagccggacatgggggcgggtgcctatagtcccagctactcaggtggctgaggcaggagaagggcatgaatccgaggggtggagcttgcagtgagctgagatcacgccactgcactccagcctgggtgacagagcaagactctatctcaaaaaaaaaaaaaatgaaaaatttgcctggtggaaggtgaaggctttcactgccattccaggtggaaaggcctccaagatgacttagaaaatttcgtgttggacaggcttgtcctaggaggccccagcttcagcttacaggcctctacacggcagctaggaccatggtgagggacgcttctaaatctttccataggctcagaaagagagggatgccctccccagatctcctcagcaagcttgagatggtccctgcctccaaaggggacttacagtatttcagaaggttcacctctgaagggaccccaggtggtacagacatagcccaagaccagtggtgtgcatttatgacttaaggacaaccctccggttatcatcctgagatgggacagcctttgtgacaaccctccggttatcatcctgagatgggacagcctttgtgaggggagaaactctcttcagtgttgtataaagacatgacaatcgtcacccttggaaagaacaaaagtaaaaatggtgatgaataacaatagaaatggtgatgatcatcgtaatgtaaaagatagtattattttaagataatataataatattttaggataagaatattgaactagggagatgaaaaataaatacataaatgaatgatggaaatacataaatgaagacggaaaacaaatacataaatcaatgtcaggggtcacctccaagtgtcagggttacactcagtttaggatttatgtgtgtgtgtgtgtgtgtgtgtgtgtgtgtgtgtgtgctttcatgatttcttcattctctgcattgagtgtatatgattgcactaattgttgaggaaaggcatattttccaaagctattttaaattgtttgctctattctagagaagggaaccaaaatatccctctctaaaatcctggggattggatggcaggatggcaatttacaaagacaaaggtcttcttgtcctcctccctgccttttccacctaaagacaagggccttcacaacattagcttctcagctgggaggcagcagcacccaaggacctaggagcagactttactctttccataaatttatcctcctgcattttcctgctttttggaagcctgaagatgctgtcttctttgtcttatcattataggatttatggctctttgttaaaatactatttgagcaaggtccgaaggccactgccttgagagagaaatactcttgaacaaaggcctctccagcgttatgggtacagcgcatgtcagtagacttcgctggtttttccctttttaatctggcttttgttttcaaggggggtgtttcaactaagaacccatgagggaaagaaaagaaattatattttctcccttacagtattatgttcaaagaaaacagccagcacctttaagaagaatttcccaactggattcaggctaagatgctaccaacagtttggctgagggctgcctgaagctgagggttgtccttctgtcacaaggtcaagaagggcctcctggctgggccgggtggctcacgcctgtaatcctagcactttgggaggcccaggtgggtggatcacctgagctcaggagttcgagaccagcttgggaaatatggcgaaacaccgtctctactaaaaatacaaaaaatgagccaggcatggtggtgcacacctctaatcccaggtactgggaaggctgaggcatgagaatcactggaacctggaaggtggaagtactggaacccagaaggtgggtgacagagcaagactctgtctcaaaaaaaaaaggacctcattcaagtggaaccaggagggacagagattgattccagggttgtctgcatcctgacaaactaacagggctggaccaggcaggaagctggctcttcagaatgaacatcctgtggaagttgacaattaaaagcccagacctggccgggcgtggtggctcatgcctgtaatcccagcactttgggaggctgaaatgggtggatcacttgaggtcaggagttcgaggccagcatggccaatatggtgaaaccccatctctactaaaaaataagaataaaataaaagcccagaccttcgcaagtctgaggcagaagctgagctcagctcccacaaaggggctactgtcagcccagggccactgccttcaggtcccctcagcctgtgactgctccatcaaggccaccaaaatcccacctgagggcctggcgcagtggttcacacctgtaatcccagcactttgggaggccgaggagggcagatcacttgcactcaggagttcaagaccagcctgagcaaacagtgaaaccatgtctctactaaaaatacaaaattggccgggtatggtggcacacacctataattccagctatttggaaggctgaggcaagaatcgcttgaacctgggagggggaggttgcagtgagctaagataacgccactgcactctaacctgggcaaagtgagactatgtctcaaaaaaaaaaaaaaaaaaaatcccacctgagcctctcaatgattcactgaagatgtttatcttctgagagcttcagcataaactctaatttccagagacacttgtatttggattttgttaagtaggtaggaacacaactggaatgcctactgtgcctagacagttctttctttaaaaatctttatttagttctatatgaaatttaaagtagttttttctaattctgtgaagaaagtcaatggtagcatgatggggatagcattgaaactataaattactttggtcagtatggccattttcacgatattgattcttcctatccatgagcatggaatgtttttccatttgtttgtgtcctctcttatttccttgagcagtggtgtgtagttctccttgaagaggtccttcacatccctttaagtggtattccgaagtattttattctctttgtagcaattgtgaatgggagttcactcatgatttggctctctgtttgtctgttattggtgtataggaatgcttgtgatttttgcacattgattttgtatcctgagactttgctgaagttgcttatcagcttaaggagatttggggttgagacgatggggttttctaaatatacaatcatgtcatctgcaaacagagacaatttgacttcctgtcttcctatatgagtaccctttatttctttctcttgcctgattgccctggccagaacttccaatactatgttaaataggagtggtgagagagggcatcgttgtcctgtgctggttttcagagggaatgcttccagtttttgcgcattcagtatgattgggtgggtttgtcataaatagctcttattattttgagacacattcc

SEQ ID NO: 593 - DNA, 40001 bp, Homo sapiens
caagatcctggagttttcgtagacattgtcctgatacttccccttgggcaataccagcgcctgcaggcaacagctctgacgcacttaagacttaaatactacccacagaagtgctggcttggctgggaaaaccttttgctaaatagaagaacaacatttttttttcttttctggaatttgcaaacagcatttattctcagccttgccttccaaacgttccaattggacattgctgggcagcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagtggggcgtaaggctgagagtggggagagcaatccaggggcgccagggtgggagccgcagcgggcccgcggccgcccggaggacactgatgcttctggagctcgcgaagggtcccccgcgggagaggaacaaggccgcttgcgctccgcagaggcgcaggcacggggctggggcccggggcgggggcgcgggtgggcggacccctcccgcaagcccatgatggccaggccaaggccgctgggaaaggcaggacgctcgcccatgcgctgccagctgggcttttctccttcgcccgccctgtgttccagggcgcgaccccgttcggtccagccgctggctccggggctgaaccccaggtaggtgggtcggagcccctgagagaactggggcttgagggcgtttctgcttccaagcgcaagcacggggagccctgatgctccagcccctggacactggattggaaactggcaagggtaggagatgttttgcaggaggccgccctctgtcttcctctgttctaacacctgctggacacagggaatcctgatacctgtattttttaccagaaaaaaattctaacagcagaaaagtcaatgtgatgggttacgcctccttaacgtgccccatttgaccttgtaagcttccttccacaggctgaccttgttttgtgcaatcagtgtgatcttttgtcagctatgcaaaacagtttttgtttactgaatctggtttaaaaggcaagaagttgcttcccatagggcactttgatccttggtgtagggcactttgatcctcggtggaaagggatgtgtatgccttgaaacatggagagtcacatgcgatgcttggttttgtgtagaactaacatgagataatcttttcactggttttcagaattgtggagaattcacttaggaaaataagcatgtgtatcaatggatgactaatatggacatgtactttaactgatttcacagaagcagtgctcctgatattttgagacactaattttatttggttcttctttaccatatgatcaattagctgcttacctcataagttacagagggagaaggtacttcctgttttctctttatatctcttgtcccttatttaaagaagcaatagggcacgtgcagtgcctcactcctgtaatcccagcactttgggaggccaagacaggagaactgcttgagcacaggagttcaagaccagtctgggcaacatggcaagacctcatctctacaaaaaataccaaaaaaattatccgggtgtggtggccgcacgcctgtagccccagctactcgggagctgaggtaggaggatgattgagcccaggaggacaaggctgcagtgagccaagattgcaccactgcactacagcctgggcagcagagcgagagcttgtgccaaaaaaaaaaatattttttaaaaaaagaagtaataaaggagaaatctttttgctacgtttaacttatcctccactattctaaagtttaagcttcaataatttataagtacagtgacattaacactttaaagttagctgatatgctgatatgcttaaaaactggaaaatatttcaattttaaaaaattctaggtggggtatggtggctcatgcctgtaatcccagcactttgggaggctgaggtgggtagatcactaggtcaggagttcgagaccagcctaactaacatggtgaaaccccatctctactaaaaatacaaaaattagctgggcatggtggcacgcacctgtaatcccagctactcagcaggttgaggcagaggaatcgctcgaacctgggaggcggaggttgtagtgagctgagatcatgccgctgcactccagcctgggtgacagagactcggtctcaaaaaaaaaaaattctattccatctagtaattgacgcatatgatacatatgcatacatgtgtaaaagtgtatatctattcatatgtatatgaaataggtatattatacattgtactgagtttatacttttattggcctttttgactttaaaagtgggttatacagacctgtgaaacaagcagcaaaaatgaaaacactgcacttttgtgtgattccgtaaacacacaagaatagtggaggtcaggatccatgctgctggccaggcgttaagttggcgttatcaataatcactgtagtctctgtgggtgctgatgaatctgaattccccacatgtcgtgccttgggaattgctcctttgactagattactgttttgaggttgacgctgttgtgtttcttacaagagtagaaaacaagtgcacaaaaatggatttaggtaagtggaaatttaatgcagtcacagcagtgccccacacaaacaaagtgatctacaaatgtagccttgataagggtccctcgctaggccagtcgtcacctactccctctgctggatgacagccctccggtatctgcactcagctcccacgttcctggagcttctcttctcagactgcgcagcgcccagagcttcaggtctctccatatccttcatcaacacctcctgaaagcgtgagaccttggagaggcccatgtcctccaggtgtggccaggagagctgagacagagccctggggtcctttcttatcaacccttgtttgggtgttctatttctgttaatcctccaaatagtcattttaaaaaataccattcattttaaaccggtagctcagctgtcctgtgtaagctccacaccctcaactctatagctgattacgtagttcattattaagctaatttaagaaatgttaaatatatgaaaaagtacagagggagcaaacattgaagcaacttaccaactttcccacaacctgcagttaacaattgtgaacattttctccttttaacttttccccagtccctggaactttctggctcatcctctcttctctaacccagtctccctcagccacaatcatgatgaagtgtgtactcatccaacctgttttggaacatttaaaaattcttttaattagtttttaaaagtcaactttatatatgctcatagtttaaagagtcaaaaagttctataaaaaagcttgaatttccttctccccagaggcaaacacttcgactctttaaactgatcctgttggcatttaccttcaaatctctaaataaccttctgaccctggtacttcttttttctcttttaatcattacctatggacttcccaccctgcaatattaggatttaattctctttaatgtaccatcaacaatataccacacacacacacacacacacaccatacatacactgtgtgcacacataccgcacacaccacacacctcacacaacacaccacacacccacaacacaccatacaccatgtacacacacagaccacacacagatcacccaccacacgctgcacacacacaccgtacatacactatgcacatacaccatgcttacaccatgcacacacatcatatacacacctcacacataccacaaatccataacacatatacagtcacaccatgcacaccacacagcatgcacacacacaccacacccacacagtatgcacaccctacttttcattgtttgaggaacctccattctgttttccataatggccacaatttacatttcccccaacagtgtgccaagcttcccttttctccgtatcctcaccaacacgagtcatcttttgcctttttgataatagtcattctagtaggtttaaggtgatattagagtgtaggtttttcttttgttttgttttttatttttagagataggtcttactctgtcacccaggctggagtgcagaggtgcgatcatagctcactgtaacttcaaactcctgggtttaagcaatcttcctgcctcagcctcccaagtagctagaactacaggtacacaataccatgcccagctaattctttatttctttatagggacagggtctcactatgttgctcaggctggtctcaaaactcctggcctcaagcaattctctctccttagcctcccaaagtgctgggattataggcgtgagccaccatgcccagcccatatatttctttgatttgcatttttctgatgagtagtgaatttgagcacctttttatatacctgttctccacttgtctgtcttttgttgataaatgtctattcaggtcctttgcccatttaaaaaattgggttatttgggttttctttttgccactgagttgtttgagcttcttacatatttttgaagttaaccccaatcagatgtatggtttgcaaatattttctcccattcctaatgttactttttcgttctgttgattgtttcctttgctgtgcagaaatgtcatgcaatcccatttgtctattttgtttttgttacctttcctttggggtcatatccaacaaatcaatgcccaaaccaatgtcaagaagcttttcttctgtgttttcttccagtaatttcacagttttagatcttatgtttatgtttttaatctactttgagttattttttgtatgtggtgtgagataaaggtccaatttcattcttctctatgtgaatattcagttttcccagtaccatttatggaggagacaatctatttcccattttgtgttcttgtcacccttgtcaaagatcagctgaatgtagatgcatggatttatttctggattctctatttggtttcattgatctttgtgtttgttttcatgccagtaccatactgttttgattactgttgctttgtaatatatatcagaaaatataatgcttccagctgtgttctctgctcaagattgttttggctattcaggttcttttgtggttccatatgaattttaggattgtttttctttttttgtaaataattatattggaattttcataggaattgcattcaatctgtagatcacttcagatggtatagacattttaatgatattaattctttcaatccatgaacatgggctgtcatatggtgtgtgtgtgtgtgtgtcttctttaatttccttcatcaatgttttataattttcaatgtacaagtctttcacttctttggttaagtttattcctaagtattttattctttttggttctattttaaatgacattgttttcttgattttcttttaaaaatagttgtgtatagaaatgatactgacttttatatgttgattttgtatcgtgcaacattactgaattcattttattaattccaacagttattttgttgaggccctagagttttctacatatatgatcatgtcatctgcaaacagagataattttacttctccctttctgattttcatgcctttgcttctttttcttctttaattatttcagcttggttttagagtactatgttgaatagaagtggtgagagtgaacatccttgccgtgtaccaggaaatctttccattttccactctttgattatgatgttaactgtgggcttttcatatattacctttgttgtgttgagataagttatttctatgcctattttattgagtgttttaatcatgagtgaatgttgaacttgtcaaatgttttttctctattgagatgatcatgttgttgttttcttttattttgttaatgtggtgtatcacattgactgatttgtgtatgttgaaccattcttttaatgtgctgtggaattgggttttctagcattttattggggaatttcacatctgtgttcatcaaggatattggcctgtagttttcctttcttgtggtatctttatctggctttggtattaaggtgatgctagactcataaaatgagtttggaagttttccttcttctgttttttggaagaattcaagaaaagttgcaattaatttttctttacacgtttgataaaatttacccatgaagtcatctggacctgggctttcctttttaggaatgggagtggggttgatgactgattcaacttccttttgttattggtctattcagcctttctatttcttcttgattcagttttggtaggttgtatgtttttaggaattgatccattccttctagattctccaatttgttggtgtataatcgttcataatagctccttataatacttttatttctgagatatccattgtaatactttttttcatttctagttttatttatttacatttctctcttcttttcttagtctagctaagagttcattgatattattttctttttcaaaaagccaagtcttagttttgttgttttttctgaggggaagggggttctcttatctatttgatttacttttgctctgatctttattatttcctttcttctgttaactttgcttggtttgttcttctttttctacttctttgagatgtaaagttaggttgtttatctgatatctattttttttgatgaaggcattttttgttataaacttccctgttaatacttcttttgctgcatcccatgagttttgagatattttgttttcattttcatatttttaaaacattctttgatttcctctttgacctaatggttgttcaggagcatgttgattggttttcatgtatttgtgattttttttttactgttattgattactagtttcattcctttgcgattaggaaagatatttgaaatgaatttgctcttcttgaatattttaagatttgttttgtgacctagcatgtgatatatctgatcctgtgtgcacttgagaaaatgtgtattcatttgctgttggttggagcagtctgtgtatgtctgttaggtccgttttgtctttagtgttgttagttctgctgttactgcttttctgtctgcatgatctatccattataaagagtacagtattgaagtcacctactgttattgtattgctgtctgtttctcccttcaggtctgtcagtgtttgctttatatatttagatgcacttggatgttgggtgaatatatacttataattggtatatcttcctgatgaattgacccttttatcattatataatgaccatctttgtctcttgtaacagtttttaaaagtctattttgtccgatgtaattatagccactcctgttttcttttcgttatcattttcatagaatatttttttccatcttttcattttcagccaaggtgtgtccttaaagttgaagtgagtctcttgtaggcagcatgtgttggatcctagtttttatcctgttcaactactgtatgtcttttgattggagaatttaatccatttacattaaagtaattattgataggaaagaatttgcttttgttattttgttaattgtttttctgacttatgcctaattcctttgttcctttcgtcctgtctttctgttgtcttttgtttaaaaaaaattggataatttttggagtggtattctttggttcctttctttttatcttttgtgtatcaactagacatttttttgttttggttatcaggaggcttacaataaacattttatagttgtaacaatctattttaagttgataacaatttaagttagagtgcatacgaaaactacacttttacttctccttcatcccattttgttattgatgtcacaatttacatctctttatactgtgtatccattaatacgttattatacctatatttattttcaatacttttgtcttttatactaaatttaaaagtgaaatatataccatcattacactattagactattttgaatttgactatatacttacatttgccagtgagctttatattttcatatacttacatgttactagttagcacccttttgtttcaacttgaagaattcctttatcatttcttttaagggggtaattctagcagtgatgaacacccccagctcttgtttgtctgagaaaatctttatctctccatttctaaaggacagactttttgtgtgtagaattcttggctaacaattttattctttcagcactttgaatgtaacaccccattctctcctgttctgcaaggttaatgcagaaaaatttgctgatagcttatgaggaggggagcagctgtatgtgatggtcacttttcttttgctgctttctaaatttactctttgtctttgacttttgccaatttacttataatgtgttttggtataattttatttgggttgatcctctttggggatttttgagtttgatatacctgatgtccatattccttgcaaggttttggaagttttcaggcattatttatttaaataaggtttctgtttttctctctcattccttctaggacatccataatatatatatagtttccctttataatgtcacgtaaatcctgttgactttcttactttttttcattttttttcttttcatcatctaactggataatttcattgacctgtcttcaagttcacaaattcttctcatttttatagagcctgctgcagaagctctttgttgcattttttcccatttcattcactgcatcctgcagctctagaatttctgtttagttctttttttatgatttctagcctttcgttgaaattcttattttgtttatgaattggttttctgatttttgtagatttatgtattcttgttgtcttgtagctcactgaatttccttaaaaatggttattctcaattatttgtcatacagttcatgtatctccatttctttagggtcggttactggaactttattagtttcttttgatggtgccatgtttgcctgcttcttcatgatccatacagccttgtgttgatgtctgtttatttgaaggaacaaacacttcttcctgtctttacatactgatttctgcaggtaaagaccccctgccatgtcctcagactgatgagactgcttcctggattgtaattgagtgagattggagtcgggtcacatggatgctgcaaggtcttcagttggatccacctgttactggagggtgcaggcaggcaggcagggttactgctggatccccaggtgcatgggactgactctgggaccatgatcaagtaaggctggagccaagctacagagacacttcttggtctgcacttgagtccacagatggtaggcctgttatcagggtagacagctgtggctactgctgggtccctgagtgggcttccacctggatgggtgcctctgggactgtgggagagcagagatggagctgagtcacagagctgcttcatggtctgcagtcaggaccaaggtcggcagtcttgttaccagaagtgctgatgggtatagggtgctctcatggtccctgggcaggcaggcctgcctccagaccaccattgaatggatctggagctggaccacagggctgcatcaggatccagtcaggactgaagtcagcaggcctactaccaggggcacagataggtgtcactgcattcctgagcaggcaggactgactcaggacgatggtagagtggggctggggctgggccacaggcctgcttcaggatccacattcaggacaggggcagcaggtctgttactgggggcacagacaggcatgggttattctggtttccttaccagatggagctggttgcaggctgcaaccaaacggggctggagccaactccgtaggaggatggggctgctttggtgtacagctaggaccacattcagcaagcctactacgggggttcaggtctgctttcttaaagtacctctcctccgtcttgggctttaccagggtttcataaccttctacctggatcctagagctcccacagaggcacttttgtccatggatggctgccagattgttgtttgtgtcaaggagacggaggatgcaagctggagacctcctgttccaccatattaatcatatcactccaatttttcttttgttgcatgtgcttttggtgtcatgtccaagaatcctttgtcaaattcaaggtcatgaagataaaccctatattttcttctaaaagcattatggttttagctcttatatatatgttcttttgcatgtggctatccatttgtcccaccactatttgttgaaaagactttttctccatttgcacccctgttgaatatcaattgactcagtaatcttaatatcttgtatgtctataaatgtcttaactctacctttatacctaattaacggtttggctgggtaaatagttcatttttactcagaactactttttagtttctgtggcactgttaagatgtcttatgccattctcattctttatgctttgcgtgcaacctgtattttctctctaataatttgtaggacttttttaatgctagtactctaatacttcattatgacatacactcatgtgggtttgctttttgggagggccatttaattacacaaattcacgtcctttagttctagagatttttcttcatcttcattataaacacacatatacacacatacatatgcatacatgtgtttcacttttacgttgttcatatatataaatacacagacattatgacatctcagtgatatatacacacacattttgacattttacccaagaaaatatggatattcttatacataaccatgatactctttcaacatacttttaaacattaaaaataattccgtaacattatttaataccctgtttatattctagtatctctaattgtcctcaaaatgcctgttatagtcgtcattgttctttgagtcaggatccagtcaatatcacgtattacatcaggttgttgtgtctcaattctttcttaatctagactagccctacacacacacaggcacacacacacatgcacacatacacacatgaatacatacacacactttttctcattgttcattaaatttgattttcctgattagcagggattttatgttttttctgtagatttcttcctactagcctgttgcaaatttttatattgtgacttgtttttgtttcgttttggttttgttgagacggagtctctctctgtcgccaggctggagcatagtggtgcaatctcggctcactgcaacctccacctcccaggttcaagcaacattcctgcctcagcctcccaagtagctgggattacaggcgcccaccaccacgcccggctaattttttgtatttttagtagagagggatttcaccatattggccaggatggtctcaactcttgacctcgtgatccgcccgccttggcatcccaaagtgctgggattacaggcgtgagccaccacgacttgctgttttgttttgtttttagacacacacagggtctctctatgttgctcaggctggtctcaaactcctggcttcaggtgatcctcctgcctcagtttcccatatagctgggattatgagcacaagtcaccacatccagccatttttcaaaaaatgttacctatccctcccagtgttccttttccaggtcatgataaaagcaccgaatagaactggaccgatgacatggccctctgacatggcactagaaactgcccttcaagtggatggtgatctatccagcaagaatttttggatacagtaatgtcacctgctataatttcacttcatgcttctgctttttgcacagggctagtgtgagcatccctgtgcaatggcttattgggaaattgatgtgcattgcaccggaagcaatctcctcatcttcctgcttactcatcagactgaaaaaggcaacacagactaccattcattgtgtggctacaaggcactatgcattttcatacaatatatctaaagcccataatactcaccaaaataaaccattgctgccacaatttaagagatgagtggaatgaagctcaggggtaaagtaatgggtttaaattatagtcttatctgactccaaaaaccattctcttgctatttcttcatacagcttatcaggatcaccatgtcctgatctttttctgagcattcagtctcctatttcctaagtgctcagcaaaacatttgccagcccaattcttaatttcattatcatcagcaaaatgaataatcagaattaattggtgaatggtttcttcctagcacccctttaagaaactttcccctgcaatctccatgggcactagcttcagcccttgagtataaataagtcagtaataaagaatgtaggagcctaataataaagagtgggtttttaattattaaaaaaaagttttaaattaaatctcctccaaacatagacacacacacacacgtacacacacacacacacgatgtgaaaatctcaaagacaactgatgattacttttatgcaaatttatgtgatagtaaagaaatgcacagtaggtatgaatctctacattttccttacctttcaagaaataactttaaagaaaataggaatattgtttagtataggaaactctggccaataagctgaaatctatacctgcatctagaagcctcacctgagagatggctaagcctatttcctagcccccaaatcaccttgatacctatgccatctcctcacgggtggtaatcagagaaagctgtaaaatcccttctttgatcccttctgggacttcaccgattggagtggctcttttctttggttcaattatatcagaaaataattaaacatgttggaatgaataaataagttaacttccaacattttctttattttatttatgttttgagacagagtctcactctatcacccaggctggagtgcagtggcaccatcttgcctcactgcagcctcaactcccccatgcacgggtgatcctcccacctcagcctcccaagtagctgggactatacgctcataacaacacactcagctactttttatatattttgcagagaccaagttttgccatgttgctcagtttagttttgaacacctgggcttaagtgatctgcccacctcagcctaccaaagtgctagagttataggcaagagccactacacccggcccaacattttcacatacataattgcaaaatatttgtcttttgaaaactttacattataaattctttagatagaaacaaaaagttattaggaaaccaaaattaaaatgaaaggcaataaaatattggttattcttccatgtattcatgtaacaaatgtgtgtggattgtgcaccatatcatagaccctgggacaaagctgaaatgaagaacaggcaggcatggccatagcccacactgagctcacaggtgagtggggtgacagacaaggacacaggcaattacactcagtatgggaaacccacagtggggaagcaaggggtggtgggtgtccgttggaggcctaacccagcattggtggagagggtcaggagagacttctgaggtcatttctgtgctgatatctgaaggaagaatgagtgagaaaagttggctgagggcgtggggatggaataatctttcaggcagagggaagaatatttgtaagatctagagctaattgaaaggcacccatattggaggatataagcataactgatagtgcctgtgagatgggtattgccaaaatgtgaagctggagaagtaaaccaagatcagaccatgaaagtctttacaacataccagagagtgacatattgggttgacatatcagtagggtaatgctgtgggtaggagttcagttaggagaatgttgaaataatgcaggtgcaaggtgacagtggcctgaaccaggataatggtgatgagtgtctagggaagcaggtggccaaggatggacttggatggattggattgggaagtggggatggagtggtaggcaaggaatagggagaggtggagtacagaacccaggtttctgatttgtgtaaaaggtgatgatgttcactgatgaaggagaacacaggaataaaaacggatggcagggaatgtgggaacttgacgggtgggttgaatgttcaaatagaagcatacagacaggtatcagacatacatgtagtctaagggatataagcatggaattctcagcacagagaggcttcttgaagccacaggagtccacatgcagggtgagaagggaagagagatcaaggcacaatccctgaggaactccagcatcaaaggaggagagcttcaggagacgaggaaacatggaggaagacataggcttttagggagacagtggagtatgatgtcacaggctcgacaatgaacaaaggtatagttgcacatacattggggcacagaaaacattctttctgagactcaaacatgagcccactcatttcttgttcagctactctattcctggcatatagatatgaaggcttataaacaatcctggcctgggaacttaaaatctgtgtgatgaagccaaacacagtaataatagcatcagtgaccaaaacagtgtattcattacagaacctgaaagtgctcatcactttgtggaattttggttaaaatgtcttactacccattcacaggtagctgcctcctgagagaggcccacaacacgggtagtggaggcataaaaagtccttcatttctcaacaatgagaatgagagggtagccattggtggaaaagacagtgggcttccagtgggccgaaaggagaaagaagtggtcactgatgttccaggctggagtgagcccatatagacacccatgatatggggatgcagaagagagggcagcccaggaattctggagaggcaccgcactcagatacagcccagcgtgacccagggacaagaagggagtgattgaaagtcgttagagacagcattgacccttacttcactcactgcttcccacagaattcctagcaatcaagacactcctcccactgcccaggcaggggggcagaaattttatctctgcagaaagggaagcgccagagacaggcctctggacactgacatctggggctacccgcagaagaatgagaatacccttcctgagcaccttagggacacatttcgttagggttgttttttttttgtgggtgggaggcaggcttgggagccgtgttctgtgtgagggtcgtgattggatggtgtggcccagcaacaagtcgcatcacccaaaggaattgggtgcattggattgattgtctgaagcctgccaacaatgattttgggtagcagttctgttagaaaagccatgaaattatattatggaaattggaccaagcccatcgccatttagttcattgctttataaccagctcatgaggttaaaaaaaaaggaagtcgacgttaaaaagttccattcattggggtggtgtagactctaacttttgtctacctttgtttgcttgcctgcttgctttttgttttgggatctaatttatttgtaattatttgtcttgtatgtagtaaccatcacttgccccctaaccattgaaaagagaatttcttgacgagttaaatcagaagccgtctcttactcaaccttaccaaattctttctctcccggttgtaatttattgcaccagctgcctccccacctgccaattctccttcagatatgcctcctctgcagcaacacttaagatatttttattagaattagaaagtgtagcaaattatgtttatttttcctttccctattgcttctatacaaaatctccccatttattttctttgaaactatttacaagcgattgctttaaccctgctcccccagcatacctgtgtttatgttatctttcttttattacaatacattgagctggccctcaggtggattcctcattttgatattattgacacttcttttatctttactggactgcttctctgtgtgcttttttgacagtcatcctgtcgaggttttctttcaatctgtttgacacattttttccttttttgttgttgttgttctttgtttttcaagatgggtctcgctgtgttgcccaggctggagtgcagtaggaccatcatggctcactgcagccttaaactcctgggctcaaggaatcctcaccctgcagcactctgagtagctgggactacaggcacgtgccaccatgcccagctaagttgttgttttttttttttttttttttttggtagagatggggtctcacttatgttgcccaggctggtcttgaactcacagcctcaagttatcctcctgccttggtctcccaaagtattgggattacaggcgtgagccaccgcacccaaccttcctgtgttattaaaggagaaatcctagtaatgaataaaaaaagactttaaggtataattgacaataagttggcctttgccatttaaataaggaaattgagggcaaaaaaaatcctctgaatgtgtatagaaaatgctgctggggagtggtttatgaatatttaattaaagagatgagagccaggcaaggtgactcacacctgtaatcctggcactttgggaagcccaggcgggagaattgcttgagtccaggagaccagcctgggcaatatagtgaaacctcttctctgcaaaataatttttttaattagctgagtgtggtggcacatgcctgtagtcccagctacttgggaggctgaggtgggaagatcccttgaacctaggagttcaaggctgcagtgagctatgatcgcaccactgcactccagcctgggtgacacagcaagaccttgtctcaaaattaaataaataaataaagagatcggaggcattactaccataaagtatttgctattgctttctggtgtcattataacaaccagcatgttctgaatatcagaattatctgtgacattaagtatgtatttgagcaactattaaaactatatgtaatggtggctcacatctgtaatcccagcactttgggaggccgaggtgggtggatcatttgaggtcagcagttcgagaccaccctggtcaacttgaggaaacctggtctctactaaaaatacaaaaattagccagacatggtggtacacacctgtaatgccagctacttgggaggctgaggcaggagaatcgcttgaacctgggaggcggaggttgcagtgagccgagatcatgccactgcactccagcctgggtgatggagtaagactgcacctcaaaaaaaaaaaaaaaaaaaaagaaagaaaaaaaactatatgtaatctattggatttctcagaaatggattttccaaagcaaaagaattttatttgactagtgtatgttcaaactatgttatcttttatgcatctgcagatcaaagattacttataactgtgtcaatgtgccaatgcccagaagaaagataaaaatatttaccagcatttctaggaaatgaatgatatagatcaagcaacaggatatttttatttttcattcacatttttaatgaaaccctttccccttgcatcaccaaaacttttttctagccaaaaagagagagaactcagtatcacatgtggaaactacctcagagtttcctatgccttatttgttgttaggaatctagacatcataaaaactcagaatatcctcaggttttgttttgttttggttttggtttggggtttttttgagacagggtcttgtgctgtcaccctggctggagtgctatggtgctatcatggctcactgcagcctccacctcttaggctcgagcaatcctcctacctcagcctcccgagtagctgggaccacaggtgcacacctccatgcccagctaattttttgtattttttgtaaagatggggtttcgccatgttgcccaggctggtctcgaactcctgagctcaagcaatctgccagcctgggcctctcaaagtgctgggtttacaggcaggagccactgtgtgccacctgtcctcaatttgtaccttaatgatttcaacagctattgcttagtagctgtggagcaaagaagtacaaatttgtatgtttgctagattgggaatataattagtgaaatctagaagatacttttacagttgcttttgatgaggtcttatggccagttacattattattcaatggtatcttaatttcaagaagaatgtagactcacagatacgggactaattaaagtggaaaggcacatttacagataatcacagtctgctttttttgtgaggcacatgagtagagtttcaacttacactattgttaaacctataatggcatatccatagccctctgttaatcatttttttgcctcttagtttattttcatatttcctttgaaagaaaaatactaataaaattacataaaggatttcttttcataattttatgatctagaaaagtaattaacatataagtccattatagctaaaattatactgaaaatatatcttcacacacctcataccactactacaacatatatttgcctgagttcctttcctctccgccccgcaatttcgtcaaagcaaaaggaccatcccactacagagtaaaaccctaggtagatagaaacaaaacagccagggaagatctagaaatccagttagagccagcatagcacaagataatcagtctttaaaagaagtcacatatttaggttttgcaaaacgtttttaaatttttttactttagatataaaaggccagactcatttttctagattatatctcatatattttgaggtttcacatttatgaaacaaaaccataatttcctaagtgtacaatttcttgaaagcatttcaacaaacatttaagttttagtttttgttaaggaatttcaccaaaggcctctttctaaatcttttttttttttttttttttttttagctgaagttactattttccaactacatggtacaacacgcaggcaactctgggcatgtgcacacaagtgcaacacacagcctcagtgttatgggcagaaagcttattcaccaaagacctatttttagatgagtgctgtgccaaactatactgtttcatttttttaggttaagagcaatatttcatgtaaaaaatgtttttaaaaatgcattcaagctttcttgggaataatccaactgttttgctaaaccttcccctttcttcgagggtacagaagtacaaagagtatattcaatttgttacataaaagaatactcaaagaagactgaagccacctccagttagcaagttctttgccattcaggtaacaattcatcacagtttgacaagatcactttttaaatttaggcttaagaaggacggcagaaatagctctgggcagagaggaaaggttcacatggatgtatataatgcattgtggtttgatattttaccccacacccatattataaataaacacgactgaagtacagtgtaaaaatcctccaaatagtcactgtgctaaaactaagcatgtgtgctatattaagagaagtggtatctacggtacttttcatgataaaatgcttcttttcctttcccctctcaaaaaaaaaaaaagactttacgaacttcttcatagtgattgtatagtttgtaatttgaagttcaaatttgtaaagtgaagttcaaggttagaggagtgcagtcaattttcatttacaaactttgtagattttgtgtaggtagtttgctttctttggcaatcatttaaaatctggctggcctctgcttgctggccaaacacttcctgggatttctctccttccagagacctctttaaatttccctagagtgtttgcaaaaagaactgcttttaaagataggcaaacctacttacgagaaaggagcaaatgcctgggatatctgaagttaatgcgtgttgttttggtaatctgctattttgaatgatgacatgagcaggcagtgtgtcattcacggaaccagccctggtgccagtctcctaccagtttgtttacctccagctcctctagaaacaagttaaatgatgactcgggcctggtgttgtgctatattttagcacttaaaatgattcaacagagtatatattgattttatagttcctttgtaatgaaaccttgggaaccattgtgttttttaaatataaacaaatgtatgtattattacctacctcgttgaaatcagcaactgtcaggaagcttaaaacaatgattcctttttgggagtccccttttgggaaaccaaagccccattattttacttgctcgtatactaatatcacactgatttgggatgagaattaaccacatgtaatatctgcaacagccattctttcattaaacaaatgtgtcctgacctcctattctgtatcaggaccatgtcaggggtgaggcatgcaaaggtgaaggaggtaatccctgtcctccagtaggtcacaaactaagaaggaaaaaaaaaaaaaaagctaaggagggaaactgagccatagagaaatgattaaaatagggtttagaatatgcaaatgttagtgtgtgcacagggttttctgagaacacagagaagattggtctgggtggggcaggcaaggaaggtttcctaagcaaagacgcctgaattgagtcaaaggggatgagcaccagcacgtggccaaccaagcagggggaagacacgtgtgggaagcgggtggtactggcagtggggacaggcccatgggacacaacagcaaatgcactaaagagcgtgatgcgcctgaggacctatcagtagtttggccctgttggcacacggagtgagagataaggaggagcaagcgggggagttggaaaggtcggcggggctggtgcatggaggctttgggactttaatcaacttggacttcatctttagcccataggaagcccatcaaaagttttaaagcaggggagtcatgtggtcagaggtgcattttaggtagatcaatgtgtagaggacagaactgaagagagcaggactggaccctggagaagagctgggagactcttctagtagtcaaggtgaatgatgaactagatggtgttaggagtggaaggggagatggcctccagaagtgacaaccttcagatcagcagaacttgttgagtgatgagatatgaagggtgaaggagcaagagcagccaagagtgactcgaaccactcgagctcagaagaactgacggctggagagacaggagcagggaacagggtccattttgagggcagatgatgggagaggcttcccctccacctcccagcacacacacacacacacacacacacacacacacacaatttacatctttgtcttgctcccataatgcgccataccgtccccacaagaacattgtagcacttcattttaattacttcattgtctgtcttcctcactagactataagctaactgacaacatgaattgtgtttgctttcttcattgttcattcccagagtcagcagactgcctggcacacggtagacattaataaatatgtattaaaggactgtgttccatttcagatcataattaagaatcagccatatattttcagttagttttttgcaatatttttatgacagccttgttggagttgtttaataaagagactccatctcaaaaaacaaaaagaaagaaatttctgctctttataaattacccagtcttgggtattctgttatagcagcacagaggagactaagaaaacattaggcactttatggagtcaaaaaaaacccagaaaaccaaaaacttagaaaaacagaaagcccagactctgagtatcattgccattaaactgtttcccaatgttttggatgtatacaggctcactaaataaaaaataaatctattcaaggtcgggcacggtggctcacgcctgtaatcccagcactttgggaggctgaggcgggtggatcacctgaggtcaggagttccagaccagcctggccaacgtggtgaaaccccatctctgctaaaattacaaaaaattagccgggcataatggcgggcacctgtaatcccagctattcaagaggctgaagcaggagaatgcttgattctggatgttgcagtgtgagccaagattgcgccattgcactccagcaacaagagtgaaactccagcacgggaaatgagcaagaaggtcaaaaaaaaattaataaataaatccattcaagagtggcatttgctgttttctgtgtggctccccattgtcttatgaccccagtggttgaacaaggtaagaagtgggtccaaagaagacgtcagcatccatcgtgtgctccatgagtgcctgcattctccccaaagccgctcagtgtgtgctgcaagctctcttttgttgccagtgcctgtccatccctaaaaagcctcgcattgattctgcttctaaatggtttcccctttttgcaaagcatcatttatacccccagagaaaagaatgtgagctcagaggcgtctttgtccaaagaaactttgaaggcagattccttgagctctcaagacattccacagtcagtagttcctttcctcatgggtgcatgtatttaactctggcaggaacctttgacatgttttttccatagttccttttattgtgatttcctaggtacatttcagtgtcaaaaatgtaagtagaaaagaaagtatgcaatattcttgctaggtttcaaacaaacgagaaactcttgttttacatttttttgataattactttcttaagaaaactatgggtataccttgcttgcatggaaaatgtgttatgaaataatgtgtacagattacatttctgtgaatcaaatccttctaggtgagacggttaaaggagtttgttttgctctttgttttaaagtgaaaagtgtattttatagggcagtctcttaacttgcctgtgtgctaatcctatgcattattacatcagaataactacttcctctgaccctgaccctgacccaagtcatggctacttcttcactttgatgaccattagggtctcctcaccagccccttaattccacccttgcttttagtacagcatccttagtgatccctttaaaacataaatacattttaaaacttaactcctctattcagaacactccaacagccctccattttcttcagagtggaatccagagttcctacaattgcactcacctttttgacccagcaatcccattactgggtatatacccaaagggttataaatcattgtattgtaaagatatatgcacacgtatgtttactgcagcactcttcacgatagcaaagacatggaaccaactcaaatgcccatcaatgatagactggataaagaaaatgtggtacatatacaccatagaatactatgcagccctaaaaaggaattgagatcatgtcctttgcaggaacatggatgaagctggaaaccatcatcctcagcacactaacacaggaacagaaaaccaaacaccgaatgttctcactcataagtgggagctgaacagtgagaacacatggatacagggaggggaacaacacacactggggcctgtcagtgggggtcgagaggagggagagcaccaggagaaatagctaatgcatgcagggcttgatacctacgtgacaggttgatgggtacagcaaaccaccatggcacatgtttacctatgtaacaaacctgtacattttgcacatgtatcccggaacttaaagtaaaataaaaataaacacacaggcactggctgctccctccacctggaattccttccctacatacccacatggccattcccctcatctctttcaagacttccctcaactttcaccttcccaggaggcctgctgtgaccactctgtgtaaaactgcagtccccgctcacccccttctcctcctctttcccttctctctttttggggcttacctccttctaatacactaccacgtatttgcttacttatgtttagtgtcctcatcactagaatgtaaactaaatgaagacagaattgtttcctatttgggtggctgctatgtctgcagtgcctagcctggtgctagtacagaaaagaaatccaaacatttattaaatgaacaagtgaatgagttcattgggtgtttttcatgtgtaatctaaacagaagcaaattttaattttctgtgtagttttaaactacaagaagggtaaagtccattaatgtgtgtatttggaaaagtagattttgtaagccaggcacggtggctcacacctctaatcccagcactttgggaggctgaggtgggaggtgggcctgagctcaggagttcaagaccagcctaggcaacatggcaaaattagccgggcatgacggtgtgtgcctgtgggcccagctactcaggaggccaaggtgggaggatcactcgagcctgggaggcggaggttgcagagagccgtgattgcaccactgcactccagcctgggtgacaaagcaaggaccgatctcaaaataagtaactagagagaacattctttctttctttttctttatgctggtccaagaatttcctaaacctgggtaggcataagagatagtagcaagaaagccccgacttagggcttggtcagagcatttgaccactctcaggttttgactcggtaaaatatgcgtaatgatagctgctattgttgtgaggattagagataatgtacatgaagtgcctggcccacctcgatgactactccctaaataagctttatgacattctctggatctgtcctcagcagtcccaacaacttaagacatctagagagcaaacaaacaagcaaccaaacaaaaaactcctgtttcctacccagagctctttgcccgccacaccctgaggagctcttttaaagactgcgtagtgaggacatcaaagctatgcaccatcctgcagttagggaggaacagtgagtcaaggaccagatcctctcccctggcccaggataaagcaactgcttccttctgtagacttggtgcggcttgcattttgcatctgtgggttttgatgttttcgagtcttttccttgtatcattgtcccacagtagtcctgtgacatagataaggcagctacagatactctcagcaacaggctccaaacgacttgcctgtggccacagggtgtcctggacttcaagtgagtgcccatttctgcaacaaatatttgactccctgttttctgccaggcgctgttctaggcactgagaagaaagtaatgtctctgttctcatgggacatacgttttaggggaggggaaagggacaagaagcaaatacaagtaaatatgcaacaggccaggtccacagagtgacgggctgcagaggtgctggggattggcatttgacggagagaaatcaagtaaagccttgctgagaagatgacatttgggaggagactgaagagtgttgcagtgccgatgtggcaagggcaagggccctgaggcaggaccacacctggatgcctgaagcacaacagggaggccaaagaggctggagctcggtgggtaggtgggagagagtcgggagaggtgctcagagagcacgcagaggatcagggcttgcctgcctctctaggccatcataaggttgggtttttactgtaagtgaaatcagacggaaagcactaagggttttcagaaggggagtgacaaaatctgacctacctgttatcagaatcatctggctgaggccacccagacaggagggagccaaagggaaccaggcagagcagcttgcaacaggtgcagccgggaggtgttggcagctgagaccaggcctgtggccatggggtgttgagaagtggttcaattctggctatatcttgcaggtagaactggaagattttgctgaaagattggacatggcattcagagaaacagaggttttaatgacaaactccaagtttttggctggagcaactggaagaatgaggttgccatgaaccgaaaagagagattgcaggtggagcaggtttttggcgttttgtttgattgtttcttcaaggggtgtaggcgaaagcaggaattaagcttggggcatgtgaagtttattagatatacaaggggagatgcctcacaggcatgctggtaagatgctggtaggagcccagggcctcatctgatatcgggattcatcagtgtttagagtgtaggggttgcttaaacccatgaaagtagaagaaatcatcttgaaagtggtgtaaataaggcagcagccagaggttgcaatgcggtaggactccagcatttgctggttaggggagggaaggaaccggcactggaagctgacaaggtgtgacccatggcaggaagagagctggggagggatggtgtccgggaggccagggaagaaggtagggggtggggtgacctctgtctgtcacatggtgctgataagtgaagcacctgaggtccaagatgtaaccatccttctagcaatgtggaggtagctttggtgagcgaaccacccattctttctcttcccaatataaaaaaacaaaaacaaaaacaaaaacacgagattaaagtctcaggttttattggtaaaaattaaagcttcagactttaatattattttttatattggcaagagaaataaattgttttctatattggaaagagaaatattttcaagaataaaaaatccaagggggagcttggatttttatttttaggctataactttaaaaaattttatttatagaaatgtatagaaacagaaaaattgctcataatcccatcctccagaggcatttttatgcattttttcttatatatttgagaccatgttatgcatatatattttgggcatgtggaaccttcttttataaacataatatatccctaggtcattgaaagcactatgcacacattatttttagtgactggccttcgtgtcctacatcatgatatccaataatttatttgattattcctcttccgctggatctaggttcccaaatgtttactcttatatatagtattgataatcacttccaagctctcactggaagttagttgttttggatagctagctagaagtgatggaaatcaaagggagtcaagggtgcaaacatttagagcacctgctacatatcactaaattgcttttgagaaagtttgtatgaatatacacacctacccaaaatgaaggagggatgccttcttaccactctctgttggctctgctatcatcaattgtgttgaaatgtttatttctgattattaaagcaatatttttattgaaaatttgaaaaatcagaagtgcatagagaattttaaaacacaatagaaacaacagtcttttaatacttttgggtttttttattaattagaatcataccttatgtgtttatacacacactatatatatatatatatatatatatatatatatatatgcatatatatttatttcttaatttggcatcacttggtgaagcattttccacgtcactaaatataattcccaaacatggcttttaatgaccctgtagtctttcattccattggagtgctattacttatttgctatcctcttattgttgggtgtttgtattaatttttagtatcaaaagtaatgcttatattcaaatcattgtatgcatcatttgattcttccatataagctcctaggcctggagttacatggtcaaaaatgaaaatatattagaaattttcccccagaaagactatactaatttttgctgctacccacattgtgaaaaaggaatgcttgtctactgtggctcccccaacactgtgtatcatcagtcatttttcaatttttttgatagtagagtagagatagtttatcaatgatgtttgccttttttcatgagtttattatggattacaaagatatggcttttgtttatgtcttttatcaatttatctgttggagtcttgtattcttcttagttatctggcaaagccatttacatcacaagggtattgatgttatgccatatttggggtaaatattgcccccacttatttgcgttgatttcataatggcattatataatctataaagttttaacatcttatgtagtcacatttatcaatatttttcttttctttaaattttagaaaattctttgccatctgaaagtaatgtacatctacatgtttataaactataactcaagatttcttttaactgttttaaaagttatttatttctatgtatagctaaaggtaacaccctaaactgtctttttttccctagaagtaaccaaatttactcacgtaggccaggaatttctatgacgtgttccaaattcagcctctcactgaacacttccagagcaaggcaacataaacagtaagtgacctatttgaacagttctaataatgtggggttttgtttgggaatcagtcagcatatcacaggctatactgcagtcatcaacagctcccatctcttctacaccttgtctggaagtgaaaccccttatttctacctgtagctcatgggccagagctagtcacatggcgctacctaattgcaggggcctggggaaggcagagaagccaatggaatggtttgggagcatcactcttctgcttcctgccatttgctgtcttgttggccccgagaacacagagtaagccttttccatacgtgttttcaaatattccagaatagcaatgatattgcctttccccacatatacctattgccatgcacacacaaaccctgagtccttggtagtattctgattttcaggaatacaaacccctattcttttgattgttcattctttctatgatgcagtttctcatctccttgccatcctggcgacccctttctggatgctttgtcatttattaatacccaaaatgtcttgtgattaaaacagaaatgtgtattctacttatttttccatttcattagcttttggtcttatgttcttgaaggcagagcttttatcttcttctccttgatagccccttccactacaccttcctatccagctagcacaaggcctgactagtggcttctcagtttgccaaatgaattgtacaccagtagtttccattgaccgggactgtgattctaaccgacacgagaacccgtatcctagagccattaccaaaaagcaattcattcagctattctaactgctttctgttataatctgctcaagtcataccattacacaccatttctgtgcttcaacttctcagtgctcactgctgctacatgttttcccattgggtattggtgaatcactggagtgtgaaaaagtagacaacctagaaaaacaatgtcgccaaactgactgtgattgtgaaaatcttgaagtctctgctgatttagaatgaggaagaagaagggacattttaagacctcttctccaactccttgtactatttttagataggaaaatttgccttgatcagtcttgtattccttgaacaaaaagccttccttctttgccaccctccccagcagggagcttcattgttcctacagaggcagatggtgacggtggggccagaggagtctgtaagggccagactttttcgcagatgtttctgccaggaaaatttgccctggtgacatttgagagtgtttacagggcagcataaagttggcttctgtattacccaattatctgtgccttatgtatgttccaaacctatttaaaatgctaagcagaaatacttgcatcttaaacccatgataaatgcagtgctaaaaatctgtgtgacagctggtcattacatgtatattaaatccttgttgggacccagagacactgtttgttctaagagttagcctagattcaagcttttattaggacacctaagtatactgaagcttaagcttaaatttcccgtttaaccaacctaatagtttccaaatacacattcatctactcattatcttctaacttccttcattatcatgactgaatgctaggagtctatttttcaaaagagcgagactatcattatgcctcccttgaaaccagtgaagttcagctcatgtcaaactgccattcattaaacgcacactaaatgcatctttaaaacccagtagttctatgcactaccctaaaggtattttctaacattatttccaaaacacttttttgttccaagtaatgtgagtaggcctagcaattaactaatttccagccaagcctgaaatatcaaaggttagtcctcagagatggtagtgtgcgaaagaatgggagctcttgtttgaaaattcagctgtgttgattttacaagtcaggactggaaaacagccaaaagactttattaaccttcttttcaatctttcctaagaattctctcacatctaggatgccaattacactccacaaagtcacgcttattttgtggtgccctgggggtgcctgcctgctgttatcagtagagttaactgcagtgggtagaggtttgggactgaaagaatccattttaactcaaggatagggcatctgtttcccctggcatctcaatcaagttgggggctcgtaggatgccccaaagaagaggaaggacgttccaacacacgttcattctttgaggcttggctggtggcttgatgcttactatagcctggctctgttgactatcctgaccgtccttttagttcctattactcttgactcagaggttggaatctttattgctctctcaactgtacttttgcttctccagtcctcacctctggccctttctatcctcaggccctaagactctctcccttggtctgccccagctctgaggatggggtctgcagagctgcactccccaggtttaaaaatgcctgctctcatcactcaggaacattgcagagaaaatccagataccctatgtttatggtatgatgtgtctcattttgcatatacttcaagaagaggaacatgaacagttgaaagtgcaaaaactgaaatttgttcagaaatagatgttagtaaacttttacatataaattcaaaatatataaaaatggtgaagtattttgtatggacagtgacccctgcacagaaacttttttgtagcaaagcaataagcccagatttcaaatagaagaagctgggatgatacacagactataaacctatcagtctttaaaaagtaacctattcccccttccccatcaaaaaacatagtcatgtacattcatttctctctagtagtattcattctggtaaagactgtgttcatgttgccataattaaaactctacaaattgagaaactttcataaaagccaactatcaacatgtctgaaacgtgtaaaatgttgatataatttaaacccctcttcagtagttgctaaatacatgtttcccctcccttaacatcaaatacaccattgtatagctatgtttggagtttaggattacaaggcctgatagattcaaaataccacagaaaaacagcctactctggtctgttctaaattcatcaattattttaaaaataactatcaactacataactggaatgcttttaaaaaaaactgtatttataaaaaaaagaaattgtatcagattgactggttatttgggatacaatactctccacatggtagacgataataaaaaatggtcctaaagctcacctgctcacgaattctgaataatttaggtagatactccctgcctcaaggaagtgagacataactctccactctgcaaatgcaggctgctcattgtatagtaatttccttccaaagtgtaccaaagagagaaaagagtaactttacagtgagaaacctacaaacactgtcaggcaggtggtcaaggtgaatgccaacagtgatacgtgcccttggtaggatgtgatgagaagggcacttcacctctgtggtcttccttccaaaaacccataaccttagtctaaccatgagaaaaacatcagaaaaaccccagttgatgtcctttctacaaaacgcttgaccactactccttaaaactgtcatcaaaaaacaaggaaaccctgacaaactgttagagtcaagaggtacctaggactacatgataatgaaacataatatggtatctgtgagaggacccctgtgcactttagtttaatgtaccagtgttggctcattaattgtgacagatgtaccatataatcgagatgttattaaccgggtaaactgtgtgtggaggttacaggaactctctgcactgtgagttcacagcagttctagaaatctagaactattaataaatagtcctaacaaaccatccaaatgggccaaatatgactttctctacaaccaagtgtgccttttaacaactggcttccagaccaccacagctgctgcctctgactcacacccagccacctgtctctagacctaatgtgggacaaaacgttccccacaacacctttcgaattgttccacatatctgaagccaggttagaaatttccaggagtcatctgaatgtgcatctaccctagaacagagtcccgtgcggaggtgttaggacatatttgccatccattgcctgcctagacattccttcctaccgtctgagtctcactgtggtttcctgctacagaagttgaaaatcccagcccccagcccagggctgtgtcctccgctccactgtcagatacacctgtgccaagtgtagaataaggagacaggagggaggcacctgcccagcggcagcgctgcgatgaggctagtggcagtgtgggctagcaggatgggcctgtaacggggcaccagcgtcctccctggaccaattctgcagcagcctgtgggcatttgttcctatccatgaagttccgaacctggttttctggccctcctggccaggctgaagccatgcagtattctttatatcaaattgtttattttaatatgcatatgaaaggctgcacgaattgtacaaacatagcctaattttcaccaagcaaacagatccttattaggactcatagcgagaaacaagaccctagaaacccccttcacaccctgtatcagtgcacactgatcccaaaaggtaatcactcttgtgacgtctcagaagatggctgtctcataatctagttttgcctgttttgagatggaatagtacagtatgtactctccagtgttgggcttttttgtctcggtattttgtggtgagaagtttccttctggtggttcgcgttattgtagctggttcattctcattgaggtgctgttttccattagaggaatatacataccgcaattcatttatccattctaccattgataaatgtttggctcgggtccaggtgtgactcctatgaacagtgccgctgtgaacattcttgtatgtgtcttttggtgccagtattttaaaagataaattccctttttacttaaacatgccagaattcgcttttgttgcttttaactaagaactcttacgcttgaagttgctatagctgtaaaatctccagaggctctggtcatttcaaagctgaaagccaaagacatttggaacagcaaacgtagaattacacgatgatagctatatgtgatgattcatggcatgatgccagttctaaagtgttatatattcttatgcttaagctttgatatttattttaaagatcattttgtatctgcttttgcttttttaatcttgcaaagctatttagccaaaaacaatgcttcaatctgacaatgccagtttttaatgggataaaaaaaaagatgaatagtatttcttcatccatctctacccaagaaacagtatacgttcttgttatagtgtgcataagaagatcaacactgggcattttgctacattttagattcattttgttcagagatctttaaggattagtaggtctgagtttttaaaatattttatttcttgcagtgcttaacacagcgtcttattaatatggttaattaaactgatatttgcattataatgacgtaagcttgtgagagcacttttgaatcaaagtgcaattaagtcaatactattattttcttaggctcagcttgaaagacatttaaagaggagttacaatagcagactggttcagtcacttattagattgactgttgtttgtactgagtccttctcgtggggtagactaaaatgaattattttaagggcttaatccttttccaagtaataagtattcacattgttatagtccagtgatttattattaatgattttatagtgctttcaagtcacctctgaattatttctccttcatgttactatgggcaaggcccattcataaccagggttctgcaagggaataggggaatactcgtagtttataatttttagcaggtagattcgaatgctgttaatagccctctatcttgtatgttttatagtggaaataactttggggttaagtatgcatgggttcaaatgttggctccaccatttattgggtctgtgactttgagtcacgtggtgacataggtagtgtccctaagcctccattctataaatgaaaatggggtcatggcacttattttgcagcatatttgggaagcttaggtgaaataatgcatgtaaaatgcctacaccgtacttactatcaagtacctacatgtaaatttccttccatctgcatttcatttttaaaaattcttctctactttagacatgatgcctaattcctagatgtttcttagtcgattagcataccatgtgatttcacttctgtctgcactgggcaaagcaagcctttgaacatcatccacacaacacttctaagggaactacccactcaggatccctactggctgggcagacaggtgtggtgctccatcatctccatcttcccccaaccccccaagccataaccagctggacaggcatctggcctgagataaacaaatccataggctggccagggatatatcgtgttggaagtcaagctgggccaaaaccgtaacctctgttaggagagcgcgctggcaaatgctgggcagcagctgaaaggatgtctgtcgggaatgagagtttgggccatgcgctgtgagaccataaggctgtgatgaggtggaggaagctcaccaggagagacaagggaaggcagggatggcaaggaggggccgagccttcatgaggccaagcatcagcccctgacctgccttctgtcaggttccacttccattcctcttgtgtccttatgaaaagccctgtttttcctgagttggttcgaggatgcttctgttcctcaaagccaaaatagtcgggacagaaaactgccttaaatacacatactagaatcacagaatcctccaggaaaactgtgattcactcacatcaaagtttcatgggaaggaacaccttcaaaactattagttttggaaggataattaaggacactacagcatgaaaaatgagatgtcgttgactggttgattgattgattgagacaggatcttgctctgtggctcaggctaaagtgcagtggcatgatcatgattcactgcagcctcgacctgctgggctcaagtgattctctcgttttggcctccccagtagctgagactacaggtgcagaccaccatgcccagtttgttttttttttaattattttcagaccaccatgcccagctttctttttctttctttcttttcttttcttttttttttttttttttaataatttttagggataagagcttgctatgttgctcaggctggtcttgaactcttgggctcaagcaatcctcctgcctcagcatcccaaatgttatgattacagtcatgagccaccgtgaccagccgagcagtcatttaaaggttaggcttaaaactattataggattagatctgatcttgaaatggaaaataaggagttggcttgccaaaaacaccccactgattcctgttcaatgacttttagtgaatctaaaaatttctgtactttccttcctgtttctccttgtgatcataggaagctctcttcctacgaccacattcaaattctgggctaaaagatgctgtatcagcggaagcatgattttacatggcaatgattctaatatgttgctgtcaaagtctgtgtcaagtccagatgtttgagaggaagctaaaatgacagcaccaaataagagtatcttttgctcgtgtgtttgctaacagcacgaatgtgtcaaacttgaggaaatgtatctataaggtcctgcacgatgttaaaggaagcacctatatattcttatcccaggaactctgtaagccaccagaatactttaactgatggcaatgagtctcagtttgtgctgagacagacatcgtggcactgtctcctctcacggcactgtgccttttgtacagctcttgggaacacacatagacactagagagggcatacaggaatcttaggctgagcagggctgaaatcagggtatgttgacatttcccataggtgcactcagagttctaagtgctttgaactgtttttttctgatttattttactcatttagtcttacctagatatgtttatttgtgattatatgcttagcacctgctttgcaaaatccagtaaagaattcccaattaatatctgtggcattttttcttctctttcattcgagctcctgaatctttttccatcttttccatctgtgtatccccagcagtgggagcagtggctggctcataagaggaactcaaaatctgtacttattaaatgaataactttgcagtgttttgacctccaaaaggaactcagtcctttgaggttgattctacataaatgaagcagagaggatagagaaggtattggactttacatgttgactctgatatttattagccgtatcttaactaaggaagctaacctcttggcctcgatcccatcctataaaatggggataatatctaactgcctcacaggtttccaacaaggactaaacgatggagtgtatgtgatgctcctggcacagagtggtgttcatgatcatggctgtaagtcttctaagagttaagtggttgagaacgaggactttagaataagaccatggccctagtctgccattgtcttgctgtgtgatacatgtaaatcacatggcactgagcctggcacatagtgaatgatgggtaaattagtaccattattattaacaaaagtcaattatcattatggatattattaagttacttctctaaaacaacatataacaatattcaaatccatttagaaggaagagaaataaaattttagaagaactcaggatgagaaaattctgtaacacagcaccaaatttagctttgggtttctgggcaaccatggcaatagaaagaaacacaacaggttacatcatgattatcagttataattagttcactagagctgtacctcccagtacaggaactggtggccactgttggctgttgagcatttgaaacgtggctcataggaatgatgacatgctgtaaaagtaaaataccctgaatcttgaagatctactatgaaaaaataaagtatctcattaataaacttttatattggttgcacatggaaattgtggtatcttggttatttggattaaataaaatgtattattaaaattactttcacttatttcttctgacttttagtatggctatagaaaataaaaaatttcatgtgtggcttccatttgtggctcacattatatctcagtcaacattaaactgtctttttaatctcagtattctaagtagaatttatattatttatatttttatattaatataaaatatcataattataaaatcattatataattatatattataaacattataaatatataataaaatgtataatgcatggtagaaatatattaatatataacaaatatctataatgattaataaaatatatttataaaatagaatgttatatgttagtttattattatatactttctattatttataaaaggctttggatgttcaaatgggtaatatcttcacctacaattttaaagaaaatttgataactatcttggcagggagagaagtattaatactaataatcacaatagctaccatttattgaatgcttccatatgtgccagacacagtcctagtttctttacatataccagtcatttaaaaactcataagtggtgcaatgagctggatgtttacgttttcccccaaattcatatgttaaaaccttatcactatcactaggtgatggtatgaggaggtggaacttttggaaggtgattggctgaatggcattggtgcccttataatggaggcccagactgggcgcggtggctcacacctgtaatcccagaactttgggaggccgaggtgagtgcatcacctgaggtcagaagttcgagaccagcctggccaaaatgatgataccctgtctctactaaaaatacaaaaaaattagctgggcatggtggcacatgcctgtagtcctagctacttgggaggctgaggcaggagactcacttgaacccaggaagtggaggttgcagtgagctgagatcacgccactgaacttctgcctgggtgacagagcaagactctatctcaaaaaaaaacaggctcagagagttgccttaccccttctaccaggtgaggacacagcaagaaggcactgcttatgaactgggaagcagcccacaccagaaaccaaatatgccagtgccttggtcttgaacttcccagcctccagaactgtgagaatgacatttctgttgtttataagccaccaatttatggtattttgtgatagcagcctaaacagactaagacaagtggtatgattattcttacattaaaccaaaacccttcataactggcataagatacaaaaatatcttcttctacctctttggtatcattcacagcattgacaaagatgcagtaagtgggtgttccatctactgctcaataagtgggtgttggtcagtagaatacctcctctttccctatgtccctcagctcagtaatagcaagatatttaaagatctatgaaattagggaatacattgtcacctggaattttgttgtgatttgcagtctgcaagaagaacattgtgtgagaaatatcaagtgagagtggaagagtctgcggagggcctccctggggctcacctgtgcttttgcctgagcttcaccgtgtcaaggtaaactgagtcagaaaaccatgtgggcaaaaagcatctccagtttttttttaaagctcaagtactgtgaagaaatatgttacagcttgttttgaaggagtccataaaaaaagtctcaaagaggctgggcgtggtggctcacgcctgtaatcccagaactttgggaggccgaggcgggtggatcacgaggtcaggagatcgagaccatcctggctaatgcggtgaaaccccatctctactaaaaatacaaaaaattagccgggtgtggtggcggtcgcctgtagtcccagctagttgggaggctgaggcaggagaatggtgtgaacccgggaggtggagcttgcagtgagccaagatcgtgccactgcattccagcctgggcgacagagccagactctgtcccccccaaaaaaaaaaaaaagaaaaaaagaaaagaaaagtctcaaagaatagttttcctaagagttaaaggtgtaaaagacagcaaatgaatctggtctgcttgtccccagccctatatactcaactgagaccaacagaaagaaaccatgcaatttaggaagatacattttaaagtttaactgcaagccaaaaatataaaaatgagtcctgctctaattgtgaattgcaagtagagccaagaaaacctgtatctagtttagaagtcaagacctctggagatggggaaagcttagaagtcacttgtattagcctgttctcacactgctagtaaagacatacccaagactgggtaatttataaagg

SEQ ID NO: 594 - DNA, 40001 bp, Homo sapiens
ggtatagattttatttccccttttttcttccccaatttttcaggtcctttctcttagagtgcccgatttacaaaatgaaaatacaagataccaacttaaatttgaatttcaggtaaacagtgaatttgttttaaataagtatgttctgagcaatatttaaaacacactaatatatgtcctgtattttacttgcatccctttctcacactcaaacccccagtggggaactaagtggtggtctttctgatgatcaagggctagaagagagaccaaagtaaaatcttgcgtaagatcctggtctttaaatatagctcatggtgtaatcacgatttggcaaaggggcaaatatatatactggaggataatgatggctctggattctagaactttttctacatgacagattctctagagagaggttgcaattatatgaaatattgcccaatatgtacatatttgtcattaactgccaaaatccatagctccttggtactagcttgactctccttgtataaatatttgctctccttctgtagaccccaaaccaccaaatccaaccatgcgttctggtccgcagaacccccagtcactataaaaccccatctgtgttgtttttttctttcatgaaatacattatcatcaacaatgtcttttttctgcaaatctactttttcagattttttgtgttttaaataagaagtgtctggttgccaatacatttcactggagttaaaaaatattacatccctttagccactcatcaaactaaagttgataaggtatcgtagttattcagactgatgatacttttctactttcatatggggtgattaattcaatagagaatgtacttttcttaacaagtaggcttatcatgcaaggcagatttatccatcctattagaggattaatagtactgtgaatatatcaggaactcaaaatgcagaacttttttctagaatattttatctactcttgataaaacctacttaattctactatatcccgtactatatttaccttacaacaggatttaatctctaaatgtattaaaaatttttaccttttgaatttgtttaacatcaagaaggatcaaaacaatatgtatggtgataatatttacaaaacctgattatttccaaaaacctaacgtcagctcacagatagttatggagaagagaaatgctgaaccccaccaaatacagttaatacaatctgaagctttataattaggaataagagaatgaataaaagtgtaatcatcctaaatattggtatctggcaagcaagcttttcagaattcattaaggagtttcagggatactccataataggttgtgaataataggattaatacagccatgggcagtgttaggtcagctggcagtagatcaatccacaacacataaaatattaaaagggttatagattagcaattagatggcttcacaaacaaggaacagttccttgagcatatctaaaggttaacagatgaaatgtcagttttctcagtttatgacccagtagcatctaaagatgagagaagagatgggacttagactgtgattatgattgacataatcaaaccgaaccatcctttcagtatcaacatctggatttcaaagggaacagattttagtattaggtgagggaaacacttgtgaaatacaatgaagtagtttgaaggacaaagtttggggtgttagaattctcaagagacatgtcatagccagtgattcagatcttatgttcagtatttagcttccaagtatttgtgagatgccctgggagaggtaagtgaattctccatttctgtggatgaaaatcaatgctgtacattatgacaaccatgttctattgaaatttcacttgacacaaagtttatcaatattatatagctatctgagtcttgattttattgttttccacgaagacattgccaaatggtagtattatactgcttttgattatgctttgtatgaagaaagcatagtatataagaacctgcccatatttaagatatgagtttttgtaatttacaacttcatgactaaggagtttgcaccaaagagctactaaactgtttccagggaagagtttttgaatgccctcataaaatgatataaaaatcaatgtgaaaacctggaaaataaagctactaaatcccattaaatcagagtatatagactggacctcatatttctggcatgttaacacctttgttctgaccctcagttcctctgtagtttttgaccttcatgaataggcaacgtggcacagaaaagagaaaagtttagtatttaagagccatgttttacaatggtcctttcttcatgtataagtttctccatggctttctgagctctattgatttcaattggaattgagctcacaaatttccatacacagtcgactcacatattcatgggtatactcccatatataatttactacatctaattggtaagggaatgcagattatgggtaaggtaagtcagtacaacataaagtctcacagtcttagagttcaagttctttaaaccagttaataaacatctgctaagtcaacctttgtcgctttgatgtacaatgctgccaacccttatggttggcaattggttgtctgaaattgtctgagagtcatatgctcagtttaaaagaatgtattcccacaacaaaaacaaaaaattgacaatgggattgaactggaataaagagcttctgcacagcaaaagaaactatcaacagagtaaacagacaaccaaccaaatgggaaaaaatagttgcaaactatgcatccaacaaaggtctaatatccagaatctataaggaacttgaatttaaaagcaaaaaattatgccattaaaaagtggcaaaggacatgaacagacactttttaaaaagaagacatacatgtagccaacaaacttatgaaaaaatgaataacatcactaatcagagaaatgcaagtcaaaaccaccatgagataccatttcacacaagtcagaatggctattattaaaaagtcaaaaaataatatgctggtgaggttgcagagaaaagggaacacatacattgctggtggcaatgtaaattagttcagctactgtggaaagcagttagcgatttcttaaagaacacaaagcagaattatcattcaactcagagcaatcccattattgggtacacaccccccaaaatctaaattgttctaccataaagacacatgcacttctgcgatcatcgcagcactgctcacaatagcaaagacatggaatcaacctaaatgcccattaagagtaggcttgataaaaaaaaaaaaatgtacatatatgacatgggatactatgcaaccataacaaagaatgaaatcatgtcctttgcggaaacatggagggaactgaaggcctttatcctaagtgaataggataaatacaggaacaaaaaatgaaataccacatttctcacttataagtggaagctaaacattgagtacgtatggacacaaagaagagaacagcagacactggcgtctacttaaaggtggagggtgaagatttaaaaacctgttaggtactatgcttatcacctgagtgatgaaacaatctgtaaactaaaccctgtgacacgcaatttacctatataacaaacgtgcatatgtaaccctgaacctaacataaaattaaattttaaaaaggatgtattttcagacttctgtggaaccttggtgtgacgatttttaccaaaatgtttggctttccaaaaagaaaaattgacggtgggtttgactcaagtttaaaaattcattcttacatacattctgttagaaatctgccaatcggggattttctgacactatttctttatgaacattaatataaggcctcaataatgcttagaaattatatatgtatatgtgtagagcaaccaattaacataattatatttcctggttttcaaaaaatgttcaaagttaccatataatcactaatttccttgcttcttataagtgattgattaggagtattccatatagatattttgcattatctctataaaatgttcactctatagactatcaaatgctctctgtattgctgtaagtaaagtaagtatttttaagtccacagaatgctaattcaagaaatcccaaaacaatttaaaatactaatccttaaaatgcttttagtcatggttctccagagacataaaaccaacacaatacacagagagaaatataaaaagggatttattggaattgggtcatttgattatggaggctgagaagtcccaagacagaaggactagaaaccaagaaagctgataacgtgactcagtccaagtccaaaaacctcagaaccaaggaagccaatggtattattctcagtctgaggcaaaggcccagagtcagggggtgtgaccacggggcagactgctggtgtgaatcttggggtctgacatccaggggtaaaagaagaagggtgtcctggctctgggagagagagaaaattcaccctccctcagcctttttgttccatctaggcccccagtggattggatggggcctgcccacattatgggcagaactttcccactcagtccaatgactcaacacaccaatctcctctggaaacaacctcaaagacacaactggggcagcccaatcattttaatcaaaagcaaacccatctgggtttccctttcagcagaagaggacaggctcagtgcctactgaagcatagagaataaataatactttaccaactatctgagtgtccgttaatccaggaaagttgacaccggaaagcaaacatcacccaagagcagacattgaattcacagtagttttcaggtttaattcaagtacagttacacagaacataccttggtggttttaaatacatttctttttcttttttttaaattatactttaagttctagggtacatgtgcacaacgtgcaggtttgttacatatgtatacatgtgccatgttggtgtgctgcacccattaactcatcatttacattaggtatatctcctaatgctatccctcccctctacccccacctcatgacaggccctggtgtgtgatattccccttcctgtgtccaagtgttctcattgttcaattcacacctatgagtgagaacatgcagtgtttggttttttgtccttgtcatagtttgctgaaaatgatggtttccagcttaatccatgtccccacaaaggacacgaactgatccttttttatggctgcatagtattccatggtgtatatgtgccacattttcttaatccactctatcattgatggacatttgagttggttccaaatatttgctattgtgaatagtgccacaataaacatacgtgtgcatgtgtttttatagcagcatgatttataatcctttgggtatatacccagtaatgggatggctgggtcaaatggtatttctagttctagatccgtgaggaatcgccacactgtcttccacaatggttgaacaagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgataatgagcattttttcatgtatctgttggctgcataaatgtcttcttttgagaagtgtctgttcatatcctttgcccacgttttgatgggattatttttttccttgtaaatttgtttgagttctttgtagattgtggatattagccctttgtcagatgagtagactgcaaacattttctcccattctgtaggttgcctgttcactctgatggtagtttcttttgctgtgcagaagctctttagtttaattagatcccatttgtcaattttggcttttgttaccattgcttttggtgttttagacatgaagtccttgcccgtgcctatgtcctgaatggtattgcctaggttttcttctagggtttttatggttttaggtgtaatatttaagtctttaatccatcttgaattaacgtttgtataaggtgtaagcaagggatccagtttcagctttctacatatggctagccagttttcccagcaccatttattaaatagggaatcctttccccatttcttgttttggtcagttttgtcaaagctcagatggttgtagatgtctggtatttttgagggctctgttctgttccattggtctatatctctcctttggtaccagtaccatgctgttttggttactgtagccttgtagtatagtttgaagtcaggtagcgtgatacctccagctttgttcttttggcctaggattgacttggcaatgcggcctcttttttggtcccatatgaaccaaagtactttaaagtttggttccaactttaaagtacttttttccaattctgtgaagaaagttattggtagcttgatgggatggcattgaatctataaattaccttaggcagtatggccattttcaagatattgatccttcctatccatgagcatggaatgttcattcatttgtttgtgtcttcttttatttcattgagcagtggtttgtagttctccttgaagaggtccttcacatcccttgttaagttggattcctaggtattttattctctttgaagcaattgtgaatgggagttcactcatgatttggctttctgtctgctgttggtgtataagaatgcttgtgatttttgcccattgattttgtatcctgagacttctctgaagttgcttatcagcttaaggagattttgggctgagacaatggggttttctagatatacaatcatgtcatctgcaaacggggacaatttgacttcctcttttcctaattgaataccatttatttctttcccctgcctgattgccctggccagaacttccaacactatgttgaataggagtggtgagagaaggcatccctgtcttgtgccggttttcaaagggaatgcttccagtttttgcccattcagtatgatattggctgtgggtttgtcataaataggaaagtgaacaacctgctcctgaatgaccactgggcacataacaaaatgaaggcagaaataaagatgttctttgaaaccaatgagaacaaagacaaaacataccagaatctctgggacacatttaaaatagcgtgtagagggaaatttatagcactacatacccacaagagaaagcaggaaagatctaaaaatgacaccctaacatcacagttaaaagaactagagaagcaagagaaaatacattcaaaagctagcagaaggcaagaaataactaagatcagagcagaactgaaggagatagagacccaaaaaacccttcaaaaaaaaaacatcaatgaatccaggaggtgattttttgaaaagatcaacaaaattgacagaccgctaccagactaataaagaaaagagagaagaatcaaatagacgcaataaaaaatgataaagggaatatcaccaccaatcccatagaaatacaaactaccatcagagagtactataaacacctctacacaaactagaaaatctagaagaaatggataaattcctcgacacatacaccctcccaagactaaaccaggaagaagttgaatccctgaatagaccaataagaggttctgaaattgaggcaataattaatagcttaccaaccaaaaaaagtccaggaccagatggattcacagtcaaattctaccagaggtaaaagcaggagctggtaccattccttctgaaactattccaatcaatagaaaaagagggaatcctccctaactcatttttatgtgtccagcattatcctgataccaaaatctggcagagacacaacaaaaaaagacaattttagaccaatatccctgatgaacatctatgcagaaatcctcaataaaatactggcaaaccgaatccagcagcacatcaaaaagcttatccaccatgatcaagtgggcttcatccctgggatgcaaggctggttcaacatatgcaaatcaataaacgtaatccagcatataaacagaaccaacgacaaaaaccacgtgattatctcaagagatgcagaaaaggcctttgacaaaattcaacagcccttcatgctaaaaactctcaacaaattaggtactgatgggatgtatctcaaaataattcatttatttttctgtttatatcttctaatttataaatgacatacaacttaattttatcttattgtatttatcatatcttgagacattaagtttacattttacttattagaattggtgcacttaaaatgttaatttcccttgtcatttagaatatatatttaaaattttattatatttctgtgtgattttatattttattcagttttatttaaaactattttttagttaaggcagtctttaaaataccaatagttgttcttttgttcctattctaaaattaatgtctggttttattgtactacagtgggacaatatagaatacataattatattaattcgatttttaagattttctttaatagggtggtaagtttttaacaataagaggttaattatttttggctttcatatataacgtatcagttttattatcagcttagaaatgctgtaaaggtagttctcaccctaagtcagtgagcatattacaaaagaaattccatggaagtgatttacaattcatcaaaatttccacttatctaatatgactggcgtgtcagaaaatgtttctcagaggagaagcttcataattaagttgtatatgatgaactgatatagtcagtaccagaagcagggaatgtgtaagcctggcagtaagagagcacgttaaaaaccacctaggatagagtgcacctaagagagaaaaggtctagtatgattccaggtttctgagttgaatgactgagtaactggtgctgcttcttatcaaggtgcaaatacagagattgtgagaaggaagatatcaagtttggtatcagccgtataaccatgcagtcataccattatttacacatttcaaagcaatttcaatgtaacatcccattttgtacttacaacaaaatagtgaatgaaataaggcagctaacatttccattttatgaatgaagaaattaagtgacttgctgaaggtcacaaagcaactcaagaatggactcagaaatcaaattctggtttcgatttatgaattcagggtttttttctgctattgtactagaaatccatattgtaactattagcatcccctgtacatattgattgtataaattattttgaaatgaagcagatgctcattcgtcacctgctacatatattcatctctctctctctgtaaaaacattgacttcctgacaatattaatgacataacttcttttaatacatttttaatgtactaaaaattcctcattttcaactttaggagagactaaacatgatagcaagaaaaaagtaaagtttttacatcatgacactagttctggagaaaaattatttctaaaggcaataatttacttgagctggtgaaatgaaaaccattcctttcattacaaatagcttaaatctgtagtctcataactaccccctagccatgaacttcaaagctctgccacagcagtcctggaacaggtttcttattttttcatttgaacttcttaatcaatcttcttcactacctactattcacgctttggaagccgaagaaaatagaaatctgagttttagctgaatcagatataaacaaaagctaggaaccaaagtgaaatctgccattcagttcaggtctattttaactctggaaaaccctctgagctctctcttctttataacgaaccaaattgaatcagtcacctgcacatgctaagaagtttgtactgtaaaaaattgatttgtgaaatacagcagcaacttaataagaaacacaagaaaataggtagtggagcaacaaactggatggttgcattaacttcattctacttagttcatgtatgtatggtttaaagaaaatacacacttgagatagagcctaacttcttgcagtggtttgtgttcatttgacttacttccatgaggagtaatgcataggatctaggattgcaaagagggaagaaagttgcatggggtgaaatcagttactaacttgagatgtgagacagagcacatttttcaaaactggctacagcaatactgcttgtctttcatattcttccagatgcttgtcaaaccccatcaagagttggagacaatgtttcttctccttaaacctgggtgggggtttgtgagtgcctttatgaatacagtgatggggaagtacattttaaggctacatcacaaaaagagaattgagtctccacatagcttcctctctcttgggaaattcatctggggagctctaagatcagatgtaaccagtggggattcctgagctagacagactacaattagaggccacataagaaaaaaggagagattccggaagacctccagctgttaaagcccttagctgtttgagtcttcgcagcatcagctgccagacatgtgagtgaacaagtcttaagatgattccactggagccttcaagctgtcccagctgatactgagtggaacctacaagctgcctctaagccttgatcaaattgcagatttgcaaggagactgaatgttgtcactgttttaagccactaaatgttaagtgattagttacacagcatttgatacaataaaaaaatttatgtatattttaaattgcatgctatcaataaattcagtcctccattatttaggaaatagtttacactttatttatacacttaaatctttgtcatatctcttctgcccatctactggatgttgcatccctaataatgctacactggaaataaaattaacattagataatatgtttgtcattaggatctttaaaaagatagttcgggagagaaaacggggagaaaaatttgcataattaggacactgtgatatattcaggaagtatacaaaaatagtatttctcctcaacagcattttcaatgagaatatatagggtaaaattttttcacagtggccataaaattaatatggattccagaaataaacttagttgacatttgttatagtgaaaactttttggatataataccaaagacatgatccatgaaaacaataactgataaactgaactttattaaaattaaaaagcttctgcactgcaaaagacactgtcaagaacctgagaagacaagccacagactgggaaaacatattggcaaaagacacatctgattagggactgtatccagaatacagaaaaaactcttaaaagtgaataaacaaatgaccttatcaaaaaatgggccaaatacctgaaaaaatgtttcaccaaagaagatatacagttggaaaataagcatataaaaagatattccacatcttatgtcaccatatgttttaatttaattcaaattaaaataatgagatatcactacatacctattagaatggccaaaagctggaacactgacacacccagtgctagtaagaatgtggagtaacaggaactcacattcattgctggggggaaggcaaactagtgcagccacttttaaagacagtttagacattatgcaaattaaacatacttttactgcacaatccaggaatcacatttttggcatttacccaaaagaattgaaaacttctgcccacacacaaaaaacatgcacatggatgtttatagcaattatatattcataattgcccaaacttggaagcaaccaagatgtctttcagtaggtgaacgaataaactgtgtacatacagacagtggaatattattcagcaatgaaaagaaatgagctatgaagccatgaaaagatgtggaagacccttaaatgcatattactaagtggaagaagccagtttgaaaagcctacattactgcatgagtccaattatatgacattctgagaaaggcaaaactatggagacagtaaaaagattaatgtttgccgggggttggaggtaaggaggaattaatgggtagagatttttttgagaggagtgaagctattctgtatcatactacattggtggatacctgtcattatacattcatccatacccactgaaggtacaacaccaagagtataccctaatctaaataatgaactttggatgattatgaagtgacattgtaagtttatcaacttaataaatgtactcttagtgggggatgttgataaagggaaaaactgcatggacaggggcagggactgtatgggaaatctctgtactttcctgttactttttctgtgaaactaaaactaataaaaatcatcttaaaaaatattggcacacatgagattagtaaaatatggtaggtatatcaattttgaaagggtaggagtgattaaagactatattagactttaatgttaactttataatttttttttttgagatggagtcttgctctgttgcccaggctggagtgtagtggcgtgatctcggctcgctgcaacatccacctcccaggttcaaattattctcccacctcagcctcccgagtagctgggactatagggacgtgccaccacacccagctgatttttgtatttttagtagagatggggtttcagcatgttggccaggctggtttcaaactcctggcctcaggttatctgcccgactcggcctcccaaaatgctgagattacaggtgtgagccaccacagctggccatataaatttgttttattcaaacaatattttaatgcttttggtttagaaaattactacttgtgaaaatatttatagtctttttaattgcttcttacataatatattttcataatgtatttattttaggttagtacataagtctttcatttccccccatgtggtaagtacaaaacatctcattgttcctatcacagaaaacacactagtagaacaggaagatgttttatttgatatgttaggttctaaaaatacagttaaatataaaatccaatgagtctgtagttctgatatgctaaaaatacataaaatcactttggatactattaggttttcttcattgctgatggtgagggaattaagagtacagttaaggtgcagatttttatgtaagttgtggattttgatattgttttatgagaaagaatagtgtattaaagagtttaatagatcttacattttcaaccaccattaatctttaaattttatgatttaacttttgaatcctcagttaagcgttgtgatttctttgataatatttcattagattttaaaatttaacattaatcaaattacatataattaaatccagtgttattggagaagaatcatgacatgccagggagatgaggaaggagtatattcagtacatattttttaatacaaaaaaagaacactggttattaattgcttcatataagtgtactgaaaagtgtcaatttctagaatgcataggccatattccttgcttaaatttatctgcaactatcctgagttcatatgcaactattttaaaattaatgcatatgtataataaattttattgatgaatgataaatttaggtaaaatttaatacacttatgtacacaaatatagagctaaatttgcctttttaaaaattatgatgctatggtatgattctcatatttatgtctctatgtgatatatagtcactacattatcttgtgttccttaaatactaattacagcttgtttatagccaaaattctttcttctacaagatagagaatgaaataatatagtatggtttctttcctatcttattctcatttcctgacaagtaaatagtgttatcaacttcagtttcaggtctttagttatgatgatttctcttcatgtaataaaatatcatttttgtgagtttctttcctttattctgctgtcactgacctggcccacaaaaatacaatttcatagagcatttcttagacagtactttcagaaatgtcattgcaccactagagaattggcattttctttgccaagatgtcattcctaataatacagtgtcttaggaagtgaagctgggagaaatagctagcagggtggtgaaggatgggttgccacatctataaataacagtgatttgcaggatgatgatctcaccaatagggctcatctcctctcttcctctacattaggatattcagcagcaccagggtgaggctgtcaaggaccccagtggggactgagagagatgatggaagctgttttgcattttagtcattcctgattgaactctagctctcctcattgcagaaggtaaggcagcaggatgttctatacagacaaacagaacttatctttccatgctgctaagtgcagttcctctctctcctagagttatattcactctgttattcaacctaaaattcctttaaggggacatggttaggtaatgttggtggaaaaatcagggcccgtattcaggtgggaatttagtgacttactctgcggttgctactgccaagctctgggggaaatttcttcagtcattgtaccagagaagatgcagtgagtgtatttaggtttttactagacaaaattgtctaaaagatagtgtccatgttcctttgaatcacactgcacataacctgtaatagcaccacaatcatggtcatataaaattttctacagagatgaagctgcacatggaaatatatcttaaagcagattccactatagactaaggaacagggacctgcttcaataaaagcatcttcttccagggaccaaaatatgtcatttcagaagactttgtggtactaaaaaagttaaactaacaaacaacaaaagtgttttactagttaaaaaaactgaaaactacaggtgcaatgcaataggcattactaacatcaatatccaattcactcctactgtctgaaacagagtgacacagaccatgcttttctcacactagcagaactcaaggtattttcatatttgcgtggtctcaacttttccaaaattgtcttccttcattcacccatttgtcttttctgctccaattatgcagagctaagtactggtaaaggagcacacacctgtgtccatattcccttacttaaaaagatcctggcagtgctctgtccaattgtataataattccactagttctttaacatctgcttcatgacaaactttttcaatcatgccttctgtgattgcctatagcccagtttgataaattcttataaatttttgtgggttatgttatttgaacatcaaaaatcaaatcagagttttgaccatattaaacaagtttagtgaacaatgagagaggagatagttctgtctcaccaaactgttctccacgactgtcaggggagatgatgatgacaattgtagtatagagtagtatcttccagtcactttaaattttttgcatgtatgaaaacatttatgtgaaaaccttgtgaaatatatactcacattattagtatctcacaagtgtagaaattgaggcaatgaggtagtgagctacttgccaaaggtcatagagttagcaggtgccagggcctgtgtttgaatccatgcctaactgtcatactgtacttagcagtcagagggcacaggcttttaaaaatcttatcacttaatggctgataatccagcacgtaaaaatcagaattaaagaacacttaaaagacacttaaattcatttcagaaagaaatgggtcaggaaaacttaggacagacatggtaagaagaaaatatagggtagacatgtttactgtcttcaagtattacataggctgtgaaatacgggggattaacttatcttaaattgccccaggactagaattaaaatcattaggcacatattttcaccaaaaatataaagaagctatttctacctgtcagaactgtctaaaaataatttcaaaaaagctttgtgagagagaacatttcccatagctgaaagtttccccactttgggctagttgacatcttttggcaagagttttgtcggtgggtatcaaatatcagaaactagttagaacacacagattgtaagaacctgcacattccatgaattatcagaagactgtcctctgactgctgggactgggaggcaatttaataccatgggtagatcagggacagaaggcaaaaatgtgaaggaggaaaataggaaataaaaatggaaatggagtgggtgggtgatgactgggagaagagcaaaaaagataaaccgtcatctagtgaggccccactgggcagagtcactaaggcagggagagttgagcccctgtacagcctttctcccacctttccaatgttcacacgtttaacagtggtttagggttggtttagctctgctgttatgtttttcctttgagacagctttttcctctttagttaggaaggcagagctctgactctgttgtggagcaaaagctattaaaagaaaattgtggtatataaaatggagacacatttttgatcgtatttcaaaggatttgaagggaaagacaagaaaatcaataaatgcatggattcttttacactttaaaaagacaattctttcctttctaaagtctgtttctgggtgttcctgctgtgaaatcaggccataacacaaagatttgatggaaatttacttggtaaaaggataaaatagtaaacagaagagtgaaggtttcagttgcttcccaccctttctactttttgacaagtgataatgccttcattgggaaccatgtagttttcaacgtgtttatttggttagaggaaggttgacattcatttttaaatctaaagtataaaacaaagtcctttttattaatcataattcccaatattttacagatttaaattatctatgacccggggaattctttctcattgttattttggctaacaagaacataaataacagttacataataccataaagagaaaatcaccataataaaatctctggcaatttgtgaacataggtctccatttgagattcttgatgatttattgtaaacaacaaactattttaaaaatttaaaaaataataatttttgatttgaggagattttttccaaaccaaatccttctcctttcattaagtagaaaaatggaaactctgcccctgtaattactccatgtaattggaaattttgtcctgattcatctaaatcatttggttcttgctaggagtattagatggtattaacttctctttctctgtgatgcatagcatttttaaacatttttattttgagatactgtgggtgtgcatatacttataagaaataatagaaagaaatcccatgtacacctttctcagtttctcccaccagtagcatcttgcaaatccatagtaaaataaccaagatattgacattaacacagtcaagacacaaaacagtttccttaccaggacaatctctcggatggtcattttatagccatacccatttttctcctgcttccacccatcctttaagccctgacaaccactatttcttcatttctatcatttagtcatttcaaaaatgttgtataatttggatcatatagtgccttaatctgttcatgctgtcataacaaaatgccatagactgggtggcttaacagaaatttatcttctcacagttctggaggctaagttcaaaatcaagctgttggccaatttagtttcaggtgaaggctcctctcctgtcttgcagataactgccttcttgctgtgttctcacatggccgaaagaaaaagccagcaagcattctggtgtttcttcttataagggcactaatgccattatgagggtcccaccctcatgaccttatctaactttaaccaccaaaggtgccttctccaaacaccatcaccttagggattagagcttccacatattaatttgtgggggatacaaatattagtccagaacatacagcatggagtgttttgatagtggcttttttttcccacttatcataattttctaatttatccaagttgttgtgtgtatttatagttcattactttttatcactgagtattattgtctaatatgaatgtgccataggttgtttaaccattcacttactgaaggccatctgggctggttccagtttttggctattacaaataagctgctataaacatttgtgtacagagtgtgtgtgtgtacgtgtgtgtgtgtgtgtgtgtgagagagagagagagagagagagagagaaagagagatttcttttccctgggataaatgcctaggagtacaattgttgggtcatataaaagttgcatgtttagtttttaagaaatgatcagctccctctccctctctttccacggtctccctctccctctctttccacggtctccctctgatgccgagccgaagctggactgtactgctgccatctcggctcactgcaacctccctgcctgattctcctgcctcagcctgcccagtgcctgcgattgcaggcgcgcgccgccacgcctgactggttttctatttttttggtggagacggggattcgctgtgttggccgggccggtctccagctcctaaccgcgagtgatccgccagcctccgcctcccgaggtgccaggattgcagatggagtctggttcactcagtgctcaatggtgcccaggctggagtgcagaggcgtcatctcggctcgctacaacctccacctcccagctgcctgccttggcctcccaaagtgacgagattgcagcctctgcccggctgccaccccgtctgggaagtgaggagcatctccgcctggccgcccatcatctgggatgtgaggagcccctctgcctggctgcccagtctggaaagtgaggagcgtctctgcccggccgccatcccatctgggaagtgaggagcgtctctgcccggccgcccatcgtctgagatgtggggagcgcctctgaccggctgcgaccccatctgggaggtgaagagcgtctctgcccggccgccccgtctgagaagtgaggagcccctccgcccggcagccaccccgtctgggaagtgaggagcatctccgcccggcagccgccccgtccgggaggtgaggggcgcctctgcccggccgcccctactgggaagtgaggagcccctctgcccggccaccaccccgtctgggaggtgtacccaacagctcattgagaacgggccaggatgacgatggcggttttgtggaatagaaatgggggaggggtggggaaaagattgagaaatcggatggttgccctgtctgtgtagaaggaaggagacatgggagacttttcattttgttctgtactaagaaagattcttctgccttgggatcctgttgatctgtgaccttgcccccaactctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaaagctgcggaaggccgcagggtcctctgcctaggaaaaccagagacctttgttcacttgttaatctgctgaccttccctccactattgtcatatgaccctgccaaatccccctctgtgagaaacacccaagaatgatcaataaaaaaaaaaaaaaaaagaaatgatcaaactcttccagagaggctgtaccttcttacagtcacaccagtgatttttcccattttctaattggaattattattgagttttagaatttatttatatattctatattctcatccttcatttgttacgtaattttcaaatattttcctccagtcagtatcttgcatattcctaacaggacatttagcagagcaaaagttgtgaatcaataatgttttaatttgtcaaattttccttttacagaatatgctcttggtgtcaaggatgagaactctttgcctgattctagatccaagtgattttctcagatattttttctttaagctttatagttgacattttacacttaagtctgtgatccattttgagttacatttatataaagtgagtcttttgtttcacttttttgactatcagtatccaagtgtcccaacactatttattgaaaagcctccttcattgaattgtgttaccttccctctctctcttaaatgacaggaaattccaaatgaagcatggagtttagctacccattccaaactaaagttttcgtttttagtcaaacttcttccacatctcatatgtcatcttatgcctttgtacccaggcacaaatatggtacacaaagttgatgaccattcttttttcctttttttttttttttgagttggaggagtctcactccttgccctggctggagtgcagtagcatgatctcggcttactgcaacctctgtctcccaggttcaagcaattctccttcctcagcctcctgagtagagtagctgggactacaggtgcgcaccaccgtgcccggctaattttcgtattcttagtagagacaggggtttcaatgtgttggccaggttggtctcaaactcctgacctcaggtgacctacctgccttggcctcccaaagagctgagattacaggcgtgagccaccacacccagccccattctcttatttttctaaacaatcatctaaaccttcacttatcttattattgagaacattaacaacttttacatttgcatatatcttttatattgttaaggaaccagaataacttacgctgttaaagaaaaaaaggaaaatgttggctgctccaagccaaatggcaggtgattagtatattactatcatttcctagtactgccaaacaaaattatgtttggagactggcctgagagatgaagtctgtcccctgctgcaatgactttttacaggttcagatcctttcccagactctggtgaaatttaacgggtggcaggggatgatctttctcaatgccaacctagccaatgggcctccatgctatggatcccaaagttgaagactcaatttcagcaatttcaattaattcacaaaatcacttactttggtttatactaaacctgagagagaaaaatcaggcctggtttgtgcatctgctcccaattgttcttggaaacacttcctcctctactcaatcaactcaattctctcccgagttcacccaatgtgttgataaattatttcttaaattctgaaaacaaagatcttctgactactcactcccaatcaattcttccaagaaactttactcttactgataccaagatgatttattcctaatcaatacgtgtaattcatggctccactcttaccagataaagaaacatttaatctttggtggatatatcaaataagagctgtattaatctctaagtagggtatataatggaccagcttctcatacttggtcttggaatcagtcttttcaatatctcttgggaccagtgtattattgatatttgcagaatattttgttttcctaaaacttgaataggggaaataaaacatttctaaagaaatgtgaaagtaggaaactaaaatgactgtctcaagatcatgccaaaagttctggtacatgtttatttactgttcattttaaaactgtttcacagacaaggacctgagaaatgccaactacattccagaaattgttattcaaattgaaacctttaaggagattcttaaatgtatcttatcttggattttatattttaaaactttttatttccagagtaagagcaaaaaagaaactatgtacttgtatatcacaagtaaacaatttcgggtccctggggtttgttattacttggaagctcacttgtttgccttgtgaattatctatgcttcctcttcaaaatcactgaaatacatttccttatagaaacccaataatcttgagatagaatggtgtaatgtatcatccaaaacacaaaatcacttaccttggttcatactgaacctgagaaagaaaaatcagacctggtttgtaaataggaataaaatttccctacatttttaatggaagatatctgaggtgtcagagtagagaaaaaaatggcttttgcttcctagaatggcaagtcaatgtcataatagtattaccatctttgtgagttgctcctttttcatagtctcatcttcaaaaaaaaaactcaagaataaagcaaaacttttttgggtgaaaatatattaattttctagtctgcatactggctgttatctgtataattactggtttgacttaacctcggtatacaggaaattctttaaaatggtttttttgttaaattttgacagctgctttcattttgacagacatctagtgaagtgtttcctatgcagtatgacagtgccagccatgacgttaattgcatcttttgttggaaaatgccacatgtaacatttcaaacagaatccaaacaccaggatgactattcatttattttgctttgcagtagagttctaaaatattagacttcattttgtctttctcagttttctaattgactacttcaactatgtgcactgatcatattagccagcactatcagttaactagatagtctaatcaaggatgtcttttatcaacaacatgccatactcagtccttttaagaacatgttagagttttaattggtttttaagtgtaaagttaatttgagaaacaagtcagtatcttttctagaaaatcataaaatgtgaaatataacttcagacttagagacattgatatgaatgtgcataaagtaatgtaaagtaatttaacagtaattaagtttcttagggtttctgttgctactttggacaggaagatctttcttagcatacattgcagaagtgttatcgctatgcactgtatgctttcttatatgtgtttattcatatattgatttaagaaatactacagaatctattcaatgccaggtacaatagtgagaaaaataataaatggttgctgccttcatgagcgttgctttacatcaaaatattgttttaaaataatacgtagtatcatcgaaaggcccatgttttcttgcacctggaatcagctttgccattggatatataacaaccccttatctacaatcataaggtccaattttgccttataagcaatacaataatttttaccacaattttattcatcacagggtcaagttgtgtttaactatttaccttcttgagagacttaaaatccacagccatatttacaataccacaaattctaaccttaggaaattaaaacatccctgcttgttttctgatttattactgccatgacaatgcaaagaaaattaaaaatgaatctgaaagtgtgccagatcatttagactcactacaggaaatattttcactgaactaatcattattttttgggtttggtggtaatgatcagttgctgttttgtgacatctatttccatattgataaagtcaatttgtttatcagatttgtgctcctactggtgcaattttaaaaaattgaccaccagcaactggtgtcatccaatgcgcttggaagcattagtcaaaatatgaacatccaaacttcattattgatggagccactggagaaaaagacatttagaaatgactgagagtatattgattatcatatgttattatgatattgaagggactaactgttctcaatttgctgtttaggctgttgggacatcaatagagttatcagcactgaatcagatgatgcattattcatttgctttcagccttgacccattacttaaatataagtttgagattttctaaccacctcttatgttttatcttaacatttgccttgagtgaacgtctgctcttatagatttattttaatggctttcaaatctagatcactctcctaaacacaattttcaataatttgctctatatctttatactatttcttttttattatatctttgagatttaactgaggtgctaatcccaaattctgttaaatgtctcttgtttcctaaattgattttctatcatttagctaattcaaaatattggtagtggctaacctctacttcttgtcctaacctctacttctaatttaccaaaatgggcactttttttatattggtgttctattttttatttctaatgccacctaagtcagcccatatatattttttgggtgtgtacaacacacatttgcctatttccatagccttccaacatacactttctcagagttctctttgaaaattataggatcattcttattcctacattgctagcaaacccttagtagctcatcaccccaagctcccaagcctaacatcaaggccctctccatacttgttttcctgcttccacacatgcccacttccaaactactctcctcatacacccaagagggacaagttaaacatgcaaatcagagcaggtcccgacactgcttatggtaacagtgtataagctttccattgctgctagaataaaatccaacttcttttcctcggggttgttcatggtctggcctgactacttgcctgtctttccagattctatttgtgccactctactctttgttatgttctggaaacagtgttcttgataattaaaaaatactttatacactgtgtcctcttaagtagatggtttctcaaccaagatggctgagaaaataatgtgccaggctgacttaaaaaagggaaaagagaattatatgaggaataattgctataattcatgccatattaccactaataaggaaaaccaaagaagtctttatcactagtacacacctacttagtgtcattagtatatgtttattttatcttaaaagtctgagaatgtttgttatttttgacataattcattagtttctataactgtatagatgtcaatgtacaactttacacacattaacacagtcaagctgaaaacattacaataacatacaatttgtttctatactctgagttgtgtttctccaaaaaaatacttcacaaattttagcagactttaatattattttgagtttgtttcaatcttgaaatgtttatcttactcaagataatcttgaaatgtttatcttacatttttggcatttttttcttagtattacttattggtctggttcactatcgccaccagaatacaagtctcattacatacactcataggcatctatagattatgtgggagacaggaagatgagcgaggaaggctgagctgctacagctcagttgagagacttcacgaacactaacagctgaattctcttgtatattcctattggtccgttaactgaattcttttatctcctcttctttcacaaatgggaagactcttaagagatcttctgagttgaaatagaatcaagagacaataggttttgaagctatattaaattgcaagactgaagaaaatctttatgtaagaaataaattggccttcccttcagaagattgtgtgtgtgtgtgtgtgtgtgtgtgtgtgtgtgttttgtctttgcttgttttattaactgacagttgttataggtaatctatgtgttacatgaatttagtggagagttcaccatttatatgtgggttaaagactgaaattaaaggcctggttaacaatgcccttatgtattaaggaaggtcataaggaggatatgtaattattcccttaatttttttaggatcaacccctccaactttcaaaattctctacttcacctgttcattaatttttataattggaacactgaaaattttacagagggctgtttttacgctcttctgagtagtatttatggatgatttagagacaggggattaaatccacatgaaatcatcacgtttccctagatgtcagcatgaaattactactttcccctgcaaatttccatgaaattacaaaaattattgcatctttgtctctggatatcttgcttgaaaatataaatgacaccgagttaacctttattttagttcagttcctggtatagatacttatttgtgaatttgttaattaagcaataggagaaaaatgtatacattttatataggaaaattttaaagttgagtcatattaaatgcctaaattcagtgatcagaatcctactatttccagtgagtgacagcctgtagcataggcaagttgcctatttttgccagtttcacaatagtatttgctgtcaccaaatatctcatgtaatatgaattttcatcaagattgactaaattggtgaattaattgtaatgaagtatacttttgtctatggaaatagccttttgagtatgatttaaaatatatactctgatctcacacacatacacacactcaactacatcttatgtaccatacttccaacaattttaaagttgctataagatctttaaatataattttgccctcattttgttgggattatatactgcagacttttaatgtactgtttggatatgtgacttaaacattccctttttgcaagagagtggtttcttgcaaaccatataccaggcttgatatatgatttgcctggggcaatttaatgtgagtaaaggagctttgtaccatatccaaatgttttctgggccattgtaaggctttcttatggtgtcttttacttctgccatagaacttgtaagtttctagataggggctgcttctttattccagactacctctgtcctgaaacagaaacaaagtaacttgagttacagccaatccacaatgaatatgtgaaataagtgaaaaaataacccaaataatgaacccaaataataaacccaaataatgaacatatggagtttatgttgttttttagcccttcttcccctctcttgctcccaccttttggagtccccagtttctaattcctgtctttatgttttcgtgtacccaggatttatctaccacttgtaagtagaatatgcaatattctatggttttctatgtctgcattaattcgctcaggatactggcctctagctacatccatgtcgctgcaaaggacatgatttcattctttttatggctgcctagtattccatggcatacatgtcccatgctttcattatccaatcccccattattgagcattctaggttaattccatgtcttttctactgtgaatagtgctgtcataaacatatgagtgcaggtgtctttttggtagaatttttctttgggtatatacccagtaaagaaattgctgagttgaaggatagttctattttcagttatttgaaaaattttctaaaccctttcgacaggggctgaataacttacattcacaccaatagagtataagcatttcattttctctgcagccttgccaacatctgttgtttttaaaccttttaacaatagccattctgcctggtgtgagatagtatttcattgtggttttgatttgcagttctttgatgattagtgatgttgggcattttttcatatgtttgttggtttgttgcatgtcttcttttgagcagtagctgttcatgtcttttgctggtttttaatcaggctattttattcttgtaggtttatgttgcttatagattgtggatattagtcttttgttggatgcatggcttaattttcttttactttgtaggttttctgttttctctgttggtaatattcttactttgcagaagctctttagttttaattatgtcccaattgtcaatttttgggttttgttgcatttcttttggaggacttagtcatagattatttgcctagaccaaagtccagaagaatattttccaggttttgttctatgatatagttttacgtcttatatttaagtatttaattgatttactttttgtatatggtgagaagtagggctccagtttcattcttctgcatatggttaactagttttactagcaccacatattgaataggtagtcctcttcccattgattatttttgtcaactttttaaaaggtcagttggttataggtatgtggctttattcctatgttctgtattctgttctatcggtctatgtgtccatttgtgtatcagtaccatgctattttgattattgtagctttgtagtatagtttgaagttgggtaatgtgatgcttctggctattttctttttgtttagggttttgtctattcaggctctttttttggttccatatgaattttagaatttttttttcctaattctgtgaagaataacattagtaatttaataggaatagtattgaatctgtagatttctttgtgtactatgtatattttaatgatattgttcatgagcatggaatgttttcccaattgcttgtgtcatctgtgattttcttcagcagtgttttgcagttctcctgctgcatcatgcaaactctagaaagtagtattttcctttccatgtagtaaaaaatattttaacttttcataaagatttataagtaaatttttataggaaaaatttaattctcttaaaccatgcacatccttctggaacctaaatgttaattttgatttaaactcactaacttttcagtaaactgtgcataaccgtctaacttcatttggtctaaaataactatataaggttgtaaagccagaagtactgatgggatacaatgatgggtagctagtaacttgaaggatctactgttcaaagtattaattctttaccagactgtttttgtaaggtacacaaatagaatttctcttttcatagtagatatacaattttttccatgaaaataaaattaagaaaagttttgtagttttgcaggtcttcataattgtataggtttggtaacctttgtgatttataaggtgatgtgatccaaaaacctcaatagctgtgtgtgtactggacttttgcccctggtattgggatacatatagaaagagcttcaagggaccttgaacatcaactaaacaatcatcttttaacaaaaaagaaataagggtcagcctttcctatttcccaaaattctatgtcaggtgtctattttttatagtgttttgtgtatcttttatcatagcagtatattaaaattggtttttacttgcctgcttttcactataatgaaagctcactaattgcttagtaagtagattgttagcattgaattcccagaacatataaggcattttaaaatctagaattataataacatataacatttactgaacatttactatgtttcaggaaatctaagttttatgtatgttatataacaagatatatatctgtgtatatatgtataacatttccatatatacacatacgtacaacatctatatctgtcatacatacacacacacaacatatacctatatacatgtgtataaatgtagacatctcttcatgtaaaacttgtcaattctgtgaggaatgggctatttattatcccctgcttacagaagaggaaattaagagtcagcaaggtgaagcaacttgtccaaatttacagtgaagttagtaagtggattcaagatccaaacgtagcattttaattatacagccttcatttttagccattatatttcattgcctattatagagtagatgttccatagatgttgaaagtagattaaatacatctaactgagggaatgaacatgtaaaacacaatgacaatataattcaacatgctaagttatataaaatctgtaagcaaaaggtatgctatactatttgtatactaggtacacaagaacgggtcagagaaggcttcatagaacattaacatttcaaactaatatttaaagtaatattttaaagaaatatcgtgttcaaatgaaatataagaaattttattttatctttgtcagtagaatgcccacttaggtttttcttctgccttaccaatttagtaattagtaaaatacactgcaaatcattcttaatacacatttgacgcagatcctacctgtgttttcccatatatgtttagctatacttttcttatgaaaaatgaatgaaaaccagaatgaataataacctacctcctctgatggctcagagtaaagtatcctggtctttgtatcatttgttaagttccccattcatgaattatcagcatttggtttaactgactggggtttcagaaaaggatgccccttctttttttggctgaaactaagcaatttgatgcactggtacttatatgcactttaaattttcaagatttaaaataatctggtgtgataatggaatcttatatgtttacctatgaaataattacttttaaagcaatgcttcctaaatgattgtcttttttttgtaaaacttaagatttttataaggcaacaaaatatattgattttatttttaaaagacattaccaaggttcctaaatttttaatttctgtgatagtcaatgtttgtcctgccttacccactccctcctagctctcccactaatttgaaattaaaagtgtggaataacatgcctcattctagtcatgagaaaaacctcagacaaactgggagattttctgtataatgcctaacctagtactcctcaaaactatcaaggttatcaaaacaaggaaagtctttgaaacactatcagaattaagatacacctaaggagacatgacagccatataatgtaatgtggtctcgtggatgcatcctggaacaggaagataacattgagcaaaaatggagaaaatctgaatacaatgtggacatttattaagaggcatgtatcaaatattggttcaataattataataaatataccatactcacataagatgttaatcataggagtatctggatatggggaattcataaaccctctttacaactattttgtaaatctaaagttattctaaaataacaagtttgtttaaaaaatatacaatggtgtgcttattcatgttagcagctccaccaggaaatcctgaaagactgaaatcttttgatgtttgcttacaagtgataaaatcggggcattttataaaggtatttgttatagaaaattagggagcaactttagtgaattcatttgaatatagacattgagcgtactctgctaccaaatattcacatgcaaattcactcaaatgaaaagctcttttccatatactgatttttcagtgttataatggaaatgtgaagaaaatctgcgttcaacaaacttcctgaggaagtcttcagatttaaactgaaccctgacttgtcctctgtgtccccacagtgtcacttgacacatcatgggggacaggctaacatttaactaaagaaaggtaagtaattgtactcccttctgaagcaattgtattttgggtatgtaggtagtgtttctattacatggcaggcacaacacaaagttttatttaaaatgcatgcaatatcggtggcttagaatctcttgatatagtgtctttccctgaggacaaggctttaaccacatccgtctctaaaaaaatatttaggccaaactttcatcttagtatagagaaaaagtagtacattcatcgcccctgcttgatgcatacctggatatgattaatgtagacatgctctcaggactaggatgactattcacagaagttgggactgtcaagctctgagttgagtcaatccttatgcttcacagttgtagtttctattcctcaccaaaattttaacattttctgtttggatattcttctttgcccagttaaaaagttatcatcctcttattaatccttgtcctcatccccaagcctttcccctgtgccctgcagaaattctcttccaattgagagcaatttacaaaattctttaagttaacatgaacagtttcttccattcttttttgattgaatccaggatcttctggggtcactacttcccttgcagacctgttagtcacttttttacattttcatataacatgtgtccccaagggtcagaagtgatctacgttttttcctaaaattaaaaatgactatttgaaaggccactgaaaataaaatgttaatatttatgtgttttctagaccaattctcttcagacgcctcatttctttcactacaaatatattcagtattttttcttgagcaaggtacttgatcagtcctgctttaggtgcagcaaattctgtttcagtaaagattctacttgtattggttatctttgcctacgtgtacatttactcaagaacttacaggcttaatacaacatatatttattatctcacagattctgtggactataaatctggtcattgtttaactggttcctttgcctcagagtctctggcaaagatgtaatcaatgtgtcagttaggtctccagtctcatttgaagatctgattggggaataatccacacttctaagctcatgttgttagcaggattcagttcctggtggactgtgaacagaggacctgatttcttgctgctggttggtcagagaccaccctgagtgattctcacttcgtttcaccagaattgcagagttggaagtgagagggaaggagggagggagggagcatgagacagtgagagaacaagagagcaagctaaagtcagtcttctggaatataattacagaagcgacatcccatcaacttttccgtattctacttgttagaaatgagtcaataaattcagcctacactcaaaataatgggatgacaggaagagatgagtatcatgaagtggggatttgaaagctgcttgccacaaacagtccggaaaaaaaaaaaaatcacgcactgaaacttttcctttatgtgcctcatactttttccctctaggcctctgcctgcattttcctgtgctggaaacatgcttcaacagctgcctctcctcactctattatcagcatgtttcctcatctttaaaatacagatcaggtgtgatggctaattttatgtgtcaatttgactgtgccatgggatgcttcaattaaacattatttctgggtgtgtccatgaaagtactctgaatgaaatgaacatttgaatcagtgggaatcatccaatccactgaaagcagaatagagcaaaaaggaggatggatgaaaacttagccgcttttgcttcctgccttgagctggaactttaatcttttctgctcttggactggaatttatatcatcggattctctgattctcaggccttcaaatcttaaagtagaattataccactggcttacctgggtcttcagtttgcagatggcaaattatgcaattcctcaggctccataatcatgtgagccaattttttattttataatatatcctattggttctgtttctctgaagaatcataatacataatcgatcaccagggtcctccctctggtaatgttacctttttcatgcaaaactttatcaccaaatataaggtaagagagatatttttaaaaaaatgtttataatagaaggctgaaacttgaagagactgaagataatatctagtttctttttataggcatagactaggtaaatttactttcctagtgctgtataatttttcagacaaaaaacagtttcttggtcctgagattctgataatcttaccacttctctaaactgggtgatatgttatttgtcattattaaaattatcaaaggactgtttgaattcatagtaatgggtttatttttctctgaatagtagctatacctgaatacatgctaatgagtatatcaacttgaagttacatgttattttagtatggagaaaggtacataaacaaatccttttccccatagatgacccaggataacttgttagggtagaaataattttaaaagggggaaactattttctagatttcttatgtaggaagtttgttaaatttaccaaatttgccttacaggatgtgaaacaagtggcaattcacatcagtaactgaggcattaaaaaatgaggctcatttcaattcagtgtagattggccctaatcactaaatgttggttaatttaaaatattcctgatgtctttaagctgcacaccattttagagactttgagtgtgaacctatatgtattaatttataaacacacacatacagagcacttagatattcagaaaataactgaagacaatgaactaagttttttaaactcattagtaactgatacagaaaaggtaccattgaatgagagtatacacagctactagagcttgcaacttcaagttacatctctacatggtgcacaaggttattgaagtctgtatctacaaataaaatgacaaatgctaacttttctccttcatttataatgttgaagtgatagaggaacataattgcctgcgtgattgtaggccatataccagaagaccaaagattttagcacaaagttttctctctcatttaaacactgattcatgatttgatcatactgatgtcatctaaacttagttgaccacacacacaaaaaggtttccattcttttcttgacctgccacactggccaattactatgacattgatagacagttgaaaactgatctttgcaggacaaatagctaatgcatgtggggcttaaaacctaagtgacaggctgataggtgtagccatgaactatggcatgcatatacctatgtaacaaacctgcacattcttcacatgtatcctgcaacttaaaaaaaaataacttaaaattctagcatccaaaaaaaacgaccttgaatacttccaaatcagatttttgaaccaccttcttgtaccaaatttccttctcatttaaatggagagagtattgtacattgacacttattaattaaggtgagtggagggcacttaagtggctacaccacagagcatgactatcatgaagcacagccatggcctattgtgtcagtcatcgctgcgactgtgcttaacgtgcttaatgtagatgtggaattatttgatggaattatgatgaaaaaatatcaagccttatgggagacgctgggtaatgataatgagccaagtgttgtagtccattggtgctggctgcctgatttgtccagatgggcttctgcctggagggttagcattagccttttgacaacatctccattaattctcactttacaaagagtgatggcatggaaacccgtctcagttcttgtgcttatgagatgtgtgacagtaaggcatgcctgccatttcagggaatggtagggacaacacttaaaatgtgtgctcctgaaaaacagtcaaatgagaaggcacaaacatcttcagaacttgaaaataattttttaaagtgcctttattaaactcagcatgggagacaatctgaaccgagatcttcatcaatcagattaactactttccaagatgaaaacagacgaggcacagtgtgaggctgagcagatatttatcaaaagccatattaataaccactttcagctttttcttgacagtttcatctgaggttccatgtttaacatttgagtatcatatgtttttgtcagaatgaggctgctaagagcatcaattaattaattcttttgaagtacagttcagaaaggtaataaagtaactgtctctaaggccaaaccagtaatggtaagcaacattctggagctacacaatttgttacttggaagagaaattaaaagcaaaatgtcttcttgaactcacctgagaataaatacagatatattttgcaaagtggcaataaggtatatatgcatttatatatgtatagccacaaatatatatttggtatacataattgcctacttggctgaaatatttctcatttacattctagtgtatactttagcagaataaaaatggactcttcaatttgctttatttaaatggcctgtaaatagggcaaaattaaacctggaaaaataatgaggaaatttttatattattaagattatcaaccacactttagtgtttcagaaaattaatttggtgggttaaaaaaatttctcagctcatgaaaattaacacttgaagtaatgcaactcagagtgtagaaaacatttgtaccttgtcacagccagatgtgagttacatatatttagggaccccttctgccatctccactttatgcagggaccatcacagacatggctaatgtagttctcacttcaatgatgtaatattagcaactggcaaacaactaaatcttagtaatctcagagatacttttgtgtacataaggtgtcaagccaaagtgcaaaataaaaataagacaggtgtgtgctgatgtaggctcattttacatgggatatttcttcagtctggaggcatgttccttatgaataatttagaatgagctttctgttacttgaagctttatatcatccacgtttacagtgactcagccttatgacaaaaatctgtcgcataagttcctggatgagatggtctattttgtagaactctttgactaataaacagatactaattcaaagtggcatgacttggagtgtgagctacctttggaggtagatggcctgccaggcaatagcaatataaggagccttctcactctgatgacctgtgagtgacaactctcaattattatgttcctgcatcagaggcttggatcacaactttcttgctattgtgacgtgggttcacatatttcttttccattttcttccatttcctatcccttttctaagacaggttattttttcttctaattgattaaaaaaaggtagtgatgttttatcaattcatactcaatattaatacttctagtatagaagtattaggagtttcatggtctcatctttttttgtcagctaggatttcagaggtttttgaactgatatctttatgggagcctggcaccatggtctcaataattgtccccctaaaattcatatgttgaaatttactccacagtgtgatattattaagaggtggaatcttaaggaagtaataaggtccagaaggcgccgacctcatgaatagagttagtgatcttgtaaaagaggcttgagggaacacttttgctcccttgcatgtgaggacgcaaagtaggtgcactggacatgatcgatatggtgacttactggtgtacttccagcctctataactgtaaacaataaatttatattgtttataaattacctagactaaagcattttattattatgacccaaacagatgaagacagctggcatctcagttctgcaggtatgtttaagtggagtaataataatacattgagtggaaaaaaaaagggattaggtcaaacatcagtggtaagtcataggagttcgagtcattgaacagtacattttcaaacctcaattgtcagatttttttaaatcactccttcaaaatagatgtttgtaatggtaaaacattccgtcattttgtacttttaaagtgcattcacatatgacatccaattttcttctcataccaaaccaagataagatagtttttgaacacatgaacgaggagtttctcacagtggaagaggtgcctgggaaagactgggctgcctagaccacctgcaagtgacacagttgaccttattttaattatagagccaccacatctgtgatgacaatatgagctgaaagaatgagtcataaaaagagatgagtgacagtggagaaaggtgagattcttcaccttccccaggagggggactttcaaacacatgaaattcaagacagtgaaactaaggcattctaattatatgcataattgagtccagctgatttttcctttccctgctaccatccttcccctcctccctctttgtggtatgttgtattaaattgacatttttgagtttgttaaaatacagacacacacacacacacacacacacacacacacacacacacacacacacatatatacacattatatatctatataaatttatgttaacttagaattgttataagtcattctactgccttgatttatgctctttagatttccttttaaattctatcatttgcttcatgcatttctttagagtttatgttatgttttatataatgtttttaattttatatgttttaatgttattctttatattaaagtaggaattaaagtaggaactattttttatttattcagtacttactatacactagcaattacacactaataatgcataaactaagttcaatgtaaaaatcatttctaaaccacatggactggcctatttgctattctaagtatgagatcgtgcattgcttctgatggttttcatcacctgagttattttactggatttttctgttcatgtctgatgctaatttttctattgaaatatttttgtacattacataaaaagaacactataaagttatctatattcatatgtatattaaacttttgcctttttaaacatttactgatgtaattctatgtgctagttattgtactttttacaagtataagccagtataaccttcttggtattcctatttgatagtattgcaatattcattttaagttgaagaaatttaaaagtgaggaaaactttgttgaaagtcacatggctagtagcagatatatagctttaatattagcctatcttattttaaacccatgtacttaactccattttatgctaccttcctatctatgcgataattatttccctcaggcttttacttttaactttagtttctttctccttaaaaattgtttaatatttatgtagtgaaccacatctatattttcctttagggtgtatatgcttttgctgttatgcttagagagtctttacctgcttcaatattatataaatatcacttaaatgttcctctagtttcctgttctaatattaaaaaatattaattacagatcctttcacaaagcttttgaaaggcaaagtctttcagtaaaaaatgtgcacaaatttccgtatatagaaaatttttcctacaacttcaggaagtttatacaatctctgaaccctgtgcattgaggtcaaaagggccatattctagtatgttttgaaaattcttaattcttttgaaatgaatttcgtatgagtataatgcactgaatcatgtgctcccaacattcatatggtgaagtcctaacatccattatctcagaatgtgataatggatgcatttggagataggtcctttaaagaggtaattaaggtaaaatgagatcattagggtaggccctaatacaacataactggcgttcttataagaatagattaggacacaggcatcccgagaaaagaccctgtgaagacacagggagaagatagctggccatctacaagcccaggaaggaggactcagaagaaatcaaccctgctgacattctgatcttgaatggctagtatccagaattgtcagaaaataaatttctaatgtttaaaccaccaagtctgtggtactttgccccggcaaaatagcccttgtaaactaatacaatgagatagggatataatttttgtagcttgctagattcatttttatttttggcaaatgagtttatcatttcaacaccatttattcagtaacttcttatgtacttactgagaataccacttaaatcatattttaaattcatactgtgcccaagtgtaagatgtgagtcttgatatataggatgtatatgcatgcatacatgcatgcgcaggctggcttctgtttccatcttaattcatatggtaagagcatatgcccttaactattcctatttttaaaaaataagttacagtaaagaaaaacaaatacatcacacacatacttggaagtggtacataatttcaaagaaagattgccagtgaggctaattgtgactcagtgataaatgacaacagagcagatttgtattaatgttattatttttctttgattttcctttacagtttgcattttttaaatctcagaattattttgctgttatcaataatgcctgatttataaaagtttgtttcaaatccgattactgttttataacgcatttcaagtgataactgaacatgcattaaatctaagaatatttgaattaaatttaaatagagtaataaaggttatgttcaataaaaaccatacctgagaaagcatacacaaaataaacttaagcagatagatgac

SEQ ID NO: 595 - DNA, 40001 bp, Homo sapiens
ggaagttggaataatatctctgaaactggccgggcgcagtggctcacacctgtaatcccagccgtttcggaggccaaggtgggcggatcacttgaggtagcgaatgcgagaccagcctggccaacatggcgaaaccctgtctctactaaaaatataaaaattagctgggtgtggtagtgcacacctgtaatcccagttactagggagactgaggcaaaagaactgcttgaagccagggggtggacggttgcagtgagccaagttcgtgccactgcattccagcctgggtgacagggcaagactctgtctcaaaaaaaaaaaaaaaaatctctgaaacttacaagagtccttgatgactctgatgatggtgataatgaatgaatgaaatatttgatacatgaaagagaatatatatagcatatataaactttgaaaatattataaaatgagcttgtgacctcgtcactcaacttaaaccactatattacatttactggtatgctccgcctccttcctgaagaaaactactatgataatgttgcacttactctcttgctgttttttaaaaatattacatcctgtatgtacatagccttgaacaatgtgttgcctagttttcctcgtatttgagttttatagaagtgctgtcatggcatatcgtggcaccttgtcatcattatgttcctgaaattctttcgtggtttgggagctgctgagtttcattcactttcactgctccagtatatgctttattagaaatacaccatagtgtatgtatttcttctcttgtccataaacatttaggctgttctgtgtttgctattatgaacaattttgttctgagcaaacttctatgtgtctccaggaacacagtgaccaagagtttctctggactatgtaattcagagtggagtttctgagttataaggttttcaactatcgcttgaaattttattccatagtggttgtatctgtttataaagccactagcagaggatgagagtttttgctgaaccacagtttcatcaacactgtgtactaccaaaattctaaatgtttgccaatcaagaagatataaaacaaatcccattatagtttttatttgtatttccctgattactgataaggttgagcatcttttcacagtttaattcaccatgtatgtttcctcttcagtgaactatttatttcttttgcttattttctaatttctgttagtttctttcttatcaacttatcatagtctgctattaatactgaatattaatctcttgccaattatgcgtgatatgaatatcttgtcccattgagtggctttacctttccactcctttttgagtgacctttggtaaacagaaatgcccagccttgaggtagtcaaatgtatcaaacttttctttgtatgcgtgtgtgtcttctttaagggatctattccttcctcaagtttataaagatattctctttgtctccgaaaagtcttgaagttttgctttgtgcaatctattggggatttttttttttttttttttttttttttttttttttgcctgtcatgtgaagcagggattcattaaatatgttatctcaatcaacatatttaatgagagagacactctcactcactcacctccttagtcatctgcaatgccacctcttcctcatatcagattgcctcgtgtgtgagatattgctgggccctctatgctgttgcattgatcagtgtgtctttccctgcaccaaaaccacaccatcgcaattactctggctttataataagtcttgatatctggtagctctcctggtaactgggctacaactagattttgagggaaagaatgaggttcaaacattctaattaagagaatgagagatagaaagatgttaagggtttaggtccactgtttatttacaaataatatctattatctaacttctgccccttacgactggtctaaggtagctgccattggaaatacacacgagttactttagctgttgcttataccctattatcaggtcattgaactgttgctttaaaacacagataattcagacttcccagtgattcagatgaaggtagtgatttggttttctgcttttgctccaagacatcagctattttgcaaaaaatgatcaacactttctgctccattagaaaataaaggcacgtgaagatgttaacttctgtgcttattctgaaggggctttaatgctaacatgtcttgcatttcttcagtattatttatatagaacttcatgtttataaagctaagacaaggtgcctggatgaactggaagctttctcaggcgggtcctaggaactctgctatgaactctcttggctctctatggaccacacattttataattcattctgtataaacaacacaaatcttctgagcattttctgtgcagtgaatgttgaataaattcttttcagtggtgacattgactccttaggctgtttatttggacttcctcagtagagatatattcatacaaaccaaataatcttaaatgttgtgcccgggatgtattgtaagtcatgtttatgaatggagttttatattctctatgaaggtgcagaaagagaatatagtacacataatgctcagtccagtcaggtacatggtagagtgcataaaaagtagccctgggcatgtgaaatgtgtatctatagaaatgcatattttaaagaactttgaaaattggctagtgaaaaatattaaagttgaaaagattggcaatgtatatttaaaaatcactatctactagagggaacatgaatatggttcaagagagggaatcaatagttagtaaggataaaatggataagaaaagaaaattgaaatacaggcaggaaatatattcaggcaagagaagtgatgtaatgaaaagaaagcagaattgaaaccacagcctcttccataacaaatgtaagtgttaaaatcatagcggatgattttttcagtaattttggctagagcaggaaaagggggtgtctatagaacagcacttttagtgtttgctgaggtggacaaaagcaatcacaattaatgagctccagcagggggcaaaggcaaacaaaggaagtttgatttttgctgtgattacaaattaagagtagctcaaaatccgttctctaaagcttgttgggtgctcccagtttcccagcttcccctcctctctacccaggttcccagagcacccataaactctcttccctctccacttgtaaaatatcctttcagatcacacttttcttggtgccctgcaacctaggaaaatctctccactcaacagtctaccagtaacacaaactctgcatttagggacacattggccacaataaattagaaggaaattttaccaaaagaaaataagtataatgtttacatttttagatctgtatttatagatataaatgcaaatgcaactgataagggatggcagttatataataatcaaaattcttcaatattatttataattcttgtatcaatagagttgcaagagttagcaaataaaatacacgatgcccaggtaaataaattgcaaagaaacagctgtttagtataagtacatcccatgcaatattcaggatgtactaatactaaaaaattattcattgctctgtagagtacaacgaaagcccggacatctcacagaataaacaaaaatagttcttaaaagttgaggaagcatcaatactgtacataattctacttcaatatttatatgcctctaacacccactaaggttcttcaggaatgttctcagctctctgagacgggattttctcacctttctctctcctggtcattcaggagtccccaaagcttcttgtcaaccctagatattatcagagattctctaaggctccttctcatgcttgttggttctaagtgcaactctgttgagaccacagacctctctagaaagaggctgctggatttgaggctcctccattcaaagggccaaccctttcctgagattccaccgcttctgagcgctccagcagtcgctgccttgcacatggttggacctccccagtacaacgttgaacacagcagtgacagcagatgtccttgtttcatttgcaatctcacagagaaagctttcaatatttcttttttcttttttctctacctccaggttcaaacgattctcctgcctcagcctcctgaatagctaagattacaggtatgtaccaccacgtctggctaattttgtatttttagtagagacagggtttctccatgttggtcaggctggtctcgaactcccaacctcaggtgatccacccatctcggcttcccaaagtgctgggattacaggcatgagccaccacgcccagccaaagctttcaatatttctacacggagttggagctagatttttttttggagatacacttaattaaatttgcaaagtttccttccattcctcatttgctaacaatttttatcaagaatgggggcttattctatctaatattttttctgcagctattgagatgatcatttgggtgttcttctttattctgataatgtgaagaattacatagtttttcaaatactggtcttgtatccccagaagaaacccaaagtgatcacaaagaatcattttctgatattttgctgaggattttgaaaatctatttttatggaagaggtgggcccatgcttttctttctgcctatcagtttctgaaagggatttgttaaaatttatacctatgattgtagatatggctatttctatttttcagttctgttaatttttttccttttttttttttttttttttttttttttttttttggagacagagttttactctgtcgcccgggctggagtacagtggagcgatctcagcttactgaaacttccacctcctggattcaagcaattctcctgcctcagcctcccgagtagctgggactacaggcgcctgctaccacgcctggctaatttttgtatttttagtagagttggagtttcaccatattggccaggctggtctcaaactcctgaccttgtgatccacctgccttaacctcccaaagtgctgggattacaggcataagccaccacacccagccaattttttctctttctacagtgtaagcctatgttatttatttcacacaaattcaggattgaatttgctagatctttgtccttataaaatgttcctctttatctctagtactatctcgtgttgaagtccatttttcgtcagaataactatcttagttttcattatcttaatgtgtgcattgtatatgtttttccacctttttatttttaatttttctattttcttcatatctaaggtaagtctcgtgtgagtggcatattcgtgtttttttgttctttttgtttttttgttttgttttgtttttgtttttgtttttgtttttgtttttgtttttgagtcagggtctcactctgttgcccaggctggagagcagggacacaatcttggctcactgcagcctcaacttcccaggctcgggcgatcctaccacagcctcaggagtagctgagacttcaggcgcaggccaccatgctcagctatttttttgtatttttagtagagaaagggttccgccttgttgcctaggatggtcttgaactcctgggctcaagcaatccacctgcctgggcctcccaaagtgctgggactaaggcatgagccaccacacctgaccaatgttttgttatttattaacaaacaaagttacctttcatttggagtttttcgttcaattacattgaatataattaccaatatgtttgagtttgaatttgccatcttgccatttgttttctacatgtcccacctattatttgttcttttgtgttttcctatctttttagcttaatcagatatttttagttatctcatttgttctcctaatagcttgtaaatggtatatccttctattatctctcatagtcttctaaacaaactcttgagattggtttgttaaataatgtttaaatgtatctctttaacattttatcagtgatgcttttgaaagtacaaatgattcaaaccagaaaacatttagctgtgatatatgagtccatgttagacttcatatttactggaagagaaagtctttccaggaaacactgcgctatggaagtttacattctcattcctgaaccatcagtataaattattgcaaattcatcattaagaatgctgtagctaaaaaatcccatgccagggaccactcaccgaagttctctggggaaaaaacgtgtatataaagtgaaaaggctgagttcttcaggaaggagtgaaggttgtaatgatggacttcactaggaaaccagaatatatatggagattcctgaaggatatttatgaggacttggcccccatattctaccataagatggacccctggctgcacttgccatggggaagtctatggatagcctaatctacctccggctctacttgatggactagcagaaaatttacatgggagtccctaactcacccagggtttagctaccatggcatagatggtggcatggcaaacagaccactggaaaatataaaatccctccagttagacctcggagccaagttgcttctaagtcacctctggctttttcctgcatatacaagggaggtgcctgcctcaggaacaaaactctgcataagtgtcaagttcacagaaagccttgccagaagctggaaggaccttgagatgaggtgtgattcttgtgtcattgagcccctgcttagacttcctttgggtgtgtcatacatctgccgagggaggcgccaaaggaaagttttatgacctctaaggaaggaatataaattaacctacctatccagcttgtgtagtgttttcttttccaaaatactttctctcctctccacttcttccttctttccttccttctccccctccttgccttccctccctccctttctttcttctccctttccttccttccttttcctccttccttcctttccttcttccctccttccttcctttcttcttgctctcacctttcattctctcattcttaacctggattttttgctaacccaaatgtttttagcctttcaaacaaagtcccaccttggctcatggcacatatagaataaagatgatttttcacttggacagttctcatattcggacacttcagtatttgaatagtcctctggtgcctactccacttctccagactgggagaagggagagtattatctcccttcattaccatctggccaggtgtcttcccatttgtaatcccctgattgggtagtgttcttcccctctgtgtgcatctagtgaactgagaagaatatattcagtgtcacccagctgtttattccattaaattctcagtgtttgccgtatattagctgaagaaaaatattaacatcctgtggctggattgtaagctattatagtatattggttacataaatgaagtgtacagtggaaagagattcaaactggtgatcataaagcatgaagaaaaacattttaactgtgtcattagtattgtaatttattcattgatgcttggtttgctgctgatatgttcgtaagtaactgcttggttcatacctgtctctactctgagaatatggtgatgagaagcttccagttgtctccagaaaagcatccttagcatcaatttgaaataaaggtgtattaggttaataaaggctaagctgctataacagaaactcccctagctccccgccaccaccaaatatagtggcttaaataagattgaattttatttctctttcacatacatagatagtgggcagttctgctccacaaaactgtcgagggacttagatttatttcatcttgctaatatgtcattcctaaaatgttgtctttatttaaatgatcaaaaatgacttattgctttgcctggttttaaactcttgagaaagagaaaaagacgaaaaacaaggcaaataattttctttctgacaagtaatgtggaaatcgttcacatctctgaagcttacatttcattggcaaaaaagtctttgccacatagctatacctaactgcaaagattgttaggaaatttagtctctagctgggaagctatgtctccaggaaaaaagtgaagataaatttgaaaagacaaatatacctcacacatccaatttgaaatcaattacaattaccattagctctataagaccgtataacataatggttaagagatctagttctggagacaaaaagcatgaagtccagtttgggctctaacacttactagttgtgtggtcataggcgggtcacttaacttccttaaaaccttagtttcctcacctgtaatatgggaaacataacagaacctttggtcaagattatgtgaaatatataaagggtaacatagtaagagttcaataaatgttacctgacttagtttcctgaagggagtgaatgaacctcttatggataataagacttccgggccaatgggaggtcatccaattaagagcctctttgtctcaacaaaatttatttagcaagactctactttgtagaaggcactggaatagtaggtattaatttatcagataagttatatactttgaatgagtttttattatgtaaaaaagacatataaatcactctaaattccccctctatgtatgaagataacaatagttcttagtgcttttctcactgaatatagaggaatggatgagataacgtttgtcaagagcttagctcattctctagcataacatacagtaagtactcaatatatgttacctccatattatacaaggcgagtgctaaatattattacaagcaatgctatgggaatacaaaagaaggaacaattaattctggctagaaggactagggaagatttcaaggagcttctggaacttctgcaggatttttaaggatgagtaggatttcaaaaatttgaagattttaaaaggatggtttcatcaaagaaaacaacatgagccaaagcatgaaggtgagctattgtgtggcgtgttcaaggacagaataactggataagagattcatgggataatgaatgggagaagttgtggaggagattataatgtgagatcagataatgatggacttccttcattaagcagtggagaggtttctgaggggattttcatactctgaactatttattaggttgaccacctttgttagcagcatacagtatagattagaagggagatgggcgtttcaaatgagaggctggaagagcagacagtggctatgaaagttgtccaggaaaaggacaatagggtctgaatctgggcgctatcattgagaatggaaagtgaaggacagagaagagttatagaagaggcaaaaatcagtaggtttttgcaactcacctaataagaaaagtgaaggagagtggagagctgaaaatatttaagatttctaatctgagcattataaccagggaagatgtacaataacttcaaagtggtatctgctaaaaccaaaatctactagggcatagctattcagatttccaatatcaatggcctgaggcaatggcatttcttgcatgccagtgtggtaatcagtttcagtaaaaacgcataaatcccaatgtgagcactcaattatcttcaaaatctagtcttactgggtcttcagaattcaccaggaaatagcattcacttgagaaatatgacctgaagataacttccgcttccagctcaatggagtacctggtatcagaccatctgtcctgctgaggacaccatcaaagctggatagaatacaaagagaaaaaaaatccagctgtttgaaggtgtcagaggataccccatgatgctaagatacgggggaaaagtactcttaggataccttaagattctgcattaatttccactcacagtacttgctgattcctaaaatgcacatgtataaggtgaaatttgtgaaactaaaccaaaagtatcaattaagtggtagagattttgacagttttatagtcctgcaaagattaaaaaacgggggccccaaacctacaaaaacaagtctttaatgatttttacctgaaagcttgaacagtgatacaccttgagaaactaacagtcccaactagatcaaagagtgattttttcatttgttatgtacccattagaagaaaattaatttccaaattcaggaaaataactattcagattctctataatttttcatactcgatataatttttcatatttaataaaacattaacaggcattttcactaagataaagaacaaggcaaggatgaccactaactcttctactatcccacactgtactagagttatgagtgaaagtaatcaggtaaaggaaatcaatcaaggcctaagaatggataaagctaaagtaaaatgttctctatttgaagatgctataacagtatactagcaaaacctaacagaatcaatgatgaaactaactcaaacaataaaacattgagtaagctagcaggatattaaaatgacagaaaaaatcaatagctttcatgtccacaaacaatgaaaagttagaagacatgatggtagagaacacctcatttacaatagttaccaaaaagataaaatatttagaaataagcttaaaaagaagtgtgtaaaatatgtataaggaaaattttaatacactcctgaaagacaaaaaaagtagatttgaacaaatagaaagacattttctgttcttaggcaggatagtttaatattataaaagatgtgaattttccctaagataatttacacatgaaatgtgatgccaataaaagcaccaacaagctattttatggagttaaaggtgacacttatgagtagtggacattaaaacatactataaagcctctataattaaaacaacatggcaaaggcacatggccagtgaggtggagtagaaaattcagagaaagactcatataagaaaaagtagtatacgatgaggatggcatttgaaaccactggagtaaagatgtttaaaaataaatgatgttagacaattgagtacacattcggaaaaagataaaatgagatccatatctcagagtatacataagaatagactccaaacacttcagggatataaagaaaaaaagtgaaaacctaaagtacttgaattattctttaatcttaatgtaggaaaaagccttgctaactatgactcaaaatccagaggcaatgaaaaagagataaaaggtaacttttgacaaataaaaaggtttttatgacaaaaaacaaacaaaataccaatttaaaaagccaaaagataactgacaaactgggaaaaaatatttgcaacatatctcacagataaagggctagagaatgcttaaaaattgagggccaaggaaccaaaaaaattttatttttattttatttcagtagttttggggggtacaggtggttttcggttccatggataagttctttagtggtgatttctgagattttggtacactcatcacccgagaggtgtacactgtacccaatttgtagtgtcttatcattcaccacctcccacctttcccctgagtccccaaagtccattatatcatttttatgcctttggatcctcatagtttagctcccacttataagtgagaacatacaatgtttggtattcctgagttacttcacttagaataatggcctccagctccatccaagttgctgtgaaggtcattatttcattccagtttaaggctgagtagtattccatggtgtatatatatgacattttctttatccactctttggttgatgagcatttaggttgggaagcaaaatgtaatagaaaaattgaaaaaggcataaactattcataaagacatagtaaaatggttccaaaacatatgtaaaatgataatcattcattaataccatttctcaacaactgattagcaaaacttagaaagcctgacaatacattttgttggcaaagctgtgaggaaacaggtactctcatacactgctgatgggaatacaaactggcagaatcttcctggaagggaatttggaaatacctaacaaaactctgcatgcacttattttttaagacagtaatccgacttctaggaatctacactgaagatacacatctcacaatacaaaaatacatattcagagttattcactgtagcattctgtaaaattgcaatagattagaaacaacctgaaagtcatactttggagagtggctgaataaactgtgatacttccacacaatgaaatactatgtagctgtaaaaagaaacaaaaagataaaagaaaatgaaaaaaaggaacgtctctattaattgatatgaagtgatcttcaagataccaggctaagtgtaaaaagcaagtgcagcctgtaatcccagcactttgggaggcccaggcaggtggatcacgaggtcaagagatcgagaccatcctggccaacatggtgaaactccgtctctactaaaaatacaaaaattagctgggcatggtggcacacacctgtagtcccagctactcaggaggctgaggcaggagaattgcttgaacctgggaggtggaggttgcagcgagccaagatcacgtcactgtactctagcctggcaacagaatgagagtctgtctcaaaaaaaaaaaaaaaataaaagcaagtacaaaagggaataagggaatgaataccatgctacctaccgcgcagagaagaaggtataagaaaagacacatttctgatcatttacacaaaagaaacacaggaaagataaaccaagaactatagcaggtaggtgacagataaaccaagaactacggcaggtaggtgggaaaggaatagatagaagaaaggaatgggagaggttaaaatggggtgaggaaggagtaacacttttgagtatatctttttgtatagatcccactcctacaaccatagtaatgttacacgcattcaaagaaataaacaattcaaaccaaccaggttgtgaagggaactcaagatggagtacaaacaataccacattaacttacctacattgtaaacaaagaacataactacactgaagggagtaaggaagaaaagaactaacttgttggccaggtgtagtggctcacgcctatagtcccagctacttaggaggcccaggcagggggatcgcttgagcctgggaggttcaggttacattgagccatgattgtgccactgcacatcagcccgggtgacagagagagaaaaaaacaacttaagtaactttggacaacaagatttttgattggtactaaagacaaaaagaactatacataaatgctgtagcctagttggtaaatttgtttcttatagaagcccgggttaaccattctgaaattagtttatgcatatgctaggactgaaaaaataagtagataatgaaaaccaagtttctcaccgtcaaagaagtgacaagtaaggaaagtaggaggctaaaatgaacctttgctgctggactggaatctgaggtttcaatgcaaattcatgttttgagagtctatacagatagagaaataaaatggatgtttgtgtatgtgtaagtatgcacagatatatttcctacctctcattgctaagagggcctagaagcaacaaacccatctagcactcagatcttagtttctttttttttttttttcctttgagacagagtcttgctctgttacccaggctgaagtgcagtgggtgatctttgctcacctcaacctccgcctcccaggttcaagcaattcccgtgcttcagcctccctagtagctgggattacaggtgcctgccaccacgcccggctaattttttgtatttttagtagaaggagggggactccagactgaaaaccccatgggtggttttactgggaggctggaggaaacggtgtctgatttgcatagggtccaggggattggtttgaccaggtgtgtcattcatgtagcccaggaaaaacctggccctcccgccctagcctcttaatatgcaaatacgggtcaccatgatgtcctgcacctgtggctttatctggaggcagccatgacacctggcacacattatgacaaggagaagagggcggtaacctccatattgggtagacttgttttctagccaccagcatttacataccaatgcttgccggtctggtttttcaagctgctttctgttggaaaaaaaatgtttttgggggtggcttttttattaaaagaaaaagccttactgaggactgttttaccctatctgcctaaaataatttcttaatagctcctgtaataaaagtgctaaaaacgtaaggggtcttgtcaaaaggacaaaagagccaacttaaaggggctcctcataaccaaagctggaatgatccgagggccaaaataaataacgatagtattggactgcaacccatgaaataaaataaatatccataaacctataatgctataaataagcaaccaaataaataaatggggagaaataacatctctttcatatagaagagtgtcttaatgaaactctttttactatatttgaaacttttatgagagtctaaaattagttagaaatagaaagttaaaaaaaattaataggtatgccaagaagtagaaacaaatgaccaagaatgtaaagcaaaaatacaatcacagggatcctgatacggaggtcatcaggcaaagaccttaaaatgtctattaccattaatattctcaagaaaatgtgaaaattaaaccaaacaagtagaatatattcttaaaagcttaaatagaggaggcagaacaagatggccaattagaaatccctagcactttatctccctgacaaacagccaaactagcaaacaaccacacatcgatgaaaataactaaaggagagtgccagagcacatcaaagaaatagcagaaccggtagagcacagaaacccagtatggtcacatagagaacaaaaggaaacaccttgcctctgccacccatcccccggtcgagatcagcttggaaccaggagggacttccctgcagggaaaaggaaaacagaaggaccctgacaacccccatcaccaccttgaacaactacagtcttcactactggggactcctgcagtattcacaggtgctatgtccagctgcaggagctgtccagaatccatactgctgcatgccttgaccactcagagtaggagctgacactgtgccttgcctccccatggcccacactgacactgcactgagctaccttgaaaccagagccactgctggaatgtgtcgcgttctgggggccagtagtcactgcaccccttcatccctcaggctttgtcaccactgaaccacctctgcctggtggcccacaattcctgagctgaactgctgctacatcctatcctgtggaaccactaaagacctcaatagctaaagcaaaaggaacaaagctgtaagcatctttgtaacttacaaagttacaaagatttttgccaaagttacaaagttacttttgctaaagcaaagttacaaagtaactttgcaaagtaaagttacaaagtaactttgcaaagtaaagttacaaagtaactttgcaaagtaaagttacaaagtaactttgcaaagtaaagttacaaagtaactttgcaaagtaaagttacaaagtaactttgcaaagtaaagttacaaagttactttgcaaagtaaagttacaaagttacttttgctaaagcaaaagttacaaagctgtaactatttgacctcaaaatatactagagctatagtaaccaaaacagcatggttctgacataaaaacagacacatagaccaatgggacacaatagagaacccagaaataaatccacacacttagagccaactgattttttacaaaagtgccaagaaaatacattgcagaaaggacaatctcttcaatacatggtgctggaaaaactggatatgcatatgcagaacaatgaaacttgatctgtatctctctccatatacaaaaatcaaatcgaaaaatatatatacatatatacacatatatacatacacacacacacacacaataaaaaagtattcagacataaaaaagagtgaaatcctgttatttgcagcaacatggatggaacgagatgtcgttatgttaaatgaaataagccaggcatggaaagacaaatatcacacgttctcactcatatgtgggagctaaaaagttgatcttctaaaggttgaaagcaaacttttctgagagtctaaaattagttagaaatagaaagttaccagattctgattgttaccagaggctgggaacgatgggttcaggggaaggagaggaaaaaggaaaggttggttaaagggtataaaaatacagttatatatataaagaataaattatactgttcaatagaatgatcatagttagcagcaattttttgtctattacaaaatagctagaagaaaagatttggaatgttcccaatacaaagaaatgataaatgtttgaggtgatggatatcctaattaccctgatttgctcattatacattgtatgtatgtatcaaattatcatatataccacataaatatgtgcaattattatatatcaatgaaaaattgataaaacaacaatgagacaagaaaaagaaataaaaggtgtctaaatcagaaataaagaaataaaattatctctgtttgcaaataacatgattctaaatgtggactaccccgaagactccagcagaaaactgttacaactaataaataaattcaataaagttacaggatgcaaaattaatgtacaaaagtccatgacattcctagatacaaataacagcctagctgaaaagaaatcaagaaaataatctcatttacaatagcatcaaaataaaataaaataaaatgcttagggataaatataaccaaggaagtgaaagatgtatacactgaaaactatgaaacactgatgaaagaaattgaaggggacacaaataaatggaaagataccaatcttgtggattgcaagaatattgttaaaatgaacatacggcttagagcaatatgtaaaattcagtgcaatccctatcaaaatcccaatggcattcttcatagaaacagaaaaaataattctaaaatttatgtggaaccataatagaccccaaatagccaaagcaattctgaagtttttataatttcactaatatttttaaaaatcaactttaggctttgtcaatttccacttttgaatatttatctcattgattttggcttttacttttgttgttttcttcatcctaatttattgtaaactttctctttgcttttcagcagttttactttgatgtgtctaggtgtggttttctatacaattattttggttgagatatgcacaacttcttgactctcaaactttaattgtgtcaacttgcctggattaacgaaaacccagaaacctggtaaagtgttgttttgggtgcgtctgtgagggtgtgtccagaggagattagtctataagtctgattgactaggaggggaagattggccttactgttggaggccccatttgattggctgggagtccagagagagcaaatgcagaaagcaaaatgggtctttttctgtgagctgggaccaacttttcctctgctgccttatacatcagaactccaggatagctggcttttggactcaagaacttacatcagcagtccctgcaggtctcgaggctgttagcctcaggctgagagttacaccatccgcttccctggttttgaggccgtcagatttggacacagccaccctaccagcgggatcccacaggtctccagcttttggagagtggcctgtcgtggcacttctccgccaccataattgcatcatatgtttatgtagataaatagatatcctattagttctgtctctctggagaacagtgactaatacaaatttggtgttagaaaaagtaaatataattccttcttactttatttcttccaacacagtggaagagatctgtgaaattttcccttgcaaaaaggctcttataaattaagcatatgtagctctttaatggggaaggacaaaactgttaaagctaattattattggtactgcaaaagcagaaattgcttaattgtaacagctgagccataatcaaactttcaaatggacagcatatatttagaaaatgtgtagaccacataaactctccaaatacaagtgcagtgagtgttttgaagatcacaaaagaagtgaaaactcaggcgaaaaagacaaaaaaaacctctcattccaagttactcaactgtgtaggacttctgccccttcacacatagggtcaattcactatactatgcatttcgtcttcacatcatttccaatattagaggtatacattatgttaagacctttagagagttctcatttgttttatgtgttttttgcaaatttggctccataaaagtgcacgatcacaatgttgattttgtgcataagagctgcgtgcactcataagaacgttgaaacttcctcaacaaatgaagagatgtccttttgtacatccgtatttgcgaaagataaaatttcttgagatcttccaacctcgggcaactgcacatgcaggggtgacccatcatagttttttatctatctcatcaaaagacttacgtcatggtatttcaaatgactgcattataaactcaatgcacacaattaccaaccataatgatatgcatctatataggcataccttggagatatcatggatacagtctcaggccaccaaaataaaacaagttacacaaactttttggttccccagtgcatataaaatttatgtttacactatattgtagtctaagtgtgaaatagcattgtctttaaaaagtgtacataccttaatttaaaatttcttaattgtttaaaaatgccaatgatcatctgagccttctgcaagttgtaatctttgctggtggagggtcttgctttgatgcggatggttgctgactgatcagagtgttggttgctgaaggttggaattactgcggcaatttctaaaaataagacaacaatgaagttggctgcagcaattgactgttcctttcatggcagatttctctgtagcatattatactttttgataccatttgatccacagtaggacttctttccaaattggagtcaatcttctcaaaccttgctttatcaactaagtttatgtaatattttaaatcctttggtgtcacttcaacaatgtccacagaatttgcaccaggagtaaattccatctcaaaaaatcactttcttttctcacttataagaagtatctcctcatcccttcaaattttatctaagattacagcaatttagtcacatctttaggtgccacttctaattttagttctcttgctatttctataacatctgcagtgacttccctcactgaagtcttgaatcactcaaagtcatccatgaagattggaatcaacttccaaacttctatcattattgatattctggcctcctcttttgactcataaatgttcttaatggcaccaacaatgatgaatcttttttttttttttccttgagacagagtttcactcttgtcgcccaggctggagtgcaatggagccatcttggctcactgtaacctctgccttgtgggttcaagcaaatctccaggctcaaccttccgagtagctgggattacaggcgcccaccaccacacccagctaatttttgcatttttagtagagacagggttttgccatgttggccaagctggtctcaaactcatgacctcaggtgatccgcccatcttggcctggcaaagtgctgggattacaggtgtgagccactgcgcccagcctggtgaatgctttccagaaggtttccaattgacttttcccaaattcatcaaaagaatcactatccacggcagctatagccttacaaaatgtatttaagtaagacttaagtcaaaatgactccttgatccatgggaggcagaatggatgttgttttaacaggcatgaaaatattaacctccttgtagatctccatcagaactctaggatgatagctcttgggtgagtagtaatattttgaaaggaatattttgatcagagcaataggtctctacagtgggcttaaaatattcagtaaaccatgctgaaaacagatgtgctatcatccaggtgtggttccatttatagagcacaggcagagtagatttagcataattcttaagggctctagcattttcagaatcataaatgagcactggcttccatttaaattcaccagctgcattagcccctaacaagagagtcagactgtcctttgaagctttgaagtcaggcactgatttctcctctctagctatggaagtcttagatggcatctttttccaacagaaggctgtttcatctacagtgaaagtctgttgtttagtgtagtcacctccatcaattatcttagctagagcttctggataacttgctccagcttctccatcaacgcttgctgtttcaccttgtgttttatgttatagagaccacttccttatttaaacctcatggaacaacatctactagcttcaaatgtttcttctgcagcttccttacctctctcagccttcatagattcaaaaagagttagggccttgctctggattagactttggcttcaaggaatgttgtagatggtttgatcttctatccaaaccactcaaactttctccatgttagcaataagcctattttactttcttattattcatgtgttcactaaagtagcatttttaattttcttcaagaactattcctctacagtcacaacttagctaagtgtttggcccaggaggcctagctttcagcctgtctcagcttttggcatgccaccttcctcatcaagcttaataatttcaagcttctgatcaaaagtgagagatgtgcaattcttccattcacttgaacacttagaggccattgtaggggtatagatcagccctaattttaatattgttatatcctagtaaatagggaggcctgacgagagggagagagttgcgggaacagctggttggtggagcaatcagaacacacacaacatttatagactatgttcaccatcttatatgggtgcggttcgtgatgccgcacaacaattacaataacatcaaagatcacagattaccataagagatatcataggagtaaaaagtttgaagtattgtaagaattaccaaattgtgacacaaacacatgaaatgagcacatgctgttggaaaaatggtgctggcagatttgctagatgaaggtttgctgcaatccttcaatttgtaaaaaacacaaatatctgtgaaacacaataaagtgaagtgcaataaaatgagctatgcctgtacattttgcttgttgacttatttctttacaaatatggtttacctgctcatcatttttacacctgtgtgactgccattagtatacctgtttatatttgcaaaaatatgtatgttattattatctattttattatgtaaagtggcctatgaagtattctgttgtttttggtttcttaaacaaatccccttttataaatgcaaataaatgtgttatgaaaaatttttttataattattttttccagaattatattttcaaggttttggtcttttgggattctgatttttgaaattttagactttaggaattttgatcttttgggatttcagcatatgggattttggcattcagtgttgagtcctttgaaattattgcccaaaccccaaaagaaaatacccaaatggccaataagcatacaaaaaggtgctcaacatcattagccatcagcaaaatacaaattcaagctccaagaagatgctacacacctactaaggtattgttttaaataggatgataataactcatgttggcaaggaggtagagttctcatattctgtgaatggagtacaaattggtacaaccactttggaaaaattttttggcaatatccactaaagcttacacacatacacctgatgacccagaaattccactcctacatttgcacccaacagaaatgtctacatatgttcaccaagagacatgtacatgacagattagaacagtctgatcccaaaggcagaaacaaacctaaatgcatatcaacaatagaatggagagatatattggcttgtatagtcacacaatggaatgctatagaattatcaaaaaagaatgaactacgacctcacataacaacatgaatgactctcacagatgtggtgctgaatgaaggaatcagatgcaaaagcccataactatatgattaagaaaattctgaatcaggcaagattaatcacgatggtagaagtcagaatcatggttacctttaagagaaaatgcctagaaaagaaacatgatcaaggccgggcgcagtggctcacgcctgtaatcccagcactttgggaggcccaggcaggcagatcacgaggtcaggagatcaagaccatcctggctaacacggtgaaaccccatctctactaaaaatacaaaaaattagccaggcatggtggcacatgcctgtagtcccagctactcaggagtctgaggcaggagaatcgcttgaacccaggagatggaggttgcagtgaactgagattacaacactgcactccagcctgggcgacagagtgagactccatcttaaaaaaaaaaaaaaagaaagaaacatgatcaagcccccttaggagataagaatggtctgtatcttgatctgagtggtggtgacatagatgcatccactttgttaaaagtccattgagtttattaagatttgtgcactgcacaatatgcatattatacttcaataaatgttttttgaaaagaaagaaagatggcctgggaccagatttaccttattaatactctaaaggtgtctgttcattagttaagcataatctattctaattaatgctctattgcatatgaatgctgcctaaatggggtgaatgctaagggatactgaatgagattatatcagagtaaagctgggtaatttctcttacagaatatgattgggtttgggaataggtcatgcgatttacctaggagacatttacttttagtacatctcttcatttccatttcttgtgattttgagaagagtttacaaatggaaaatctgggttggtcttttcacttcatctgtttctgaaaacccctccttttaggatgtggcccctcgtccatgctggataacatcaagggcacctggcaaagcagacttttctccccatgagtctgtagaagtggcggctgccgtattgctccatgaaattagggaaaattctaataatcatcataaaataaaaacagcaataaatgtaaataagggaattaatatttcacagtacattcgagattgaatccatgaattttcaccatgcttttaaggtgggtgaccagtatcatgtctgatactttcatatggaggaaaaggggcagaaaaagaacaaagcactttctatcagcaactctattcctccccagtgagcaccttccagctttctttgtgcaagcccttctcactagtccacactctcataactgagcctttgttctggattttcttttaccagaaacaatctccctctttctgattatttcactgtaactcctggccacctctctgatttccccagcctaccatgccccagaagtcatcgttgaaagcccactttctttgaaagctccacaatcctgacacatttatccaccatgacacttttttttaaaaatattgggttgcaaattgacttatctcccaagaatcttcacattatgacactcagagcttgtcttcccaactcttctccctgtggtaagaagagagtatatagtatactctatatgggaggaaaactctttggagtgcaccttcgaagccacattcagttgaacaaaccagtcatttatacttgctcttacttaaactatggtatgtgtgataatgactgagtgtcatatttagatctaaggttttgagagcgacaagaaacattcagactacagaggatagggattgaagttttgccactctttgtctccctattcaccagtataacttcctgctgagctccagttcagagcttcccaacaggtggggcttaatccccagccaattctgaagatttagctcagggccagctgctgcccccaatcccctctctgacagctcttgggatcccaggccagggggaggtggagagtaaccagaaagacagcaattgccatgctctcatcagggccttgccctgctagcaagctagctctttccccaccaccttcctcagtgatgccccagtgaagccttctctggcttctctttggcattttgtcctttaaagtcattctgctagttgatcagagcactgatccacattccccatgaaagcaaatagcagagagcagagaaactgaattagggctgctctcaactctgtagagaatggaatttttaaaacatctagtaagttaaatagttataagttttcttttgtcgaacaaaaaacttgaaatttccttttgtgtatgtgtacatgtcattttctaagttaaaattgtattcccatggtaaaatatccaagcaaatatgagtatgccgagaaaaataaaaaacaccctttatccgctacccttccctccaccctgaccccatttccacctcttccccaaagcaacgactcccaatattttggtgttcacccttccaattctctctttctctcaaaatatacactgataagtactcaaatccatttctcttcttattctatttatattaatggaatcatactatacacctatacactgtgactcttttttcacttaacaatattttgtaaatcctacattggtctacttcattcttattaatgactatatactagtatatagcctgaatgaaccataatcacttcctattttacattaagtgtgttttcatatgctacaggctacattgtgtcccctccctcacaattcacatgttgagtcctaacccctccaaacctcagaatgtggccttatttggatacgtagtctttaaagaggtaatcaaggttaaataagtcattggggtgaaccctaatccatatgaccaatatccttgtaagtagaggagactcagacacagaaacacacagaggaaagtccatgtgaagacagagacagatgtcagccatctacaagccaaggagagagacctcagaatgaaaccaactctgccaacaccttattcttggacttctagcctccagaactgtgaggaaataaagttctggggcttacgccacccaatctgtcatcacagaagccctagcaaactagtaccccagtgttttacacttacatagaccactttggtgaacagctttgcacagccttgcacatacatctttgtgcacacgtgtgaatatttcactaggcaatgttactagaagaggaatctcaaaacatatcattaacttttaatttggacagagatcataaaactacctttcaaaaaggcctcattagtattattttgttcatatttaacaatgctggacacataagtcctttccatctttaccaatgataggtaatacgcggtatttcattattttacctgatgactaatgaaatgaggctcagaattcttcagttgattgaccattattgtatttctagtgtgaatgaactatttgtttcctgtgtatattattctgacggtttcttgataatttgttattaattaataggcacactttatagatttgaaaattaatcatttgtctattacataactatttccttccagtttgttacatgatttttaaattttatttatggtatcacacagaggctttttgttttgttgagttttgtatcttgcttattaaggtcttctcttcctcaggttatggtttaagaaaaaaatgcctgtatttttttctgatagttctttgggtttattttcaatgtttaacattttaagccatctggaatctacttacatacatggtatcaagtgggagtctagctttattgtcttctgaatagtgagtcaatttatcccaataaatcccaaaccatttgttgaatagacatacttttctatttattttaaatacttgttttttatttttattttgttgtgtagagctggaatttgctcctagtagagttatatctttatttcaattaagcttttaaaaaaaatttaaacaccaatagaaggtgtttaaatagaaggaagagagatttgggatgacatcaaagtctcttttcaatcatacttcatttttttcaattttatcctcaataaataactacattttagaaaggcatccaatgtattacgaaaaatgtattttataaatgcagtgttttatgcaagctggaagttagacaatagcgtcgcaaatagtgaagactcacgcctccaatattttttaagctacagaatagaacacattccttcatagtctccctgcacaatcttcatcacaccccactttacccattgtcttttggcttctttaaaaggcacatcaaaagtcctgcatttactctaagattgccttttatcacacaaaagtgggaaagcccaaagagaaaactaagctaagtaacccttcggcaggcatcattgagtatctagtggcgacgctaagagctcccacttaccgtaagcctccctgttcccactgctcagtgtgtgagggaactaacaataagtaagacacaaaggccttacaggctgtttgtgtatcaatctactaatgtaggtttgttatttttttatcagattctgttcaatgtgttggcaatgcctgtgtaaagccagacagcacttaattgcaaataattctggagcttcttggcaatgtaggactagtcaaaatgagagaaaaacaagcatacttatatgatgaataatactaagacccagggagcatttagaagatggaaaaaaagagtgggttaattttgaaccattttcaatttccataccagtcattacccacattagtggatttattatgttctttttctttccctaataagagccttgtaaaattcagcacatcatcaggcaacctaataattaccgtatttaggggcaaatgttagatcccagacagagaccgtttattatgttccattccctaaagtttgactgaatggccatttttctgcttcctcattaataatcataataagtaaactgcaagaaagaagaggaaagaactcagcaaatcaaaacttagaaaactagaaaggtcagagccataaagcattctgccattactcaccgactgtgtgagatattagaattatgattcttaattttcatgaccaaaattctaaagggaaagaaaatggcaccaaatgaatccattcaattaatgtggaagcccagatggaaaaaaaataagcaaaataaataattccctgaatctgccttttatctactcaaaccccaattgtaggcctcccctgagcctaaggatcacaaaacaaaagcttaatgtgaccagtaatttaagtgtttgctaaccttttgtcctttaagctctgtagaacaaccagaaaaacattacgtgataaagttacattggttaatgcacactgagtaatagtatcaatcttccaatattcctgatccaagatttgagatacagaaacaactccaccccaaagatttttttagaaagctcttttgtttctttggattgctctcaaagattttcttgctgattttccaaaagcacattattcatttactaagcttaccagttgcttcatcacaaaaaatgttacagacacctaaactctagcacaatatgattctatgtcaaggaagtatttttgagtaccaaataattttttggttccccattgtttggctttcaatttgaaaatatcttctgcacagaggatcataaaagcttgctccggaagatttgttttgttttgttttgttttgttttttcctgcctttctattttcttagccaaaagtgaaaccgatagctttgttcccactatggtcttctttcttcctgctaaaatctgggcattttaaggaggtgtttaaagacaccttcttcaagtattccctgaggctaaagcaacaagcactcactctctgtttttgaaaacttataacagttggaaccttttgaacaaccacttagtgccaacgctgcccttgatcttctctttacagtacacggggtttacactttgtgagccagatgcaatccccgtggacctctgttggggaacacaggaagaattttcccctcatgtctgcagggagcattttccagccagaatgcataaaccattgagaatatctcccatggagtccgctgagaggaagataatccattaccctccagacatttggctggcttaggaaggactgggcagccccgcctccaaagatactaatgggaattacatttgaaaatctcccaaaagccagatcctgaaatacagttctctctccccacgggttttgcatttctcagaaagcaacataaggagagatagagaaccggaatgtaaatcatgacgtttaagaaaatatataaatcaaacgaatggataaatattttctatttacatagcctctctgaagagtcgcattagctagatcaagacaaacccccacgtcccagtttcataaacccgcaccacattggccagataaaaatcagcctctccaagtgactcccaactttaacacttcaaagtgaagcacagaattatttttattatcatcacagtatttgacagcaacgcagagagaaccaatgaaaaccaggacccgagttcatgtcttcatagaaccagaaagctgtgtgccgtgctgagcacacgcacttcattaaggaaagatgggagagaggccttcctaagcgctgatgttaaaaattgaaatccattctgtaaaagacagaccttgtgtattttttaaagcccagagccataatagctaaagggtagtaaaaaccgtatataagaacattatggtggttagattgttcctaagaactcttgatccaggatttggtatatatgtatataaacgcacaactcaaagctagcggaacttttcagattgtagggggtgggtagtggagaaacaagagtctaatagaaaaatgggcaaggattaactgcatgaaaacatgtagttcccagaaaaatgaaatctaaatggaatacaaatatatgaaaagatacttggccacagtcataattccagaaaatcaactcagaaaaaaaggaaagcttgtcacctaggaaactgaggagctagtttgatgacacacaagttaaggagcgaaataagatgtgtattctctgcagatggaagtgtaagttggttctgtgtttggagatatcttcggtgtaaatggactcagcttaacaatatttagcacaataaaaatgtatatactttttgacctggcaattttacttccagagatttacaaatgaatacacttgtactcatacacagagataaatgatgtacacaacagcaagtttttagtaacagaaaacaatttaagggcttaggactggccatgttaaatatggtacacccgttagtggaatacttggagcattgctaaacatgagggagaccaacagcaagcattgatatggaaagatcttccaactatactgtaaagagtatttttttaagtatgatagcattctcccctctgtgtaaataagaacaaaagaataaaagaaagaaagaaaaaagaaatatatatatataaatgtttatatgcttgtatatacatagaaaaattcaggaaggctacataagaaattgttgataatggttgcctctgtaaaaacagatatgtcagctaatggcacaggctagagagcccagaaataaacccacacatttacagtcaattgatttttgacaaaggtcccaagaacacacagtggggaaaggacagtctcttcaataaatggtgttggaaaagctggatattcacatgcagaagaatgaaattagccccttgtctcacatcatgtatgaaaaccaactcaaaatagctgaagacttaaatataagacctgaaactgtaaaactactaggagaaaacataagaggaaagctccacaacattggattgtgaaacagatttctttggatatgatcctgaaagcacaggcaacaaaaccaaaaatagacgaataggacagcatcaaactaaaaagcttctgcacctcaaaggaaacaataaaaaagtgaagagggccgggtgcggtggctcacgcctgtaatgccagcactttgggaggccgagatggcagatcacgagatcaggagattgagaccatcctggctaacacggtgaaacccatctctactaaaaatacaaaaaaattagcccggcgtagtggcaggtgcctgtagccccagctactcgggaggctggggcaggagaatggtgtgaacccgggaggcggagcttgcagtgagccgagatcgcgccactgcactccagcctgggcaacagaacaagactccgtctcaaaaaaaaaaaaaaaaaaaaaaaaaaaaagtgaagagacaacccacagagtgggagaaaatatttgcaaaccatacatctgttaaaggcttgatatctgaaatatataaggaaccaaaacaactcaatagcaaggaaacaaataatctgatttttttaaatggggaaaagttctgaacagacatttctcaaaagaaggcatacaaatggccaaaggcacatgaaaaaaatctcagcatcactaagcatgagggaaatgcaaattaaaactacaaggaggccgggcgcggtggctcacacctgtaatcccagcactttgggaggccgaggtgggcggatcaagaggtcaggagttcaagaacaccctgaccaacatggtgaaaccccatctctactaaaaacacaaaaattaaccaggcgtggtggcacatacctataatcccagctactcaggaggctgaggcaggagaatcatttgaacctgggaggcagaggttgcagtgagctgagatcgagccactgcactccagactaggtgacagagtgagactttgtctcaaaaaaaaaacaaacaaacaaacaaacaaacaaaaaacctaccatgaaatgttgcctcacacctattagtatagtacagcttttatcaaaaaggaaaaaaactggccaggcacagtgactcatgcctgtaatcccagcacttttggaggccgaggcaggaggatcacttgaggccaagagttcaacaccagcctggtcaacatagtgaaaccccatctctactaaaaatacaaaaattagccaggcatggtggtgggcgcctgtcatcccagctgcttgggaggctgaggtacgagaatcccttgaacccgagaggcggaggctgcagtgagctgaaatcacgccactacactccagcctaggtgacagagacagaccctgtgtcaaaaaaaaaaaaaaaaagagagagagcgaaagaaagaaaaagcaggtgttagcaaagatggagagaaaaggaaactcttatatactggtggtgggaatttaaatttgttattataaaaaatggtatggagattcctcagaaacctaaaaatggaactatcacatgattcattagtcccacttctgggtatatattcaaaagaactactaacgtcaatatgtcaggggaaaaaaatgttcacttttaggttcattgcagcattactcacaatggccaaaatatggaatcaaactaaatgtccattaacaaatgaatggataaagaaaataaggtatatatacacaatggaatactattcagccttaaaagagagtgaaaatcctgtcatttgcaacatggatgaatctggagagcattatgccaaatgaaataagccagacatagaaagacaaatactgcatgatctcacttatatgtagaatctacaaaagttgaactcatagaagtcgagagtagaatgatggttaccagagactgagggaagggggtgaggagggagggaacagtaatttctgatcaaaagatagaaagtttcagatagacaggaggaataggctctgagagctactgcacagcagggtgattataatccataatagtgtactgtgtaataactaagatagtacatttcaaatgtctcaccataaaaattgataggtaattgaggtgatggatatgttaattagcttgacttaatcatttcacattatgtacatatatcaaaacatcacactctgtcccataaatatatacaattatgatttgtcaatcaaagtaatattcattttttttaaattttaaaccatagttgcctctggggagtggtagtgctatatgtatttgattatatgcctttttacaaagtttgaaatattttatcagatataatatggaattctttttgtggtcaagaaaaagtgcagagagatgggaaaacggaactgtgaagattaccacagttgactggatggaaaacaaggaagaggcctcggtggacagctaagacatggacatgctgttctggaacgtgtcatcggaggacagctcagtcatgtgtatacagctgtccctctggtgtttggttccaggatgtcctgcagatacccaaatccctggatgcccaagttcctgatacgaaatggcataatatttgcatatagcctatggaatcctccaatatattttaaatcatctctatatgacttatattattctatatcacttatctaatacaatgtaaaggctatataaatagttgttataccaaaaaaacctagatattatattgtaaaatactaagccactgctttgagttacttttcattgagatttcttgcacgtgatgtgcactccacatgataataaacatgtttggttttctcttgttaaaaaaaaagttatactgtactgttgagggaataatgaccaaaaaagtctgtacatattcagtacagatgcagttttctttccaaatgttttcaatccatggttggttgagtccacaaatgtgaaacacacagatacagagggctgactgtacttcactcttagaaagtctttgttttttggttttgttttttgctttttgttttgagacagagtcttgctctgtcacccacgctggagtgcagtggcgcagtctcagctcattgcaacctctgccttctgggtccaatagattctcctgcctcagcctcccgagtagctaggattacaggcaggtactaacatgcccggctaatttttgtatttttagtagagatggggtttcaccatgttagccaggctggtctcgaactcctggcctcatgtgatccaccagcctcagcctcccaaagtgctgggattacaggcatgagctaccacacccagcctaaaagtcttttataggagagattttgctagacctcacttttaattgatgccgtgtacatacagaaatgattttcatgttttaaaactctatttaaagtagtaagtacatggattcaaacaaagtaaatgttttgccagctttgtttctcaaagaaagtattcgtttcaacagatatttttatcaaataaatgcttcctttgcaggcagttagtatttccatgagctttaacaaatactttcaaatgctcactgcctttaattaatcaagtagttctgtgaatgcctgctatatgcttagtttgcaagtgtatagaatgagtgttaaaagaggaagaggaatgcacaactaatagaccgtggtatttcaggttttcattgataaataagcatttgaaatcctggagtaatgttttccgttgaaaacatggtgccaatgttatatcaaaaaataactccattgttcaaacatcaatagtgggcaaacttgcccatataacctgcatgactgtattttgaaatattaaaatggaaataaaagggctcaagaacaataaagctatcacaaaactctgaaagaggcatggcgcacctcatatttgttcatgaaatcaacagggagagaaatgaaaagtgaccatagggaagtgataaaagagctttaagaccctttcatggcttccagagctccttgattgcatgaaaaggctcacagagaaaccagctggtatataggatggcagggttatctggctgcagacctataacctcaccaatggtcagggttgattgcaagcctctgtttttttcctcatccctcaagctttgaacttccaagttggctcaggattgctttccattgtggctataagtagggtggctctttggccaggtttaccagagatgaccatggattactcctgtagtttctgaagtaaatactaatagtacctacttccacgtcccaaagtgccctggtttggatgatacattatatggttaccctaatagaagtagattaatgtagggagtgagaagaaatggccccttggattatgactggtatatggaaaacctttttgattacctccttaaactactaagcaattggtgggatattaagaaaattaaattattaatttaattttgatttaattatattgaagaaaattgactgaatttctctccagataccactccacatggctcgaaaaaagaaaaactcattttcctattatgtacctgaagtctgtttcctatagcacagagaacacaaagtagtattttttaagtcctgccattttctctgtgtagtagacaaacttctaaggcagccctcagtgatgccaacctcctggtgtttgtgaccttatagaatcccctcctgttgagtgttggctggaccaagtgacttgtcttacctaaccaggtgaatatggcaaaactgatgggggagagtgtcgcttcatgattaggttataaaagatggttttcattttgacagcacgcttactgtcttactgggttagatgaaacaaactgttgagatacctcaacccaatattcagcaagaaactgaagccctgaattcatcaacattaaaagataagaattctgccaacaactacataaataagctcagaagcagactcttccccatttgagccttcagatgagatcccatccctggctgatacattgattgcagggatgtgagaagaccttgaagccaagacctaactaagctgtgcctagattcctccccaacagaaactgtgaaataataagtgtgttgttttaggctgctacatttttgagtaatttgttacctacatagataactattagatcccgcctgatgctggaaaaaccacttaactcctctggcctcaattttctcttttgcatggtgtatagtaggcctgaatcaatgtttgtgaccagaataagtgtgaaataaaggggttagactagataatgtctaagacccccttaataaaaagtctggacaatgttttgctcacaaagtgataactcttgacagattgtgaatacatgttattctttgtagctacctttttttctttgtagctacttttttctattcttattttaaattgcctaaatttcttatttgcaaaaagaaaaaaacacctcaaaacagaggcctcttgtttgaaactttttctcaccaactttttttttggttttaaaactatcctggcctgtgggtgtctgtgtagcctggctgaggatctccgggtaccccaactctgcctttgatgtaaatggtcatacgccctgcatccttcaagtagataaatgtgtattttatgaacactgtctcacctagctgcagagcaacacctgctttcatttaaaggccttttcattgcaagacaaatgcagacagggcagggtgttggacacatttcattttgcctctctctaaattcactggtggaagctttttataaatctcacaggtcatttccaagaatctctggtactaaaacaccacaggtctgtgctaaccctactttcctgaggattaaacttagcttcattgtgggtaaaaatggtgttttacaggctggaaacaacgtctttgatgctaaaatcattcccattgtgaactctgaaaaattttttggaggtgacactttaaaatcttcagcaaaacttttctttaacatttaaaattatttcattttattattcattttattttattttattatttttgttttttctgagaaggagtttcactcggtagcccaggctggaatgcagtgatatgatctcagctcaccgcaacttccacctcccgggttcaagcaattctcctgcctcagcctcccatgtatcttggattatatatatatatatatatatatatatgtatgcacacacacatacatatatacatatatatacacacacatatatatacatatatacacacatatatatacatatatacacgcacacatatatatacatatatatacacacacacacacacacatatatatatatatatatatatatatatacaccatggaatactactcagccataaaaaagaataaaataatatcttctgcacaacttggatggagctgaggccattatcctaagtgaattagctcaggaacagaaaaccaaatactgcatgttctcacttataagtgggagctaagctatgaagacatgaaggcacacagagtgatagagtggacatggaagactcagaagtggggagggtgggagagatagtgagggataaaaaaactacatattgggtacaaggtacactactcaagtgaccgatgcactaaaacctcagactttaccattatactattcatccatgaaaccaaaaccacttgtacttcaagagctattgaaacaaaaaatgtatgtataaataataatattacttcaaaaagaaaacaaaaccagaaaataactagtgctatttttaaaaacgtgtgcattgttggtgggaatataaaatgcaacagcaactatgaaaaatagtagggaagttcttcaaaaaatgttaaaaagatgtatcacatgagctcacaattccacttttgagtagctatccaaaagaactgaaagaaggatctcaaagaagtatttgtgcacccatgttcataccagcgttattcacaatagccaagaggtagaagcaacccaaatatctatcaatggatgaatggataaacaaaatgtggtctatacgcccaatagaatattcaaccttaaaagctacgacatggatgaacctcaagaacgttatgctaagagaaataagccagtcacaaaaagacaaagactttctgatcctgcttatataggtacttagagtagccacattcatagagataggaagtagaatggtggttgccaggggctggtgggagggaagaatggggggttatttaatggaaacagagtttcagttttgcaaagtgtaaggagttataaagatggatggtggtgatggttgcataaccatgtggacgtatttaacaccactgaactgtacccttagaaatggttaatcttggccgggcgcagtggctcacacctgtaatcccagcactttgggagaccgaggcgggagtatcacgaggtcaggagttcgagaccagcctggccaacatggtgaaatcccatctctacaaaaatacaaaaattagctgggcatggtggcggccacctgtaatcccagctacttgggaggctgaggcaggagaattgcttgaacctgggaggcagaagttgcagtgagccaagatcatgctactgcactccagcctgaacaacagagcaagactctgtctcggaaaaaaaaaaaaaaaaaaagaaatggttagtctcgtaaattttacattctgtgtattttaccacaactacaaatttaaaaatgtgtgtgtttatgtgtgtgtgtgtatatatatatatacatatatatatacgtatatatacatatatatatacatgcatatatatatacatatatatacatatatatacatatatacatatatatacatatatatatacatatatatataaataaatggtgcaaaaaaaaagaaatgttttcctttttgggtagaatagcagggaaaacaatatgaaatgtatgtacatgaaagagatcatatatgtatagatcataacttcatgtttctagcatcattaatatctctttattatcttttatctcttcagagaattttaaagattcctcttacctccccactgcaagatcctgtttgtcccccaggagtgggttaatatgttagccatgcactgttctcagcagaagtcattgaagtggcaattgcaaaggtcttatagataagtgtatctggtgatgatgcattcattttaccatcctaaccagtgagaagcagcagatcagacatattttggttatgaacaatgccagaagtttctggtcaatgaaaagaaattgctaaggaagacagcttattagtgccaagaactgtgatttctgtaagctggcttgttttgagaccaatttgggtataattttaaacccaagcacaattttgtatgatgttttagaaaagtgtggaattttttattttaagaaatcttagaaatcagtttaatgtaattacctcattatctggatcgagttaacccaaatcatcagtgagtaagtgaattatacaaggtcagacagctagcagaagatacaacactctggcttattaaaaagcctattaaaaaggtgagtgaatggcattggatagtttataaagaattcatgagaaaacaagattgaaagattgctaaaacatgaagtctctatattgatagtttttgttattacttaaaaatatgtttgtggaaaagtacattagaaagctgattatataatagtggaagaagatattctagtacctataactgttagcgatttcagaggggacctccctcaatgcttttctaaaatctgcccacttctaagaaaatatgaaatctcatagtatcaaaaacttagactcacagtcactttattaccacagtctcagaagatttttcattaacttctactaatacggggctggactaaaaactgaagagcagtaaagcccagagggtttgctagcaacacaaaacacacctgccaggccaaaaccaaacaaggcagaaacaggctttattcctccctgatggtctcttctggtctctctcttggctcagaggctgagactcagcaaaacactagaaagctaaaattccaataacaaaaaagtgaaatcgacagtaaaatggttaagagcaaaagtgatgctttaggacaaaaatcaaggaggtgggtaaatatcttggaggatcaggagagaggcaaaaacgatgaagccagtaagaggtggtagctgtggaagcagaaaacaagattcgacctctaaagctctgggactctgagaaaaaacacaaggcagctgcagcagaactgataccaaagaggtgactgaaaagaagctaattaatacctgtcaacttaccaattttaatagttagaattatttagggtttcgatgttttaaaaataaagcaatgaaaagaaacatgaaataaatcaaaacaggaaacataaaaataagccaaacacatcaaccataacaaaaaatacaaatgccttagaaaaatctcccttttaaaaaatgttgtttataatgaacatgtaataattgtacatgtttatggggtacaggggggtgtttcaatacttgtgtatgctgtataatgatcaaatcagggtagctggtatgtccattgcctcaaaccttaccatttctttatgctgataacattcaagatccgcttttctagctatcttgaaacatacaattcattcatatcagctatagttaccttaaaaaatccaaaatccctttttttttttttttttcttgagacggagtttcgctctgtcgcccaggctggagtgcag

SEQ ID NO: 596 - DNA, 51489 bp, Homo sapiens
ttgaaaaagtctgtcctagatacagtgttatttgaaatttgtgtctgaaatttctgccacttaattgtaccagaagatctagaaggttcaaggatttctggaaagtgttcgtacactggcagctctagcacttctgaagaagtcatgtggtgcagctccttgtctagaacagatccacttaaaggctggagagagagtgcgttgaatcctggagaggtttctttgtgtgtgtttttgttttgacagaaattttgcttttgatttatatatgttaatttcctggtgggtcttttatttaagaatacagatgtttattgtttccatgacatactgagtaaatagaacacaagatcagctttgatttcttatttaagacaagtcttgtgaaagtttgttcatttaaacattttcttttattaaagaattctttaattcctgtttgttttatatagtttaaatatttgagattagtttaaacttcagatttacttaataaatatccatttactttggtactaaaaaataaattgaaaacattgattttctttcaaatgacatatttattctgaagattaaagttaagagagtagagacctaggtttttgtcttaattttgttatcatctacctgtgagatctcatccaagccattcatcattctgagaaaattaaatttctaaaacatcattttattgaaatattatataataactaatagctataatttataatattgaatattacatagtaatataatgctatattatgtattatataataataatagtagtaaatacaaaaataacatttcagtcaataatgaattccatatacaatggtgtcccataagaaataataccatatttttaatgtactttacatgtttggatgcgcaaatacttaacatgggtattatgattgcctacagtattcagtacaataacatgctgaacaggtttgtagcctagaagcagtaggctataccgcatagctgaaatgtacagtagactatctcaactatgtttgtgtcagtatacgctatgatgttcatgcaatgatgaaataatttaatgatgtatttctcagaatttgtcctcatagttaagtggcacatgactgtagtattattactagcaaatagtaaaatagtacatagcaaaatttaataaccactgaaacaaacaaaaacttttgcattattacagagcaacgtgtgattgattcaatagtaagtaatgcttatcacagtcataatatagagaaaaagtacgtaaaataaatgaaaaagaaagatgtaaaatatgccttttttggtctgtatattaaacttcaagatgtgtggaaagtagttaaataattatgcaaaatgaagaatcattttaataaactgctactgtgagaatgtgtaagatttttatgtagagcttctctgataccaatgacctgagatctgaccagatagtccagaattaagtggtaataaaggctgtggcatgtgtatttttcatcgatgttaacacaatgaggctgaagaactgttcatccatgagaaacaaacttcaaaattttcccagtaggcatgacttatgcagtgtcaacttcataatgtgcagccctcctaaattttaaaaatgtcatttaagctactcagaaagcgtccattaaaagcagagttagggctgggtgcggtggctcatgcttgtaatcccagcactttgggaggccgaggtgggtggatcacaacatcaggagttcaagaccagcctggccaagatggtgaaaccccttctccactaaaaatacaaaaattaactgggcgtggtggagggcgcctataatcccagttacttgggaggctgaggcaggagaattgcttgaacccaggaggtggaggttgcagtgagccgagatcatgccactgcactgcagcctgggcaatagagcaagactctatcttaaaataaaataaaataaaataaaataaaataaaataaaataaaataaaataaataaaataaaataaaagcagagttaaagcttcctctgtcctactgtgtttttcctccaagttgttcttctttgtgtattcaccaatctcataaagagaaactacgtacatacaacagacatgtgtgtgcacagtcatctgtatatgaatgcactttgtgaataaggatgtatcaccaatcagaaactaatgaatggcgatttttctttaacactttttttttttttgagacagagtctcgctctgttgcccaggctagagtgcagtggcgcaatctcggctcacactgccagcttcccctcctgggttcacgccattctcctgcctcagcctcctgagtagctgggactacaggtgcccaccaccatgcctggctaattttttgtatttttagtagagatggggttccaccgtgttagccaggatgatctcgatctcctgacctcgtgatccgcccaccttggcctcccaaagtgctgggattacaggcgtgagccaccgcgcccagccttctttaacatttttgtttttgagttctcatgtgataaaagattttaaatgggttagtttgacaatttgtatgatactgaagaaattgtgatgaggaaaatgagagaaaagggaacccataatcaatggacatctctttatgttccaggtattttgcaaagtactttataatcagttattggaattgtttcatatggttattattaatattcatatattagggatgagaaaacaatgctcagagaagtcacataacttgtgtaaggtaatccacaagtgactacttttgcaagatttaaaaatatttctgataaattcctcaagtttttattatgtatcctcacaaagcctcaatacatcatggagcttcaaagcaattttcgtcgtttgttgctgtcttccattatttaattatatttaactattaatatacactagaaagactactatgtaaccatatgtatcatctagaaatgagtccacctgcaaagacaaaacaaacaacaaggcaaaacaaaacaagctaaccttacaaacaaagacgaaacacaaagtttgataatgccccgctgtcataaatagcaagatgtcaggatgctaaaccagtagcaatcagaattggtgctctacctgtttgacagtccactaccgctcactcattctcttctcttgctgctgtacggagacttgaattttcaggccttttggtaagtcatcagcaatcacttttctacagatgaacaaaagtgctgatttgaaagatattctagatattcagtctagaaagacttggataagagacttttctctcttttttagtggagacaattacattttgattaactgtatttagaacaattagatctcatgtatcaacatattcaaatagtaagatctttaaaataagatcatgcaagtagataggatctttccagcttgcagaaatcatgaatatcagccagactggatacacatttaataaaatatattatttgaggtttaaatcccatgtctggtattttacttgcttcactgaaaaccaagctggttaagcttttaacgttaacacagccacttgcaaatcattatttcttctaggttttgcaataactatattccacctttgttttttgttgtatctttaccctcaaatatatgcacaaataaatttaagacctttataagaatacttataatatttagcttccatgtgactatctaattatcatctagtagctgtaaggaacagcatgtaagatctatttctctcttcttcccatagctattagttgacagtctagtgaatgaatacagatatttggtaagacgttgtcttctctcttcaagtttgggcatgcctttagtatctagtccttgaacctttgtatatgcattcactgaaatggtgtcggttgcgaaagccagccttcactatattacgctcaagataagattaaatggcacctttaaactggcaagagggattggggacaggacattttcaccatcttccaagtcatcatgcatactacaattttcttgcctctgattgcatacttgcacttgtgacatggaacttgttcctacagaatttttgtagaagtcacttttctttccaatttcataatctcttctggaatattgtcccaatctattaatgcttgatctaaaggtgacaattttatgtcaatgctgttcttggtttttatatttcctacaaaacgaggctggcatacaatagtattcaccctgaattctggaatatttttttctttttgtttcttagccagcattgcttttgctttcatctgattgcaccattgctgaaaagtttaatttctctttcaggatctgcttttgtcatttgaaacttgatgtttatttaccttgactgtctcctatttctgaccatcatggcggcttatagagctcaccatgtttttctacagcataaagaagatggaaggtctacagaggtcccctaccgaggcatttgcagggctctgcaagcatcctttggccaggacactgtcaaggtggcagtgaggaatctcactcagacatggtctgaggacatcctgctcatctggctgtttcctggcccagctccattccacaacaataccatcctaggatttgtttcgtggcaaaaagattgcatgggggatatatatgaatgtgttaatttattctgcttatgaaacatacagaactgcattttgtaagtttggggctaacaccattttcctcctcctcatatgtcagcagatacatctttatttttaataaggcaagaggggcaggtgcagtggctcatgcctttaatcccagcactttgagaggccgaggcaggcggatcatgaggtcaggaatttgagatcagcctggccaacttagtgaaaccccgtctctgctaaaaatacaaaaaaaaattacctggacatggtggcgggcacctgtaatcccagctattcaggaagttgaagcaaggagaatagcttgaacctgggaggcggaggtcgcattgagccatgatcatgccactgcactccagcctgggcgacggtatgggactccttctcaaaaaaaaaaaagaaaaaaggaagaaaagaggaatggcaccaaatcacaataggcttgagaaggatcaagaattgtgggaaattcttgattgtgagatgcaaatagtctcacctaaacacaagaagatctgttatcacctatgcaaaccctcgcaggcagtaaaatgcgcctgtagcagcaaggaattccagattttatcatgttttcacaattaaggacagttacttcacaattaaggacagttacagctgagtgcacagtatgtgggcatgagccagataaaagtatgtcattaagtgttctagttagattgggtatttgcctgtttgaataatttatgaatttcttaagagagctagttgtggacagatattttacttcatgcttcattttctaatgcttttctctgtattgtgagactgagtgccttctgcctatataaaaagttttagcagagcaattagaagtattattttgcaatgggtgatgaagaccagacagtaacagttgcagttttcagggttgcttgtaagaggggagactatttacatgctacatacactgactaataagctgggaatttatctaggcacctgtattgccccaattaaacgtgtgaatcagtttactttcacatgaagtgagtaagaaaaagcccattttattttcaccctgcaattgagtcttttgagaaaaacttagcagaatcctctaatttgatttattatgttcagatatgtatttagctatattaaaaatactctgatacacaatttataatatttgtttcttttttggtacggggttgttctgtaggagagtgcaattaacataattgtattagaaattgtggctactgaaaaccaaaatgaagagttgcctgcgttacgcttctctgcctagctgcccgtcaatgggaacagcctcctattgtcttggtaacatgataattattggagtggcttggtcatgaggtgataccctctctatcacctcctgtcccagtgactcagttgggtcagcgtgtgtagccgacatcagtgggaccagagaccttttcttgctttaatttttatttgtttgttttagagctttgtgtcattgtaattagaaatcctgaaagtcaaagttggctctctgcaagcgatagacaagaggagaggaaaattttgggagctgttggcccctgagcccctgatatgggcagtgcaggttggaggctgagcatgaagccaggcgctgggagccaggaggcccagagtgctaggcactgaggcacacggcacccacacaggcactgggaccacagcaggtctccccacagctcagctgttgaccgttctctggatagtaaatgcgggagacttataaaaacaggaacatagcaaaaggtcagagtgtttcctctcctttgaactatacctgcttaaggaaatatgaattactagaagacaagaataaacagaggggcaacagaaagggaaaaatcatgacagagaatgaaagaaactaagcatgatgtctctgggcaaagaatgtgcagcacctgcagcggcacccccagcaataccagggaagtaccaccgcagggcttctccgggggtgacggttctggtgtcgttcaggcaggaggtggggagaagaggcccagctgggtgaaggcccagccatgccttgcccctacttaatactgaactcaatgtttctgtcccagaatcagccctcaaaatgccacgtcttcacagcagtgggggaacttgggagagcaatgccctaaagcttagggaatcactggactggaagctatacaggccttcacattaggtggggaggatggtctggaactgctgatgcaggctgtgggccatgtaggtaacagcattaaggctttaagaagcttagtttgagatgccaggacttcttcctaacttggacagggatttggggaggcttgagatccacaggtcacactaaagagagctagatggaatgtgtgtccattgtgcccattgttaattgtaatgtgttgacttgtttgtccattttggttggtaaatcctatgactaagaattttatcttagattttatctaagatttttattttccttggcctaagattgccttttattgtatatttttttctggtttctactgaagaactctcttaaaatgaactttaattaaaaaaaaaaagaaaccacaaacatcagctgttatctgaatgtgttatagatcaaattgcaatttctattgaggagacagagttaagtgaaagggtaattaacttcagcatattcatgatgttgtaaaaaagggaaatctgtgaagtaggagaaaattgattttagcagactacacacatcctggtgttcctgatctctgttttcctcaaaaaagtctgggaatggattcagcatccttgttcaattccattgcttcttggggaagattctattcaatgacttttcaacaccggtctttcctttcggactcctgggacacataaggtacttagctgtcatgacatcaggttaaggttgaggcttgggatgagggatggggtttattgcaacagcaggaccctttacatcactgaagaactatagagaatatttaaaaatcctttgccccatgaggatgttcatctttcagagatggtcagagtaaagcataagctcttgacctgtcactcccacatctcttcccttcacctctcttcccttcacctctcatcaaagaatgaattggggactaagtgaaattctaggtctgctccagttcctatctagaatcagcatcatattatcagctttatcccaccttggattttaaataaaaaatatggggaatccagtagcactatggtgccactgcttcattattcaaggctttgacccctcaaccataccgggtattccaatagatagaaagttacaatgcttttgcaagggtacccatgtccactggacttgaacacataattgttactcacttccttccctaatatcagagattgaatatgaattctaattaattggctaaagcaaacgtaatataagtattaattcagccaataaacaactattgtcattttatggccttggcattatgctagttgatgggggaaatctaacctaagcttttattttcagaagcttaatcctgaaccaaaagctccaatcaaatggaaaatatactgagtccagtagagatattgcaagacatcataatgtaataaaaagttagaaagttcattctttatttcactcgttaagactttaatactttgatggtaagtttttacctggtggtgtgttgcctaatttcccactgatctgtcctactatgccaatctgatccatataaagaagtatttaatgactgactttaatagaacacaaaatccctggtatgccaaatatctttgatttgttcctctcaaaaggaccgaagcctgcacaaagatgtgagccttgccttatacttctcctctaccatccatttcacttagcataatgttgagtatattgcagatgttcagtaaaaatatgcttaagaatttattgatagggaaatgtccttagatttctgatattgatacttaactcaaacttgacaatgagtctttctcactgtggaaaaaatacaatcatatccaatgagactgctgggttttttcttactctaataatgtattactaagttccaatcaagctgttttaacataaaggtctgtttggggttaaaaataattttggaatgtggtttcatactgctcattacagagtacttcttacagtgacattatttggctttgaaaatctccgtaagtacttcctacttccagtgagttgttacagaaaaaaaatccagtaagcacatttcaagcaatatattctctcctttgctcctgccaaacctcctgtaaatagaaatctcagaatatttctgcctatttcctgtgcccgtgccttccactagcaaaattctattgcaagagtagattaaactatttttcttcagtgttggcatttgaggttgagtcagcataattattctgaatttccccccaaataactttcccttttaaaaacaagctcaaagcatttaatctcttctagtcaatgtgaacgatatcctgtacactggcatgctaatctgctccagggccagagtgggagcatcctggcacagctttgacctccgctggagtcagccctctgtgaccaggaggatttgcactacagacttcctctgaagtcttttcctgtgtgtagatgtggacaatagctgatgtcactgcactcataaaagaccctggcaatatcggcaaggctggtgtcaggccattggccctgtcctccatggagattccttggccagtaaggaaaggtctatgctttttctttgtgctctggtttcacgagcaagaatcaaactcacggattcccattgccctttatatgactcaccccagaataagtctcacctaatggtttagtaaaaacaagaccatttcacccacacatctctgaacagagcagacctacttccatgaagtactagcctattatttcacattcatccgctgaaagttaaattttatatcccaccttctcaatcattcttctgtaaaactcctcagtgagaaagtgaagaaaaaaaagatttaaactgcaaattaccctgctattttcaattgtaatccacacaggaacctaactagataatgttttctccattttaactgatgagaaaaataagattcaaagtgataaattatctttaacagaagttagttaatgatttgtgtaatttagataaaaactatatattgtcttttgtgaaagcttggaatctctcctacactcctcttcctagatgggatagcacatgatttgtggagcagcagactggaagagaagaaggagaatgaggaagagccatagatagggatgacttagaaaagaaatggccaaattctactttattcatttttttcaaaatagtttgaattcgtgacatgaagctgtgttattttcagaaaaaaatggtacgacattttcatataatggaaaaggcaaataaaaatgtttggccacaaagataacagtaaaattttgaaataattgtttgtggggtagaaatttacaatcactaaaaacaaacaaaactaacaaaaaccacaaatagaacatataggagaaaaaggaactaggatgaatgaaaactcaaataatcaaataattaaaaagtgtcagttttaagttataataaaaatttaagtgagataaagtataatcaaaatataggagtgagagaaaaagacaccaccaccaatattagcaaaatattaatggggactagaaagccaaaatttatttaacaccaaaaagcagtaagttgaaagcaaatatattaatcagtaaaattatttggtggtagttttagctgttatcatggaaataaataaaatgattgactttgtctgatctgttctattccttttataatttcttcttcctcataacacaataaaataatgcagaaaaagggttacaggatgtttcctacaggagaaatacttcttttctaacatggtctaaggtacggtggggcattttgagtggaatgaacttaggcaattgaatcaaatcttagggaaaattattctctttcttttgaaggactttgatttcatctttgcttgcctcttctctccataaaaaagatattctctgaatttagggtaaagaaatcagaattccatggggccgtagtgctgaaagtcaaaactgtgtgtgtgtgtgtgtgtgtgtgtgtgtgtgtgtgtgtgtgtgcgtgtatgtctgaggtttcagcctatgtcctttattgtgtggcacgttcttggtttactccttcagagccgcacttggcattgtgggctataggctgatacttaggggctgcatcatataaggttccttggcctccagttaagcatctacaggagactggaggaggaggaaagagagtttggagtatttatttcaccagcaacctccctgccagtaggaaacttagcaatgtcttctcacttctacaaaaagccacagctcttgaaaggtagttactgtttacagctggaactcttgcttcattctactaatgacctgttgcctttgcccttcagccatgaggcacgaagatttcttttgcagcttgtctatggatatttcatcatttcttattggtttcccatgaccttatccttaccttggtaaagatttccttcattgaaccctccctgacatctattgagtgtgacttatctttcctaccagaaccttgatacccttagtaatgagttgaattatcattcttttattagttaattcattggtgtaacacacaattgtcagtgaaagactatattgcagactctttactagaaaataaaaataagaagagtacaaataacaatagctaacatttattaagcatattccatgtgtcagatatttctctaagcatataataatatataacttaataaattatgtctgtaaccctatgtggtatgtctattagtcaggataatctaaggtatattacaatagaaaagtaagttccactgggcatggtggctcatgcctgcattcccagcactttaggagggtgaggtgggcagatcccttgaggtcaggagtttgagagcagcctggccaacatggtgaaactctgtgtctactaaaaatacaacaaaattagcaaggagtgatctcagctatgagggaggctgaggcaggaggatcgcttgaacccaggaggtggaggtagcagtgagctgagatcgctccactgcactccagcctgggcaacagagcaagattacatctcaaaaacataaataaataaataaataaataaataaataaataagttccaagtctcagacactttatcacaacaaagtttatttcttaggaacattataattagcttttaagcaaaggttctccaaacacagaggtgtgtacctcttgtacagcatacacacacgcaaattcgtacacacacagactcttacatcataagcatgagctgtacttttagtcaaatttttagtttatcttttaaaagtaaaggtgaaacatgaccaaataaattacagataattattttttaatcacaaggatttttctatacatactcggaaagaatagactcatagttgcaatgtatgcaatatacccacaagactgcatggcatagcgcctatgcttgaatttgtgtattaaaatatctgagttaattatcactgaccttaaggcaaatcttcaaaataaaaaaatgtagccatacctccaggtagcattggcattaatttaataatattctttcctcaccacattaggttgatttaagataggaaataaaatatagcctaaggcaaatacctaaagtcagtcttgtgaataatccaccctcagagctcataagacacaggagattgaacagggaacatactagaagtggacactgttaataaaagttttttaaaagggactctggctcaagtagactaaaatatagccatggaataggaattgaaaatgttcacacgaaaataatttgctcatctgaaacttctagatccaatgaaaataaatattaccagatttgagaaacaaaataaaataacagtaattctgaggaaaagcaattttgtctgtaatatttctggaagccattcaagtagctaaaggaattttacatatgtgctatgaaatggccactaatttacccattttactacttcataaaatgacattttaaaaagtaatcaatactgttaattagaattttgatgcatgacatcaaattccattgtttggaaaagtagttggaaaattcaccaaagaaattctagctgaaaaataataattccattttattttttgggataggtacagatgcagttcaatctcctttacgataagaaacggttaacatgtgcttttattttcagggttaagtgaggagttaagaacagtgacttttatctagagctactcaatatggattactttgtattattactaccagaaccactaccatcatcaccgtcatcatcatcattctcaccacctaatcatagtgtcagcaaaacatttcttagaaaacaagaaataaagcatcaccagtatcttacttcctatttggaaatggtgctgagtgagttgctgtaaatcatcatctttattaacaatacaaaaaaatagctacctcattttcttcagttcaaaaatcacatgtggccattgatcagtggagccttttagaatttggtatgaaggtaatttgttttgcaaactccaatggttccaagccactctgtcttgtccctggggtttcatccccctggactcgcttctcccctcagctttgcctcctaaatttctatccattctcagcatgcagattacatgcaatttctaggtatccctttcacacttcctaagggtcattcccctacacatgactataactgactatacttccttccaatccaatgtctaatattgtgcatttaaaatgtgtctatgtattagtttgccccaatatccttttgaaaaaatatccatactttaaaaagatgaaggggcggctgggtgccctggctcatgcctataatcccagcactttgggaggctgaggtgatagaattgcctgagctcagtcaggagtttgagatcagcccaggaaacattgtaaaaccttgtctctacaaaaaaaaaaaaaaaaaaaaaaaaaaatacaaaaattagcctggcatagtggcatgcacctgtgaccccagctacttgggaggctgatgtgggaagacctcctgagactgggagggaggcagagcttgcagtgagctgtgattgcgccactgcactctagcctgggtgacagtgagaccctttctcaaaaataaaattaaaattaataaaaaaaaagatgaaggagatttctttttgcctctctatccctaacacataatttttaaacaagcacattaaatattccttgtggcaattttaataaatgtctaagtatgaacacaaggtgaagctcattcatactacgttctagttgaagacaaaatgttctttccttagataccacatatatttatttttttcacaaaaaaatagtttaaaacattaagaacataaagcaaatgctgttcccaaatgccacccctgcaccttaaattatttgtcatgtcctaatgcttacatttctgaagtctcttacatttacaccctcctctccatcttcactggacaaatgtggttaaagatctcataaacagttttctttcttccctaaaaagctttccaattagtctcctgcaagcttaaattttctcttttttaattccactgcctgagtgatttttcaaaataatgaaataattctgtcactcccagaatcaaagagatccagtaaaacctcattgactttggggtaaagtccaaagcccttagagtctcaataactttctaaccaaaacatcaacaattcttttcaataatccaaaacctggtcattggacaggcactgggcaaggcattttacatgtattttcttattaattgtcacaaccaccagatggagcagatttaattgttatcctggaaatgtctctttgccacaaatgtgtcattgaagatgtccaattattttccatttgtggagtaactcttttgattatttcatgaatgatatagaatttgaaagcttcttttttcaaaataattaatttcaactagtaatatgttgtctcttttatctaaagcttaaaaattttctcttcagtatttcattttatgatgtaaaagctttcctcataaatgtgtatatgtgtgtgtgtgttttgtgtgtgtgtagcgagagagatagagtatatatctctctaccatgcctgttttgtctcacgttgttatacttttgtaattttctttaatattcactggcaagttcatttattttcatatactggttagaatttcttcacatccaatctggctatccatgctgctagtatgtcatttcattgatgatcacctatgtgatggtagtagttgttgttgttgttattttgttgttgtttttattttgttgttgttgttgttgttgtttttcctaagaacactttctgaatctgtttatcatcttttagcattcctttcagacatctctgctctttttttttgaacaaatgtggcatcctctttaatcttgctgatgatacaaatttgtagggagtcttaattttttaattcatctgttcttcagctactccatttctgaaatgagtgttaatactgacttttgcatttggtgttttttgaaggaaaatcattccatttcaccggtccttgtggagggacagagcggggtgtcccatctcccatgctgttgacattggagctgggtaattctttgctgtggcggctgtccggtgcactgcaggatgtttagcagcatcgtcggcctcaaatcattagatgccggtagtggtcccccaaacatacatgcaaatatatctctagatgttgcctgcagttgagaacctgtattatttaaacaagtgcatcatcctctttaatcttgctgatgatacaaatttgtagtgagtcttaattttttaattcacctgttcttcagttactccatttctgaaataaaagttaatactgacttttgcaattaatgtttgttgactctccccagttcttaaccatagccttattaaggtaatttttgatgcgtttgaaagaaaaatatggatttaaaatgttaacacccatgttttgagggatccgaaggcagaaatgttctttctcaaccatacagtggcatggcataccagactcccagcccagaggtctgagacttggaggtcctttggccatgtttcataaaaagatggcatttcattttccatatatctgacataattggttttgaaactgacttccatccccccagcaatctccttcctttaaactgctgtatttgtgcgtataactactctgttttcattcgcaatgaagcacttttctttttggccaatatcataattgagataatgtacattagagattatgtgcttctcagtttaaatatattgactccttttgaaggcaaaagagcaatgtttcggttgactacagtatttctcaccactggagtttcagaagaccgtggatgtgagtggtagttggcagaaccaaatatcatatcacatgttgttttctttcagattcctgtggtactatgacatgttcgcatttaaactaattcattgaaagtcaattctcccaaaattgagtctgtttaaagatttagttccctgataactagtctccctaaaatctaacacttcagaacatgtgaacacccatcatgaaaaatgattgttttatagtttgtggatgtgcttttaatgttttattcacctttgaatcttttcaggaatttttaatcagttgattaaaaaaatatttttcttcataatatcatgttctcattttatatttatctggcagtgatgttttgagatattattttgtgtttatgatctagaattgttttattcaaattaaaaatcctaaaaataaaattaagtttaataaaactacggcctagacattgcatttattaatttctatcaacaaactatcaatgcctcatagaagcccctgaaaatttaacaaacacataaattgaaagtagttacaggaggaaaaaaataatagcaaaaggaggctataaattcagaaaagacataattctagttaaaattcttggatgtattatcttctgtttctaaaaaattattttataggtatgaactattcaaagaacattattttataatcaacaagggagcagtgaaatacttttttgcgatcccaatggaaggttattatgaagagattaaatcttcttttcaatggccacataatgccatgaacattgcatttagacctcttagtaccctctatacactgtgattcaggatatagtagtgcccaaagcatgagaacattatcataatttgccctcagggaacccaaagatggtccagcagtgaggaaagctatacaatcatctgcaaatggcaggtcagtcatcagagtgcaagacagtgaaacagagctgtgaaaaatataaggaacatcataggaaaattgaatcaaaagagacaaaatgacttcataaaagttatgaaaaatggctaaagcaattgtgaagtatagtaaggaagagggatttggtcacataaaaagaaggagatttcaggattgacagtgaaactataataatttagaccctactgaacaggcacagggatgatactacaggcaacgtgacatacaccagggtcccagatatatactgagtcatgagcacctgtgcaaattcttcacccaccttgaagcccactccttcaccatctcctttgctgaattcttctcctcttgttaagctctaaatgttagattttccaagcctttaacgcctggacctcttttgtgctttatctataattactccctggaccttacagtcctcttgctttagattccatttccatgctaatgcatttctcccttataactcagatcctgctgttcccctcagctccagactcccagatccagctacctactctagtctctttttgtatatctaataaagatataaaagacatccaaataaactccgatctccacctgcacactcttttcttacccccatattttcccttcacagttaatggtcatattattcatccacatgcacaagcccaaatccctagaaatttttccttagtatggaattataagcagtagctaaatttaatgagttagatcaatttacatcaacatgtaacgaacttaaataaataatttggattttaaaaacacagaaggatttgtataacatgctaccatagatatgatttttaaatgcacttttaataagataatatttatgaatattaatgcagttaaaaactacaattttgactttgttattttctccacagagagataattttgaggttggcttttaaggaaaactttatatgtatctatggttttacttcttaagaactgtctagatcaaatacggcaaaatgtaattatatatgcagctcacatggatgtaatgttactttctgttcttttatttagctttaactaatataaagcatgatgtaaatcaagattgaggagaaaagaaagggcactgtcacagcaatcccattctctgggtcttataaggtcttctaaggaatgaactttgtagaactaaaaggtttgctgagggcagacaaataagcccagaatggcatcacttgtttatttaatgggctgcaatgttataaatatttcattgagcaacactcagggaggaattgttctgaatgcacaataaaactcaaacaagaaatactatgcaggaaagcactgtgctaggcaagccaatctctaccacatatgagcaatatatcaagggtagctaaggcagtgggcagtatgctgcagaggaaaaaatgtgagctgtaaggctagataaatgtgcatatgtatcctttagtttgctcacgggtaagtcattttactgttttaaccctcaggacttgaatttattgggcacttgcaaattttacatcagtgtagtacctgcataatcacagatggtcaaaaaatgctaagatttgtttttgttgtttttgttaattttctgcaaacgcagttccatccacactatttcattcactaaatgacactgagatattattaatttgaaatgacggtatgcaatagttaactcactagtttatcttcttattaaatacaactgtgctgtatttaataagcagcatctatccagtattattgtcataaaatttgcattcatgctttagcaattgcccttgtaacatataactcttctaggcagaaatatatctggctaaggcagctctcaaataggataacgtttagttggtgctctcactttggccaccatctctggatgggcctgtatttagcgaggtatttatcttaactcttggaggtgttaggaatatgacaggagaagtttgtgctactgaaagaaattaatatacacattattatagacctgtttaaaatacatatatatataataattgcaaaggctgtttgtcaggaatcagtgacaaacttcttgattagtacattaatcaaggcaattaacgttagctgatgtaaaaataaaaaaaatctcagtagcttaatacagcaaaatttatatctcattcaccttatatccagtatggattggcaccctcagtgggtgaccatgagatgcaggtaataatggttccctgctcatcttatcccctggatgtttctccaacacctgttcatttcctagtcttgcccacatctctgtatctgatccttcattaaattttcatcaactgaagttggagatactctcaatgacccattaaatatagcagactacctcacgttaacttacacaccactgtccaaaacatattcagatggcccaacctaacacacaggctcaagctgtaatttttctgtcctcccaggaagaggcaattggttggtgagcatctagactgtttctgcttttccaaagcgtcttcctgaggacattggtattctatcatattaaaataatttaattacttaataaatgtgttggtgatgaaacacatttgagaaatgctgagctaaagaagctggaagtgtttataatattttaatcatacacgtacaagcatgtaatgttgtaatgtgcaagagtcagtctcctagattgaaatattgtctgcagaattttccctttggaaatacatatttttttatgaagcacatgatgtgagtggagttatttcctgggaagtcagtttgggaaatactattgaagttatttctcaataagcagctggtgggtccatcagtgaatttgccaaggaatagtttctgaatttatcaaaatagattccacttttaccaaactctgcttaatttcctctgcatgccctgtgctcttctttcgttacatcatcttcactggtgcacattgctgtattttgcagcatgtgcagaattaatttttaattcctatatttgcaacttcttctatttacaatcaacaccctcgttaacaattctaatacatatttggattcattcaatatgctcgtaaatcttgcctctctgcttcaattgttaattcatcatttgtaggccaccaaaactactaagagaatagagtgaatatcataattttaaaacaatgtctgtgtttaaccaaatattacctgggaagatcacttccttcagaggcttttctaatagttcagaaagtcaagattcagagtcatgaacagcatcgcaataacaaccacattttaaaaatagttatttgcatacggtatacttatatcatcgcacatgtatcgtctcagttaatatcccaaagaactgtataaagtaggttgtagtattgccttcattttacagagtcactaatcaaagcttactgatattgaagaaactgtcctagtaacacagctaattaatggcatactggggatttaaccaaggtaaatgatcccctatcacaatactattatgggagagggatggattcatgcagtctggagaacataggaaaatttttaaaaaataaaataaaaactggcctgggtgacatagcaagatcccatctttacaaaagaaaaaaaaatagctagtgtggcaaacacctgtagtcccagctacccgggaggctgaggcaggaggatcacttgagcccaggagttcaaggctgcagtgagccatgatgataccactgcactccagtctgggcaacagaatgagacttcatctcttaaaaaaagaaaaataaataaaatgaaacactggagaaagtcttgatatgttggaatgcaaatgatagtatatatatataaaaaaaaagacaaattgaaagtaaataaaccaatccaatagaaaaaattaaaactttaacattatgtaagtaatgttctcagggaaacagaggaaaaaccaagcagctatgtaaaaaaagaaccaagtagagacacagagttggataaatataaacatcaaaataaagtgctcagactatgagttaaatagcaaaatattttggctgaaataaaattagtgaggtagtagacaaggttaagaattctatcagaaatcatcagtaatgggtaaaggacaaagataggaaagctccaagctggaggagatggaagtagaagtatcttatgtattttaaggtaattatagaatgggtaaaatatatgaaaaattaaactgaggaggcaggtaaagttcaaatagaaaaaataaaggagtaaaactacatataattaaattttaaaatatagaatttcagagaaaagggatatcacaaacatggtttaaaaattactaaaagcttagagtagacactgagacaaatatctcagtacaagtagtatacatgggaaggatgcatggaaacagggaagtgagacaaggaagaggggaatgcaacaaagatgacttacattacaacaattttcttataaagttacatatgaactaactcataaggttacatataaattgccttagcaatttattcacaacaaatgaaaacatctgcccacaaaaatatttttttcaggaatgaatattaatagcagcctttttcataactgccaaaacagaataactaaaagtcccaacagaaggaaggaacaattgtggtctatcaaacaatggatcaaaagatggtaagctgctgatacacacgacagtatagaaagatgtcagggatgttatgctgaggtaaaggagtcacgtacaaaagagtgaaatttcactcatgcaattcaagataaaactaatttatggtaataagaaatgtaactgtgaatggctctggtaagaattagatggtgactgagtggaaatgaacacaagacttctctaggctaatggaagtagactacgtatccatcttgtatgtaactgtagaattgcctataagaaaatgcatcaagttcttaaacaggggaggagccctagtgctgcggatgcaacagcatgcagttctgccagcctgggaatggcccacagacacaagtgtgagcacacatcagtcaggacctgaataagggcctggggaggtggagcaggaaagccacaaccttgagaggcagtcacttcagttagattcttacctgggtcagtttttagctaggttaccttgggtacattgcaacatttaactttcccaagaattaattttctaatcttaatttatctcttaaaattgattatatatgtgtatacacacacacttacatgtatatatgtccacacacaggattattctgagaagtaaaaatgatgtgtatataaatcacatagcacaaaatatcaagtagaacaaaagctgagaatagccagtgttctccatgtaccaacactgtttaaggatttttgtggtgttaacacgtttaatcatcataacaacttgatgaggatgtgatagttccataggaaaacattatttcacataattctatttcctctctacatacatttctatatattcaatatagtattctatacggtaccttaagaactattattttcctattttacagaagaaacagagtcaaagaattgagatattggcccacaggcatgcataccaggtttatctcgaagctgggattgatctcaggccgtttgtaatatctgtgctgtgaacaattgctatagaaagagaacaattttttaagtcactgtgggaccacagcagcgggggcagggggactttattctgcaaagggaggtgaaacaaagtttcagacagaaagtggcatgagcatgtttttaatagcaagtttaattatcaaattaaatattaggttggtgcaaaagtaattgcggtttcagatcataaatttaaatcttataactatgctcaaacacatctttattaatcaaaatgagaaccattacaatcaacacatttttgccaacgagaaatgtttgtttcttcctgcagcataaaaatccatgtttctggattcgatgaactcttggaaagcattttctgcatcctgccggctttggaagcattttccctgcaaaatgctgtggaatcggtagtcagtgggtgagaggtcaagtgaatatggtggatgaggcaaaacttcatagcccaatttgttcaacttttaaagtgttggttgtgcgatgggtggtctagtgttgtcatggagaagagtgcctttcaagggtgtggctttcccgttccacctccgcaggcctttatgcaggtcctgactgatatgtgctcacacttgtgtctgtgaatggctctggtaagaattagatggtgactgagtggaaacagacccgagacttctctaggctaaaggaagcagactatgtatccatcttgtttgtaactgcagaattgcctatacatctagtgttgtctagtgttgtcatggctgcagtctttgcagttttcagtgcatctcatccatttgctgagcatacttctctgatgtaatggtttcgctggggttcagaaagctgtagtggatcagactggcagcaggccaccaaacagtgaccatgacctttttttggtgcaagtttagctttgggacttcttctaggtccatctactgagctggtaattgttggttgtcgtgcaaaatccactttttgtcccacgaaataatctgagaaatagttcgttgtttatgtgtacaataagaaaagacgacacttgaaaatgatgtttttctttaatttttctcagctcatgaggcacccaacttatcgagctttttcacctttcctgtttgcttcaaatgcggaacaaccctagaatggtcaacgttaagtttttccacaacttctcctgcagttgtaagagaatcagctttgatgattgctctcaattggtcgatgtcaactttcaatgaccgaccactgtgctcctcatcttcaaggctctcctctcctttgcaaaacttcaagtaccactgcactgtaagttcattagcagttcctgggctgaatgtgttgttgatgttgcgagttgtctgcgctgctttacaaccattttgaactcgaattgttttttgtttaacatcatttccatagtctaaaataaacataaaataaacagcaagcaataagtcattagcaaaaaaataacataaaataaagcaagaaatgcccattaaagtgttgtatgacataaccacatttatttaagaatgtattccaatatcaaacagcaaattccaacaatgcgaaaaccatgattacttttgcactcaactaataaatcatcttgctcaatctcatatacttagcattctgtaaaccccgaggggctccctgaatagtctacagggacagctgggaggaagggggcagctaagtgcaagcagtgtgggtggcctgggtaagtccttcaaccagaacattctccttcatgcctggctcatataagaggattccctagaagattcactttgaaaaatggattccaatttcatttcaaaataatgtttgaaacccacaaccattttatgatgaaatagtataacctcattattttcactctctgaattaagacaacttggatgaaattaaaatccaagtgtttttattctaattttcttgagtggactattttaaaatatgtctctttaaaatgtttaatttctgcttatctttccaattgtataacaaatagcaaaaatatagagtatacctgtgatttagagtaatattcagtttatgttacctgtttaccttttttttttttctttttgagacagagtttctctcttgttgcccaggctggagtgcagtgctgctatctcggctcactgcaatctccgcctcccgggtccaagtgattctcctgcttgagcctctagagtaggtgggattacaggcatgcgccaccacacctggctaatttttgtatttttaatagagacaaggtttcaccatgttagtcaggctagtttcaaactcctgacctcaggtgatccacccacctctgccttccaaagtgctgggattacaggcatgagccaggatgcctggccacatttaattcagaatatttttataatgatgaatggtatctcaggcaactaaatgcaagagggtgagaaaggtacttagcattataatgtttataaaataaatttatttctctttatttgaatatctcatttgaatcaatgaaatgtttttacttgatttcaacttaaaatttacatcaaattttagtgcgtgaaatctgcatttatatttcatatgttagaaaaccagaacaagaaaatatttgactaaatttaaggttaaacatatgacttaatcagctactgctattgtacaacaaaccctagtttctaaatctgaaacaacatattgaaattgacatctttattcccattttaaggatgagaaaatgaaagctcacttacagtgatttccctcagtaaccctgtaaggtgataaaaccaggattcaaaactctttatttatttgaacttaaagacaattttcttcccagtacacaattctactttttattttcaaatgaagctgacattaacattcatgtctggctttgaatgcactattcagaatactttactatttaattaattttatcttaatatatagtttggggggcttcaaggctgaggttgaagcagagaaaagtaaaaaaggagacagacagccatttgtttgagcatgtgtcatgccttctcccaagctggtctagctgagcggacaattcacacggtaacgtagtcggttggaacatatccatattccacttcactcagctgcttttaagataccaacagtttacctgcagcaactataaaaagcattcagttgagatgctgctgtcatttcacctgaatcatcccaagtaccactgactctctgctgtagacagaacttaatggtttagaaaatcccaagcaagttagaaagtacagtgtcacatatccctgttttcagccaggacagtcaattgagacagcaagagattggattttctttctggttgaattcttggtgttttttattttaaatactaatcatgcttcaaggcctaattcaaaagtctccttctttttgatgtcctccttgatcccctacagcagaatttatagatccctctgtgtttttatagttctttgtttatatctttataacaaaagcttcaaagggaatcccaagcctttgagtcaaagctgctgatgggattaagagaaaaacagatggaaagatgtctgaggagcccaaggagggaagatcagcctcttaaaggaagcagttatggggggaggataggagttctgtggctccagctcctgtctcttccacatgtagtgggaatgttagagtagatgagcaaggcaggagagggcccccccattcccaggaattttaggcaatcatcaggtgatagtcaaatggttgttaaactgtctcgctaaaataataattggtcacagccagcgacagggaatggcagtctcccagcagataggaaacatctaaagctggtgatcaccagccaccaataagatctaaggagatgggcaaatgggctcaagcatgcagactaagaggcaaactggcagagttgaactggtatatgaccttccgataggaatgccccacaggtaagggaaaaagacctcaagtgagcatgcacacaacctcagtaaacacaccgcacatgtgtggcctctctcaggtcctggtaggccactgtgcaggcagagagcccactctaagagaagaatgaggggagaaaacaacacaaacctcagaaccatgccagtgtataaaaccccaagtcaagggccagatggggcacttgaatctctcaagtcgcttgcttggccctcttccaagtgcatttttcctctttttgttcctgttctaaaactttaaaataaactctcactcctgctctaaaacttgcctcagtctcttcctctgcattaaagctacttctgcccctccactgaatgatttcccccaagacggcaaaaactgagtttgctgcagacccatcagatttgctgccgataacaggtggtgtaaaagtggaatggcaacaaattagagaaaatgtagtggaatacaatttggttttcaccaagtaagcagtctatggctctgagagggcttcccatcatgtggaaatgctgagagatgatgcaggtcgttgaaccaaaccagaggataaagattgatggtgtgatttcagacagatggaatgagggtggacccaatgccttcagagacaatggacacacctgtggcaagggagctaagagttcagcagggtaggaaagctctaggcaaaggcaagaataaaagcattcccatgtcctggaagcactatgaagcgaggcaggaacctgagatacaaaggccaggagccatttgttttgtatctcaagagtagccatccactcatatattccaaggtaaagaattgagtggtgttaaccctccagccagggtgatctgagttacgcaaaaatgactgaagtccatgctcgaaaagtgggttgattgtaattttgaaaagtgtaaatagtgactatgaactttgaaaaaagtttgctctggttttcgactacagccttattatttctagtggtgtgatcagaaaataatgcttatttacttctctgggttgctatcttattatttgtaaagatggaagaaaagtttgcattaaggattgtttgtgaatgtaagatgaaaaagtatgagagcctgctgtgcagagttactagagattggcagtcatttaataaatgttaaattcttcttgctgatccctcatatgttttgcctaccttcccttcattcctactgtttttttcttctgtactaataaggaaaaaactatttctatttagattttcattttcaaaaattttgaaccatcctctaacatacagaagagaatattatatatcaagttcttccttatgtagcacttgttttattttaatatactcgcatttttgcttcagatctctgtaacttttacagtctttgcatttacaaccaaagcctcgccactgtcccttccttttgctacaccccagagatagcactgtctggaaattgctttctacatttcctatgcatgtcttggtaccttgtaccataaactccataccactgttcaatgcattttaagttttacgtaagtaacactgtatacaacaaaataacacatgcaaacttttgtgcttcccttatctcagtattatgttttgagatttatttatgttcatacttgtaaaccaaactgattcattttattttggatgttgttcttcattgtgggagacaatttatggttttcatagctacaccaagagatattttttttctaaatttttatttctatatagagtactgcactgaacactcttatcatgaattttgagaatgcgtaagaatttctgtatgaaccatttgaagtgaaatgataatgtaaccaaaatgcgagtgagttgctccccacctggagaactcaattaacaacagtgagatctgattcaaagcaagtgaattcattccgaagctagcatggggaatgggcacaaagtgtcctgcttttaaatgtgccacttcacctttgtggcagaaagtggacacttttatgaggtaagggggaagtgatcatgggaaggggtcctctttctaacttggtgccttatctaccaggcacctatctgggcagagataagttgtaaaagtggccaagcaggcatgcttttggtatgcccacctggtagctgagagttctgggcaaaccctggagggtggaagttccctggcaggtatgctttggtctgcaaatccactgtcaactctccaggagagatcaatcttggagcatgcagttaggagaacttgccctgcaaggaatatctgctgaaggggaggtgaaaggttatatttgcatttctgaaaggctaagtaggaaacagggaacaggagagtagcggagagtagaagagaaaataataatgaaaaaaatagtaattcatcccctttttcttagaaaacataagagcacttggttgcaataaggttaaaggatttgcttattttaatttgcctggatatactcagttttctcttctaaatgcttgtacaatctcggtcagttctgacacataaaaagcttggcagttgttactctaatccttacagaaaaaaaaagaaaataaaagataaacaaattgaaaatcgatgacttttcttggacctataagagaagagcagggcaaatggccaccctaaaatctgaagagaccagcaaatgcggagaaccacagccaaggtcagctcacctggagcagaagctgctggggccagaactcgtgggaaacataaattgtcattttgatgaatagctggaggatgcgtgtagggtaatataagagagaaactgctgggcccccctccccacatttttatttatttttacctctaggaaccccaccaggttctcacagtaaaaagccataaacaaataaacaaactgtcttgtctctgacagatggagggggaaaataaccattatgaaatatgtccagaatgcaaagccctttacttgagaaaacactttacttgagttttacttcaccggtggtagagggaattgacccaactctggccccctctagccattcttttttacctccgtggggaataaaagctaagaaacacagcccacggacacagccaagagactgagattctgccatcagattgtagaacacttactctcccccacaggttacccttgtatctacagggatcaggtattcattgcagtagattacagaagaaagagaagcaagattcagtttccatatgaagaacttcttaggaaatcacagtccaatgatgctggcacaacctttggaaaggaacggtgcctaaatgggcttaaaaatttaataccaattctggttaagttgtataaaaatgcctttttcctcttcctcttcactttttcagatgaacagtctaggggaaattaggggacgattggcaaagggtgaagttacagccactgaagtgggacatcctagttttgtagacagtaacgaccccagcacctggaggaggaaggccttagacaccaggacttactgaggaaggagggacattggtaatccacatctttaaaattgccctctggagattttctcataaagacaatggccctttctgctctctgaattgctattaattccctagatatagctgactgttggatgtgccatgcccttgctgagagacaactctgaccatgatttgactcatatgccctttaaccttgatgcaaactctattggaaacagcaaggatggtcccaacttctgcacctgtaagcgccattgcatgtcttccccatcccatcccgagtggtccctcagtcattttgtgggtcaaatgaatgccatgtggctaatgacatggacacatggactaggcgacactgtcaagctgtacccacccaaaataatataggtcccatttggggagaaaattgcaagcaacactttttttttcctaggaggctcatatgctccccgtgactttactccgtgagtacagttacttcagttgttaacttgcctcccttccaaaaacacaatgaatggcccttagtgtggtcataagagatgtgtaagtttttaagtaaatgccaccagtaggtcacacagccccagataactacaaagatctctccaaagtcagactctcctggttactgagattgagaagggcttccagaaacagagccaactgatgttttatgtggaccatttggacaatttttttctacaatgtgtatcacacaaccacttgagctaaagtaattaatgggaccattttggtcctgccaagcattcaggtcagcctcacctcaccagccagagtgcatggactatagagttgctctggactttctccttcaagtccaagacagagtctgtgcatccactaatacatccttaccccagaccaagtggaatggttaactccgacattgaaaacgaagcctgtctgggttcctaatgtagatctgcactattttgagacattattaagcctggagacatagttgaggacaatattgacatgggatgggcttattctgatgcttgaaatcctattacaaatacccttaattaaatactgtatgagacacattagtcagacttggtcctagcctctgttggtcagaaaaatcaaagtgtcagaggaaacaatcttttattgaaaaaaatcaccagaagacaaggtggtgcaaaaatgagtggtaaatattttgggggatgattcttcctggatctctcacatttttgtgtgtcttatgagcagaggagttggtggccttttgctccagatgatctgatgatctttccaagatttttcatttagtgaatagccttggaaaaattgctctggacttccagcaactgtttctgaagaagggagtagatgtgcttctatctagtataataaaaacagtgtgtccctctgggaaaaagcttaggcaactgtacttcatttgggtttcctatgcttgaggttcatcacctatgaaagaaacagactcagtatgtgcacaaaatccacccaggccatgtcgcccatgtttgacttgggggaaaacggagctgacaggagcatggagctcaggtttcctgctgttttaactagaaaagccctctgtacctgattcagatgtctagtgtctcctctcagcatttgtgaaactgtggcagcctaactcactgactaggaagcaggataacaattcagatcctcataattattttcagaatgtactgtcacatttggagaaacagttgtggagcttaaggcttaaggcaatggagctttttactcactgctgctcagtgagttcctggttcaatcgccagtttaaatgacactttctcttcatagctttcaccaattccccttactgcccacatatcatggagttaactttgcctccatttctagtccattatatcacttacagaaagtagcaatatgtatttttctattttatagttaatgacgtcatttagttttgtggctttaagtgacaactgtttttttatttaaaacaagaaaacatgttttatgcatttttctatagttaatattaagcaaagtgcatggtacagagagagaatttcatattctaatccaaaaatgaatgaataatatagcaaatattatctgatttccttttatatgtggggactgtactaagctaaatttaggctaagtaaaatttagaatatgccaatgaaaaatacattgtgcctctcttcaagaataacttttaaaaggtagatgggggctgggggtggtggctcacgcctgtaatcccagcactttgggaggctgaggcgggtggatcacgagatcaggagatcgagaccatcctggctaatacagcaaaaacccgtctctactgaaaatacaacaaaaaaattagccaggcgtggtggtgggcgcctgtagtcccagctacttgggaggctgaggcaggagaatggcgtgaacccaggaggcggagcttgcagtgagccgagatcactccactgcgctccagcctgggcaacagagtgtgagactccatctgaaaggaaaaaaaaaaaaaaaaaaaaaaaaggtggatgggtcagacctctgtaaatcaagggaaaagcatatgaaaggtaaaataattcttgttggaaaacacagaagtgaaagacatgaggtggaaaggtagtcaacattttaactcagaaagtctaacatgtcttatcctggagtttgagcttcttgttttaggtgatttaagacagcagacatttaaaaatgacatggtatagtacaaagaatatatgattatatgctgttcacacatcaggtggtctaaattattttgttttctgtgctttattgcctgacatatggaatgcaaaattggtgtggaaggtggaaaaaaatttaaatgaaccttatatttatgtataaacataatcacacctaagaacagcttacttagtttaagcaatgctagcatacatagaatcattatttctacaagagaagggtcaggatatgtggtggtttcatggaaggggagccctaaaggaagagatataaacacctgtactatagtccagtgccctgggaaataagggagaactctaccctgaaaccaaatgcttccatgcttacctgtcctcaaccaccatcagccccatgtagatttttatactaaagtatcaggtgtaggatcaataatcatgaattctgaagtcaggaaggccttaatgtgcattctaagtttgtcacatagattggttgtttttctcatctttaaaatgggaataataatatctaccccataagaaagtaatgctaattaagtgaagaaagatatgaaagcacatattaaattgcaacatgctttaaaatgtcatctatttttaattgctattaaatgtattaatatctttagctttctgcttaaatgttgctaagtggtaagcttcaaagtcgggaacttttggaatgtttctcattttgagtgaagactgacgtagtaagtctgtctttgaacatctagtcctgattcatttagtcattcattcattcaaccattcataaatttactcaacaagtatttattgacaaatttatcattcatcaagtacagcaaagaatagtgagatacaagacaaaattcatattcccgcagtaatgaaaaagtatgggtatggtatggggtagcagatactgaaatatgtgtgcatagatgatggcttatttccatgtatggtaaagcctagaaaataacaaataatgttcacactctcttgggtttctgtgagagtacaagcttcaccatcttcaactcctgaaagcccagcatctgtcaccacaaaatttgacatgcttgctttgtggccagaccctctagaaaacctcactcatttctgtatgttggcaaaatttagcaatctttgatttatcgacccctccacagcagtgtacctctaaatcctgtcttgctggggccctgggcaaagcagtcaggcagagtgtttttaccctctttctcaggctgatgtccttttgaagatcccctatgttgagatctctgcacacaaccctctgggatgctaccctggatctgagatgccccacaagtgctggactcaaccagctctgctattggattccatagtcatggaccatggcatgggatgttggaggtttactttgagaattaatccttcatgataaagccccttttttgctcaggttcccttagctaagtcctgatatatatctattctggcttctcctgagcctcttggtcgggtatctcagcacacctgatggtgggagctgtggcagttaagaccatgcttcaaacttttataaaaatccatgagcttctaaatgaatggcctttatgtagcatgtttaaaagcattcacagttgttttttaaacacttacttaagttttgattctaagtgctttctcctaaatagaaattataggatcaagctgggggtggtgacacgtgcttttaatcccagctactcaggaggctgaggcaggaggatcacttgaacccatgagtttgaggctgcagtgagctatgattgcatcactgcaagccagactgggtggcagaatgagatcccatttcttcagaaaaagagagaaagaaattataagatccactctaacttgtgaaaaacgcagccctgacagaaaagagaatcctagtatgacatattagaggtcttccttgaaagattattcaaattgtggttgcatcttctgttttccctgcttttcctttatcacaggaagaaagaacatttttgttaaaagttattgattgataaacacacaaaaatacattagtgatttaaacaagccatttgtttctgtggataataaatataaaaaaatctaattcagtttctaaaaatttatcatgtttattccattgtagaagaaaccacgaaaatatagcatttggtatcagtaaattatactcttagtgaagcctgtctctattcatcagactccctgcacacagaaatctagtttttatgtgaatttgtacagcctttcctctgaagctatgttattgattgaattataggctgtacagagccttggagctcacatacgctgaactctttattttgcaaatgatgctattgaggtctagagatgttaaatggctgcccaagattacatacctgactgcaatgttgcccctacaccacggctttaagactgatttgtgagtgtctgcagattcccaagtgagagaagcatgtgccatactacagatgttcttacccctatacctccccactctgttacatatgaaatactctagaggaatcacggaatcagaagacttgagttcaaaatattggagagccttgtgaccttttaaactttagttgtttaagctctataagcattagtttttcaaattgtaaaatgaagagacttatgcaaaactcagatagaagagggaaggttaaactctaatttatatggcaagccaggacagtgcacagcaaacaccaagaaaccaatccatgctattctgattcatttttgtgaaatggcttgaaaattgtaccagtccatgaaaattcaaatattatacattatgtatttgtaataaagtagctgttcttatttaaatatttctcatttatgatcaggtcttattaatagaaataagtgcctcttacatgctctatttttgagaacttttctgtgaactaaacccctcttatgtcaacatagcggagcccttcctgccactaaataagccattaatggctacctctttaacatactgtattagggctctctagagggacaggactaacaggttagatgtatatatgaaaggaagtttattaggagtattgactcacatgatcacaaggtgaagtcccacaataggctgtctgcaagctgaggagccaggaagccagcctgagtctcaagacctcaaaagcaaggaagccaacagtgcagccttcagtctgtggccaaaaacccaagagcccctgttaaaccacttgcgtaagtccaggagtcctaaagctgaagaacttgggagtctgatgttcgcaggcaggaactatccagcacgagagggagatgaaggctggcagactcaggaagtcaagtccttccacattcttcagtctgctgtattctatctgagattgcagctgattagatggtgcccacccaggttgagggtgggtctgcctctcccagtccactgactcaaatgttaatctcctttggcaataccctcacagacacacccaggaacaatactttgcatccttctatccaatcaagttgacagtgttaaccatcacacataccattatccaaagttttcccagaaattcagtgttcaaaagcttctggaggcaaaagattaattatagtattatgaaaatgtattagaaaatgaagcccatctaatctaaacatttacatttagaagtgctactgacagatgtaccaacctgaaataaatcactcagatatttaaagataggggtgatactggaggccagagcccagtctctttcgtaaaaatcatagaatttattacaacccatctatccatttgtccttacaaccaccttgcaagtaatttcaaactactatctatttttaggccatagcatatgaaaatataaatgtaacacttctgaaataaaatactgacttatctgttcaaggtaatgggcatttcaatttggcaggaattatttcaggaatttggtaggaactatttcaattatgaacatgaggatggagaagataaaaaggaatggcaaaaataatttgtgatatattaatcccagtagaagaactagtacttcatctttgccaaagttatgcattgcaaatgtcaatttagctttggctactgcagggtatgaaaaggaaaaaaaaatcttgagtgtgcgtaattattgttaatgtaagttatctaattgggagtatttattttctgattgtagggcaaatgttagtgagtaaagcataggtttattttcttgtctattcatattttcctgaattccttaaacaaaaccttaggaatgtccaatatatatctgtgattataatctgcttaaaggatatcatggaaaacaagagtctttattgtgtgccttgtgcattcctaaggtaagctgaggaaaatcactctcaacgtacaattagaaatagttgtaacataaaactgtgtcatggatgtaagggaaaatgtttactgaggaaaggggtgcacgtgagggcgacggtcaggcaacagttttctgggaaatattgagcagcctgtctctctgataattttattaaactgctttgtgagataatagccaagcagaggctaaaactaaaatacagaaaatgttgaagtggaggcacctggtcaaatgcataggttcaaaaataataagagtagaataataagggctgcatcgttgagaccaaaatcttggaattctctatgactcctgagatcataaattcaggactatgctatacttctggacaagttatgcttttgtgtctaaataaggctcttatgcaattaatttttcccatgttctactcacgtcaaacatctcttcaatcggatatgaggatcagaaattgtatatcattagctcagtgtcccacacatagtaatctgcatcttgaataatgggcaagctgtgtggaaatgtatattctgctactgaaatgactagagaactgttggtgcacgtttatttatttatgtttttttttttgagacagagtctcactttgtcaccaaggctggagtacagtgacacaatctcagctcactgcaacctcccaggctcaagtgatcttcctatctcagcttcccgagtagcggggcctacaggcacacatcactacacctggttaatttttgtactttttgtaaaggagagattttgccatgttgcccaggctggtctccaactcctgagctcaagttatctgcccaccttgagctcccaaagtgttgggattacaagtgtgagccattatccccagcctgctgatacaaatgtaaacatgcaaactcgttaaggtgaattactttactataaagtgatattttcttacttaaaatgtaaatttctgataaaatctgaatgttaattcacgtgctataaagagataaagaaatgagggccttgagaaagaaaaggtgtgataaaacaccttttaaaacaattttatgatcataggcaggtaatattaactaataaatatccaatatacaaaatatttgttcatgtgaatactggatttaacatcaagtatgaagagtttctcctaccttttcttgttgtcacctgtattaattttctagtgctgccataacaaaatagtacaagctagttaggttaaaaaacagtcacttattgtctcataattcagatactagaagaccaagatcaaggtgccaacagggatggttacttctggcagtgtgaggaagaatcccttccatgcttctatcctagcttctggtgacgagctggcaatctttgtggttcggcttcacaaagtgttccccctatgtgcgtgtctgtgtcccaatttcctcttttagtaaagattttggttctattggattaggagtccagcctaagccagtatgacctcatcctatctttactaattacatctgcaaagaacctatttccaaacagtcacattctgaggtactgggagttaagactttaacaagtaaattttagggaaggacaattccactcgtaagaccaccttctggccctgcaaaattcacattcttctcctatgcacaatacattcattctattccaacattttaaaaagcttaaactcattccagtgtcaactagaagctctaagtcttacgtaaatatcatcgaaatcagatatgagtgagacttgaggtgtgattcatcatgaggtaaaattaccctccagctgtaaccctgtgaaactagaaaaataatctgcttccaaaatacaatggtggatcggacataggataggcatttccattaaaaaaaggagaatctgaaagaagaagggaatcatggattccaaacaaggccagaatatagttgggtaaattccactaagatttagggcctataagtaatccttgttgactccaagctctgtgctgcagacctactagggtggtggccatacctccttggccctgggcagtggctaccctttagtttgggccttcagtctatggtgacagttatagccccatgagccctaaaaattatccttcctctattttgtctcttctctgcctctttcagtctaagcaggcttgcagtgctatgctggcataaaattctcaaaaaccttgttggcctcctgtgctagacgtgggagttcaaaccagcagacaaaagtggatatttcctgtgcaatcacatctctatttctggcttttgctgagatggtttactggatgcatgagtcacacagcaaatctatctagcaaatggttgtccagccacacccttggccttatttcaagagtattttgtctgggtaggttgagaatcttccaaattattaagtgctagtttatttttgctcagcattttctttttcagtttatttttctcctcttgcattttactcaaagcagcaagaaaaaactaggccacacctgcaacactttgcttagaaatctcctcagctaaaaatccaagtgcatcacttgtatattatactcgccacaaaacattaaaatacaatattgctaagttatctgccattttataacaaaaaaaaacttttctccatttttcactaacatgttaatttttgtccaagttctcatcagaattacttttaacattcatatttatactaagaattttttcaagaaaatatagtgacatggtttggctgtgtccctacccgaatctcatcttgaattcccacatgttatgggagggacctggtgggaggtaattgaatcatgggggcaagtctgtcctgtgctgttctcatgatagtgaataaatctcatgagatctgatggttttataaagaggagttccctacacaagctctctctttgcctgctgacatccatgtaagatgttacttgttcctccttgtcctctgccatgattgtaagtcttccccagccacatggaactattagtccattaaacctctttcttttgtaaattgcccagtctcgggtatgtctttatcaacagcataaaaacagctaatatagtaaatcatctagcatttttttagtcaagttcctcaaaactcttcaagcctctatccattacttaatttcaaagctacttccacattttttagatattgttcctaacagcatcccaatttctagtccccaaatctggtatgactcttacagaaaaaaaaaaataataaatttaattcctgtgctgtatttctttaagaatgtgatatggttattggtggcaagactagaccagatatgagcacaaatcagttgacaatgatagtagatggcattataataaattctgtgttatcagcttacatggtttcctgttccacattttcaaaatgtcaaaactaaattcagttaaactaaacacattgattctgtcctatcagttaaaacttaacaaatatgcctacaggatgcttctttaactaattaatatgtttgttacttttataaagttctttttcatccaagactccacattttagtttttctcaatagctgggtagtttccacatcctaagtccctgtgttgtttactggtaggagttgtttgtaagaaacaataaattacaatttctctggaattattgaagcttgtttttgactctttgaatataccttagtttaggaccatattatgctggaaacaaaagaagatctgagtgcatggaaaataactaattagagaaaattgaatatatgagggaatcagacaaacatgtaagtgtctcaagaaagttatgtctttggttttgcacatgtgaggaaaaaacaaaagcagtcgtaactagtactgataatcctaaaatttatgataatgcataaaatatattcaagaaacaaaaatgcatatacaaatagataaaatataagaaacaaaaaatgttatcttattattataaatgcccagaagatttatatgggctttctaaataaatattattctagttcattatcattccctaaagtttaaagaaattttcctgatcatctaccagaatggcaaagtgaagtgctcagttaacttgttccccttctaaaacaaaggaaatatggacaacataaataaaatcaatgatttcagaacttttgcatttgttcaaatccaaagaacaaactgaatattatctaccaaagagaaactattgaaccttgtgtattagtccattctcatgctgctgaaaaagacatacccgagactgggcaagttacaaaagaaagaggtttaatggacttacagttccacatggctggggaggcctcacaatcatggtggaaggcaggcaggatcaagtcacatcttacacggatgccagcaggcaaaaagagagcttgtgcaaggaaactcccccttataaaaccattagatcttgtgagacttgctcactgtcatgagaacagcaagggaaagaagtgcccccaagattcaattaccttccacccagtccctgccaccacatgtgggaattcaaggtaagatttgcctggggacacaaccaaaccatatcaccttggtaagacagttctaacttagagttatctacttttccctccctccccctaagctcagtggtgatatagcaaaaagctggcagcatggcaaacaatggaggtatatggctacttttgaagtttcattaaaagcaccaccccagggctcagttatatttgttctgaacttgcagatctctaaaaatcaaaaatctattcttagaaagcaatggctattttattttactcagagatcagcttaatggagcagaatgttgtagcctacccccagaacattaaataaacaataataaattgctgacagtatttcagatacctatggttgtggtttcagatgaagcaaagaaaagcctagctggaaattttaaaaagaaattctgggagaataaacaatcataggagattgtgagaaactccaacatatgcctggggatctcatgggtcgtgtatatgcccaggaaagatctgggaaaggagaggcaccagttactcagctttggcttgcctgcacaagcaggaagcaagagctaaggctgtgtcataaactttctgaaatccaaagattttctttctcacacaaatctacttggaaaaggatgtaaggcatacaggtagggcactgaaggcaattttctagcaactcattgctcaccactaaattaaaataacatagaagtgaccccataaaagccagtcttaacaatgaaacatgaattacaaatgaaaaactaacagataattcaatagctccacgcttcaaacaatatataatgtacagaattatctaggaaagtgctaaacaagtcagcagcaacaaaaaaattacaacactaccacaaccagaactagcaacaaactgatgactataaaccttgaaggatgtaggaattaaaagtagaattgttgtattacctaaaatatccatttttaataaaaatataaagaaaccgaatagtatgcctatacatagagggaagaaaaacagcaaatagaaaatgtctttcaggaggcatatattttgaatgtagcaaacaaagtcttttagctattataaatatgttaaaagaattaaagaagcagaacagatctcatttgcaaagagtgtgtttttttatttttattttttattttacttgtctagtggctccctggatgaccagctcaaagggcttgcctttatctcttcttacccagatctctcctaatctcatgccctggggaaagtttgttgaaaatatttaaaatatttataggtaaatatattagtcattgctgcatgtacccataaatagtagttgtaaacaacagacaaacaaagaagattgagaggaaaatctgtgatatcagattctttgaggaatgagttttgaagtatcccaacatatttctggtaatttctaagccatgtaatgcaaagggctgtgtgcatgttcaggaaaggtaggagaagcctgtaacctgttgcttctggctgatcttcagcctctgagctagcagaaaatggaacctaaggaagaactgaaaactccctgaccaaatgtagaagggaaaattcaaaaatctaccgagcccatctgtgaaatgttcaatcactagctcaccaatgagataatggaacagaggctttagtggctacaccgaataaagaatacactctttaaaaatgtaattcagaaaaatcactaattaaacaaccaataactacaacaagaagcaacgggaaattctggggaagggaggtaagctaactttcatattgctgcattatgatatcatgttcagctttcaacaaaaaaaattataaggcatgcaaaacaactaaaaatacagtgtgaagtgtactcttcaaaaccaccaccaagttagggagcaagatacagccccagggtaacataaaacaccgcaaaatgtgctcgtctttttatgattcagctgttttattttttccttgattaattgttctcctacttgctgcaagctgttgattagcctatagaattagaaaaatgttgattctgaccgtttttacctatttttattgctttatgaagggagaagctattggcattgtgtactctgccatttttgccaacatcactcactagtgtatttttgaagtgacacttacatttaatgttttttagatagctaaaaataatgagacaacatatttctcaaaaattttaataatttgtaaacattttaaagcaaatttaataagactgaaatcttaaagtagtaagtttacttttttcttcacaagtatgttttagtgccagttccaaaacacaacatattccctttattgtttttttttttaattgccatgtgtctatttttctcttggaattttgaattttgtacatgaaggatgatcttgaatccttgaagtttattttagacttttaaatatgcctgtcaattagcatatttctcactggaaaatctctttaccttcgcaggctgttcaattgccttacctcctttactttgagggattagagctaatacatttttgcaaaaactgaaggttatactttgaattgaactttatataattaaactgaccccttttttaagtgaaattcttacttttgcttttgttgtgtgttgggataatttatgttgtatatttaaaaactttaaaaatattgaaaacattttcagaaataattgggttgacaaagttaactctacaaagcttttagaaccctccatattgaaacttgttcaagtagccatagaagctacttggcagacagtttatatctgcatgattagcaataaatgttaaatagagtaatagccatttaattcaacaaatatttattgtatgctttctgtgtgtcagttaatccgctaggcactacagaaataacaaaagaaaaactatattccttttttttcaaaggagcatgctctctgatagtaggtggttttataaaataattcaatgtaataacgaagtggctacactgtctggggtatataccctggagtttgttgtcacacatcaatagagaattcaggacacggacacgtgtgggcgggttaaggagtggaaagtttaataaaagaaaggagaaaggagaaaggtgagcagctccttgcaagagagagatcaggagagagagatataaaagactgaaaaagtggggaggggaggtggcagactgcagcagattttatagggaggctagaggaggcggtgtctgatttacacagggctcacagattagtcccatcagctatgatccctatagtccctatagtgcacagggaaggctgatcctcccactcaagattatgcaaatggtctttcctgttaattggcaccatcttgtctgctcctctacagtacacgtgactggcagagaagggaagatggacctgccattttgaaaaagtctagtccttagttcctgccagcattcacccatacaagctcacggcttgcaggctgctatttgttagaaaataatttggggctgcttttcattaaaaagaagagccttaccaaggactcccatgaccttgctatctacctaagtaattccttcttgactcctatatcaatagcatgcttgctgctacaagtgcttagagaaggcacaatgaacccagggcagatagattcaaaaaagatttcattacctctcattttagggtttttatagtttccttgtttgcaatttatatttaattagccatatctcaaaatgtactgtttacataaaattgacgtttgccaattcttaaggagactagaagaaaaatagctttacccaaaatgttgcacctagatgttttcatgttctataaaggtgagtgtgtctaacatggtcaggacaagcatgaaagctggtgtggctagagttaagagagagggaggaaaatactcaaaagattttcagatggtttgtatcaggcaagtgccaggatgatcttaaatggttaggtacaactatattcatagctgaaaatagaaccaactggatttcctaatggtccagatgtgatgttaagaacaggcagagttaaggtttgtattgagcaactgtaaagatggacttcccatcaacagagaagactggtgagaaggggctggtgagtgacatcaggggcacttattttaactggttaaatttgaggcacttatcagattcacaccggagccatcagtttgacagtaggatttgggaagttggagttcagagtaggagtcagagatgaaaatgtaaattttagaggaatcagcgtataaatagacatggccatcaaaggaatgagtaaagatagactcaaaggagaattcaaggacagatccaagtggcattcacatgtttaatgttaagagatgaagtaacagcaaaggatagagattagaacagaacttacaaaaaaagggaaaaagaaaactgactatataatgtcctgagttaaagtaaatttccagttttttaaaaaagttgcccattgaaagctttctaggagaaatgagtgatcacctctgtcctgtgctgatgacccaatggctccatccatgttactgcaaaggacatgacttcattcgtttttatggctgcatggtattctatagtatatatgtaccacattttatttatccagtcttcctttgatgggcatttgggttgtttccatgtctttgccattgtgaatagtatgcaatgaacatatgcatgcatgtgtctttatgatagaatgatttatattcctttgggtatgtactcagtaatgggaatgctgggtcaaatggtagttctgattttagctctttgaggaatcaacacactgccttccacagtggttgaactactttacactcttgtcaacaatggataagtattcccttttctctgcaacctcaccagcatctgtttttttttactttttttttttttttgagacggagtctcgctctgtcgcccaggctggagtgcagtggcgcaatctcggctcactgcaagctccacctcctgggttcacgccattctcctgcctcagcctcccgagtagctggaactacaggcgcccaccaccatgcccggctaatttctttttttgtgtgtttttagtagagacggagtttcaccatattagccaggatggtctcgatctcctgacctcgtgatccacctgccttggcctcccaaagtgctgggattacaggcctgagccaccgcgcctggcctttacttttttaataatagccattatgactggtatgagatgacatctaattgtggtttggatttccatttctttaatgatcagggatgttgaactttttttcataagcttgttggccacatgaatgtcttcttttgaaaactgtctaagtcctttgcccactttttaatggggttgtttatttcttgtcaatttgtttaagatccttatagatactagatattagacttctgtcaaatgcatagtttgcaagtattttctctcattctgtaggttgtctggttgtctgtttactctgttgatagtttgctttgctgtgcagaagttttttggtttaattagatcccatttgtcaatttttgcttttgttgaagttgcttttggcatcttcatcattaaatttttgccagttcctgtgcccagaatgttattgcctaggttgccttccagggttttcatagttttgggttttacatttaagttctcttaagttgatttttgtatatattgtaaggaaggggtccagtttcaattttctgcatatggctagccagttatcccagtaccatttattgaatagggaatccttttcccattgtttgtttttgtcagctttgttgaagatcaggtggctgtaagtgtgcagtgttatttcagggctttccattctgttccattggttttgggatctgtttttgtaccaatgccatgaagttttggttactgtagccctgtaatacagtttgaagttgagttatgtgatgcctccagctttgttctttttgcttaggattgacctggctatttaggctctttttagtttccatatgatttttttttttttttttgagatggagtctggctgtgtcacccaggctggagtgcagtggtgtgatctccactcactcactcactgcaacctccgcctcccaggttgaagtgattctcctgcctcaggttcctgagtagctgggactacaaccaccatgtggggctaatttttctatttatagtagagacagggtttctagtaaacctgttgttcaggctggtctcaaactcctgacctcaggtgatccgcccagctcggcctctccaagtgctgggattataggcatcagccaccatgcccagcctccatatgaattttaagatactttttctagttctgtgaagaatgtcattggtagttagataggaataacattgaaactgctaattgcttaggataaaaaatcaatgtacaaaaatcactagtattcctatacaacaacaatagtcaagctgagagcctaatcaggaatgcaatcccattcacaattgctacaaaagatatggccactttaatggtactgattattcctatccaagagcatggattgtttattcatttgtttgtgaccctctctgatttctttcagtagtggtttataattctcgtagagatactttcacctccctggttggctgtattcttaggcattttatatctttagtgataattgtgaatgggattgcattcctgattaggctctcagcttgactattgttgtataggaatattagtaatttttgtacattgattttttatcctaagactttgctgaagttctttattgctcttcgcttttgggccaagactatggggttttctagatatagaatcttgtcgtctgcagacagggatagtttgacttcctctcttcccattcagatgtgttagtattttagtactttttcccttttgttgattatactttgaatgttatcaaaatatatgccaaatccaaagtcactaaatttttcttgtaatttttaatagaagttttgtatttttgactgtaatagctataatccatgtcaaattaatttttgtgtatattgtgaaagaagcttttttaaattcctatttattcaattgttccagcaccgtttgttgaaaatcttacactttatacccatcactggtcctggcacctttcttaaaaaatcagctgtccatgtaggtgtgtgggtatgttttgggtcctcttctctgttttattgaactagtgcctctctttatgctaatgtcacactctcttgattactttagcatcatagtgaatcttggaatcacaaagggagctcctttaaccttgttcttctttattaaattatttttgcatttccacattaatttttaaataagcttgtcggtttttacaaagaaggcagctggggttttaattctgattacactgaacttatagaccaatttgagagaactggcaccataacaataatgaattttcttatctgtgacctcgctgtatctcttcatttatttagttcttctttaatttacctcactaatatttcataattttcagtttcagagtattaagaatattaagcaaatctgctaaactgaaatatttgttctagtaatatcacagtagttacagcagaattttttctacagatatatagaaaaaacaagtattacatttaagcctgtaatctattttgaagtcttatatttaagcctttcatctattttgagtagatttttgtatacgatgtgaggtaacagtccaatttcattcttctgcactatggatatttgttttttccagcaccatttgttgaataggctgtttttccccattatgtgtcatgatctatagaaaaaaattctgctgaatctactatcatattcctagaacaagtaagtcagtttagcaagtttacttatgaatacataaataaagagagttttaatttttccttgcaatctagatttactttatctattttccttgttgcagcaggtagaatctacagtataatgtttagcagaagtcataagagcgcacatacttgccatgtttgttatcccaatgggaagggatttagtcttttaccattaagtacaatgttagctataggtgtttcatagatgccttccatgaggtttaagagatatgcttatatgcatatatttctgaagtttttgttgttattcgttttaatcagggttggacggtggatttctctaaatcctttaactcttgagatgatctttttcttctttttagtatatttacactatgaatttcactgattttttttccctttttttttcttttgagatagcatctcgctcagtcacccaggctggagtgcaacggcgcgatcttggctcatgcaacctccgcctcccgggttcaagcgattctcctgtgtcagcctcccgagtagctgggattacaggcatctgccatcatggctggctaatttttctattttggagagacagggtttcaccatgttggacaggcgggtcttgaattcttgacctcaggggatccgcctgcttcagcctcccaaagtgctgagattacaggcatgagccaccgcacctggcctcattgatttttttctaaacattttctttaatttttcagtttattgaggtataattgacaagtacaaattgtgtatatttaagatgcacaacctgttgttttgatatacatttgtaatatgaaatgatcaccataatcaagctagttaacatatcacatagttgctattttctttgtgtgtgtgtgtgtgtggtgagaaccacagatttgctaagctctacacctcttagcaaatttcaattattgctaacttagtgaccatgatgtacactaaatcccagaactcatttgtcttgcataactgaaactttgtacccttcagtcaatatctccccattttcttctccttgccatacatagcaacaactgttctactctgcttctgagtttgaccattttcgcttccatagatcatgagatcatacaggatttgtcttttgtgtctggcttatttcacctagtataatatcttctaacttcatccacactgttacaaatgacaggatttccttttttaaggttaaataatattccttcatgtatctaaaaataatattttcttttttcattcatccattaatggtcatttaggttttttccatgtaattcctcttgggaataatactgcaatgcacatgag

SEQ ID NO: 597 - DNA, 40001 bp, Homo sapiens
agaatccgaggccaggcccttccccacgtctgctccctcatctctatgcccaactggcccccagaggctggggcgggggtggtggtgggctttcctaagtagccccccagccggaggagaaggactagactcagggatgagaacagagctcaagggaaagaaacatgtatccttcccagactgcgccacactctctcagcttcctcaccatacacactcctatctgcaccatggcattgaacacttctttgccagctggtgacagttgcagtttttctttaggaaggaaagaattctattaggaggaggtgggggtcgaggcagcctaggaaagtgggaaggacaatcacccgggagccgggcacaggcgctcccactcccaggtgggaccctgggtcagcatttaacctgcctgggcctcaagctcttcctaagggggttccaacagatcagatcaaacctcttagcaacagaactctttaatgacaatgttctcagaacctcaaaagataaaactgaccgatgtggagtggggaactcagaatctctctgtgcctcagtttactcatctgtaaagtgataactgcactcactgcactggggtgtcgtgaggactcagtgaggtaataaccgtaaagtgccgagaacagtgtctagcacatagtgagcgtggtatcaagtacttgttcagtaaagtgctctcaaagcagagggtgaaaactgccttcggggaaaacgagaacaggaatcaagcttgtgttacctgtcggagccgcccggctaagcaggggcgctgcccagctccccctgccccccagagccggtgaaggcggtgccaggaggtcccttacctgccgagaggaggtgctgttaacgggatcgggcaccggtgcgagaaggctgggcgggttctttttgtgaacgctattcataccaggcattttagtgattttacaggctttgctactagaactcgagttcttacgcttttttccttctgatttgtcaaaagagaggggcagagaagacacagcattgtgtgaggccagagagaggtcccctgcgtggagcgcaagggagggcacagagaggggacaggagtcactgctgcctcccaccgcgcccacctgtctcactatgtccgcggggccgccgggcagcgaggtccgtcctgagggctccagtttggcactgagtgggctcaccccattgtttgagttgtgcacagacaggctgttatagggaggggccgcctgataggagttcaaagcagaactggcattcaaaacacagttctttttgtgaggccctgacagtggagacgagagggatgtctgcaaggaagaggaggaggaggaggaggaggaggaagtcgaagactgtggcttcctttttttgttacttggagactcgtcgctacgggtggacaggtctttgacttttgaggatttgctggttttggttttggatggcttgtgggatggggaagggatgacggctggtatcggggacacggcggatggggccttgaaggttgagtccatgatgctgagggttgcggccacatgagggaaagctgtggtgtgggacatgagggcgctcgggtccggcgatgtcacgaaagctgcgtttgagagcatggctgatgtcattatgtaagaagaggtgagcctcgagctgatgggagctgaaggaagatacacagcactggggttgctgaaaggctgcaaaacggatgctggaacgggggtggtgatgtgggctgctggcgagggcagggggctatctgccgcaggagggatcttcctaaacatgagagaagagtgaaagagaatcagtgagacatcgggttggcattgctcaggaggctcgatgacgtttgaggatcagggctacagaggacaccccggcagaaccagactatggagaatggagccttgaaggatgggagaatctgaagcatggcccctccttatggcaccccccattgcaacatccagcaacctaattttcatcacgcacagtctttcagatccttttctccaggcttggctactggagaaggcctgatttgggttcatgaataaaaggtcaatgttatttagaatagaaatctccccagtattctcctctctcaaccactgcccccaccccccaactctctttttttggcagcaatgaaggtggtttttaatgagaagtgatcatttcacatgtaggtcctggttgcaagtaagaaatgtgaggacagggctttgctacctggacacaggggccggagcttcccctctccacccactccagcttctgcccagagactctcggggctttccccaccctgctctgggctggaggcagttggggaacggccctctccaaggccagcatcctctcgcctttgctgtctgcagcctctggttccctctgcagagagccatttccacactgactcgcggctgctggctcctggtggctgggccgtggagggttaggggtttgggaatggtgagatggcaagttgcccattcccaggactagctttgttttttcctattcagcccattctaccttagctcttgctcagaggagctgtctggggtgtggctgctgaccacaccccacacgggtcttcttgtcccgtgttaggaaatggtgagtgtggggaccctcatatgtccagagaaggagatcagggatttctagtttgttctgaagataaatgtaggatgtggacaggaggagaaaaacaggagggaaggggaaacccactgttttcttctttggtcttcttggaggctggggggtacctcagagcaaactccctggagccaagaccagcactaggctgtggcttactcttggggcctccctgcaaactccatcttctgatttgcgctgggagtgactcctccttccatcctacagcctggggtgctgctgctgctactctggggaccgggaggaggcacacggccacagggacgtttgttcgtgattttgcaggaaagcacatggccctcgggagccaggtaaatgtgttcaagctggtcctttcccatttctcaccttgctccctctcccggtttccctgggaaatcattttcactgtagctggggctcactagcgattaggaactagctttccttctttgaaagcagcacatgaaggtgagcaggcccagagcctgtgccccagtgggctagaacacgtgcaagacagggcctcacaccgtcctttctcttctttggaggccactctcccagctgtagcatcaggaccaggtgccagcgaactctggaaagaggcactgctgagagataaatgtctctcctagcgttcctctctgaagattctgcttttggcctgcactttggtggagcctgtggcatccatctttagggtagaatccagaggaatccttgtccttgaaaacgtcagaccaaagggatcaaatacaagagaaaaatgttgccaaactcacaatggccatgatggcattgagaatttacattctctcaagcctaaagaaggtaagagatcctgtaagcactcagcaaggtgccccataaatacttgttgcaatgaatgaatgagtgaatgaatggatggatgaatgggtaggtggatgggtgagcaggtggattctcagcagcaccatacccatattgtcaggaactatgcatggtgggcaaggactcccatatgatcagactggaaatgtctacacacatccttagaactgtctggccctgcacaaccccttcctaacaggggcagggaacatttcttagagggggaggaacctcccaactttcctgctgcttttgttgccttgctgtggtactataggcaacccactccatctttccttgactcaagtttgcttacactaaagtatagatagaaatacatgtgggcagaggtttggcagttacttggaataaaaagttatttacaaataccagatggctcatttagagaggatcccaatcaatgactttgaatgggatccattttttccattttttttttttagatggagtcttgctctgttccccaggctggagtgcagtggtgtgatctcagttcactgcaggctccgcctcccgggttcacgccattctgctgcctcagcctcctgagtagctgggactacaggcacccgccaccaggcccggataaatttttgtttttagtagagacggggtttcaccgtgttagccaggatggtctcgatctcctaacatcgtgatctgcctgcctcggcctcccaaagtgctgggattacaggcatgagccactgcacccggcctgaatgggatccatttttaatgtctcaatttataattttccaattaaatagtataaattcacacttcaacttgtgctgactagcagagttgaagccctaaatcttaacctggctgacactcaggattgggatgggtgctatttttaggcacgctttctatccttttcttgcctcactactcacaagtggatagcaggggcaggaggggagatagggcaggggagaaatagggtgaggggcatgtggcagctccctgtccccaggagtcccttccccgccaaggctaaacagtttatgtgtttttctaggtgtcaaatggcagtggatttcagctttgctgggctgtgccctggtttaagctttgcacactggcccagggaagtcccacactaaagcccacagatgcgaataaattactgacagtgcccaacctcccctgccaggtggcatggaggtccagatgctgacctggctgaaagagaatactgtgttggcggctcctgatgcagagttaaatgcttgttaaagaaaaaagagtcttggccgttccttttcttcctaatgtcttccacgcccccatcggctgccatccctccaggttcgggcccgccggggcctggggtttgggcagcgaggttgagagggtagcggggtgctacgctctccagagttgacacccaggcagccccaatgttgctcagtgacagcagattggttaggcaagtcctgaacaggggggagggacctgatgccctgtggctcgggtttctgtgcctgaggaggaaaggaatatggagcttgagctgacaggacaccagggagtgaaatacagatcaacacattccttccacgtgtccgggattgacacttccataacacagggagcaaagagctgcgaggatcaccagggctggctgccgtcttggggaacaagagcagaggctcaatcaccaagtaactgagagcacagtcaccccacgtgtagcaccaatttgttgctgtttggaatggacacaagtaaatatcaagggtgccctttacacacactgggcagtcacttaaatgggaagaaatgataagcttctcttgtggcccttacctaccttatagtaaatgttaacatttagtactaagtctgccatgagagctcaattcagacacaaatggggctcacttctcctagaagttcaggtctggaagctctttaggcttccagaaaggggcctaaggtgtcgtagctgcctgggggagaggaggaatcctggaagaggggcaaattttgacttctgttccctcccgtttcttaggaatcccttccttgcctctactggacctcagtgggcagctggggggcctcagctgttgtccttcctggactgtctaggcccagatttatgtgatccatgactccaatggatgatgatatcttgagagctcacctttgtaggagtgggggatggggatacccagtgggccggccttacattatcaagcggcctattatttcttaccaatagcattcttccagattaaggcttcttccctgtttatgaatcccctattaaaatgtaagtacactgggaagtggatagtaaaggaacttaagagaaagggaacctaagttggagtttagggtagagaagtacaagtagaggtgggtggggagtcctaaggaggcgggaagggccaaagacaaacttaaccaacttcacagcattgctcaggatctgccctgttggcaagtgtacagatgttttcacaggacagcaaacaactagaaattagcaattggtccacaaccataatgaaatctttagtttttttttttttttttttttttttgagacggagtctccctctgtcacccagggtggagtgcagtggtatgatctcagctcactgcaaactctgccttccgggttcaagcgattctcctgccttagcctcctgagtagctgggattacaggtgtgcgccaccacacccagctaatttttgtatttttagtagagacgggggtttcactatgttggccaggctggtcttggactcctgatctcagttgatccgctcgcctcagcctcacaaagtgccaggattataggcgtgagccaccgtgcctggctgaaatctttagttttgatattgtagtattaacatcacaaacagaagcatatatatatatatatatatatatatatatatatatttttttttttttttttttttttttttttttttttttaagagagagggtcttgctccattgctcaggctgagtgcagtggcacaatcatagctcactgtgaccttgaactcttggcctgaagcgatcctcccaccccaggcctttcaagtagctaggatcataagtgtgtgtcattacacccagctaatttttaaaaattattttttgtagagatgggggtcttgctatattgcccaggctgatcgcaaactcctggcctcaagcaatcctcctgctttggcctcccaagcgctgggattacaggcgtgaatcactgcactcagccagaagcatgttcttaacatccttagattctctaggagcaataaaaaggccctttaacttaggtaaacagacaatatattatctaacatccttctcatttaggagattaccaacacaaaaatggtctccaaaaaagacaaagcatgtaacacatcattcgtgtttctcaaaaccttcaggcaaaccattaagaagagctggtatttaagaattaatcaagcatcctgacttcagaatcattttgttctatgaaaagtcagccactgacatttatttagaaagttaagtttcaggtaactgtggggcagcttggatcttatattgcacaaaagctgctcacttacttccacatctgtgaattcaggtgtttttctaccatggagtttagtgcgaatcgaaaacgatcccatcttctatcaaacacatagtaccctcgtcccatgaggcgactcccaaatgagcaaaactgtgaggaaaaaaaaattttaattttgattacaggttaataagctaatataaactatacagagaaaaataacatttacataaaaacatacaagggcacagttttactcaaagaagcaaaccgtactgaagccaaaaatacttctgcagttctgtagtttgagctctggattttctgcagaacctcatattacaactcaacaatagctacattcaattttctgtggcacagaaggggctacgttttctacttctgggattgagccagcatttttggttaagaaacaaataatgccaggcacagtggctcatgcctatattgccagcactttgggaggctgaggtgggcggatcacttgaggtcaggagtttgagaccagtctggccaacatggtgaagccccgtttctactaaaaatacaaaaattagccaggcatggtggcacgtgcctgggatcccagctcgtagggaggctgaggcaggggaatagcttgaacctgggaggtggaggttgcagtgagctgagactgtgccactgcactccagcctgggtgacaggctgagactgtctcagagaaaaaaaaaaaaaagaaacaacaaccaacacccagggtgacttttcaggaccatctgtttgtcctattatcagccacattttctcaaggaacttggtggttccctgcttctcatgatagtaatggaaactgcttgtgctggtgtcccaggtcccacctttcctatctgatgtcaacagagccactttgcttccagccaggctaaatgccttcgtttcccagtctcgaccacatttctgcctccaatcagtctttgtaggctgtcctgggacacagcaccaccttgaagcttttgctcctgctgttccttctccctgttgtctccttccttcttctttttgtcaatcccaatttccccctctctctcctggttcccttatcaagactctcatttccagtggctctcatctgagtgatcttcccactgtgaattcccatggcacacccattgcctgctttattacattttgccttggacttatgacatggctgttttacgttatacacaggatgcctacatacctgattcgactatcagtgtatagacaggggagcccatcctcttccttctccttagtatgaggatagtaggcatttgggctaacaaatagatgggggagacagggatccacaaaatgtttaaagcacactatctctcttaaaatatgtggatgaaatattggcattcagatgtttaataaacatttgattatgatgttagggcaaccggaaggctagcagacagaaatgcaagaagcagcctcagagaaggtgacatttggctggtttagggctcaggcaagtctgcaaatgactctataactcaaaagcagctctcccccttcctccaggcctcccagcagctccctggcctctctcccagacacagggctggattggcactcattccacaaacccgtcctggaaccagactttggaacaacagttctcaggaggaaatgcaagaccttccctttgttctgtttctattggtgttttggggggtttcgcattaaaatcttatcacccatcaaatctggtactgctgatgaaaaacacttttctgcaccttcatgttaagtgcttactgaccaagcaagaaaacacacaaagggaattttccgacatagaagctggtccccggcagcatgtgggagctgttccaggtctagacatcatttcttccctcatcccaattgctaaagatgcaccgagcaagcattcattacaaacaatgatttaatgtatcaactggccatgagagaaaggacaaagcaaagacacaaatctgtggcctttccatttaaatcagcaaaacattaagggcacacagctgcgccacatcccgagtttagcgaatccactgcagcctggcaggttgtcatctggacaaatgtcttgatgtgctccagagtctggccttctggcagagcctcatatttctttcagactcaggagctggaggcaccgttttgtctttgctacctgtgtatctgattccgtacagatgcgaggctaggccctgagaggctccagttcccggctggcatgttacgcctccagcagagctgtagatcctcactgcgtgggccaccgtggcagaccctactggttgccaacctcaccaactaccacccactcccacctctctctgtcttttccttgctaacagaaccacacttttattctgatatctgacacagagcagtaatcaagtgggtctcctcccagaaccttgggatgaatcatggctggttcctcctgcgtcactgcaaccccttccttctctgctgcgaattgatccggcgggggcatgtgacccatttctggtagatataaggggaagtctgctggggttttcataggaagattttctttcctaacataaggcaacatcttggaagaagaccccttttctgtttgtccctttccaacctgagtagcacaccactgggtgaggatgtaatatcggagcagcagctgacgtacagggaccatgcgtgaaaagtagagggaattgcagagattgtccctcggctccatgacatcgtggagaagctgaaccaagcttgggagcacctgcctctacacgccctgctacgtgagatgattaaatgaccttagcgcttgtgccagatgagttgaatgttccacttctggcagtcaaaggcattcttaatcgtccctattttctgtactaaacaagaggcaaagtctcaggctgatggtgagccacaggtaagcattatccccaggaaaggaagtgaacttggccttcgttcatgacatggataggagggaagagggattcactcgatcttgatgcgggaccaggatggatttcacttacacagtctagagacagagctgatcctgcaggactcaggctggcaccagagtaaaccaccatggggtcccatgttctaggcccctgcatttggctctgcaatggcagcaccaggcattccctcctcaagtgctcgtacgcaaacaataaacaagcctccaggggatgcctcctgtgaggtgggaaactaaggtcccacctcagtgtcaatgaccttctgaactgtcagtgtgcactcattcaaggaaatggaaagaaagtgcccttcttactaatcagcaatcatggtgacctgaaatgcttcctctttccttcaacacacacacacgctcagttctggtgccatatggtcacacaacagtaacacttagaaccaacaggggagaataccaacaagggctggcccctgacacgctgctaagacagtttccagagtaggtgaaccgagctaaccctggacatcagaggctccgtttttagatggacaaggccagagggtcagctcctgagtgcacttacagaaacactatttctcacgcgtgctcgcttcaaagcgggccataaatactcgggattatccattttttccccttttttctttttagtagtatgtggaagtacttgggattataataagctgggagcccattcctttccttttgtaatgttcaagggtatttctaaggcaatcattcaaactcatggtaagcctttttgtaaaacactgcgcaggcagccttgccttaggaaggatcatgcctctggtatgatcacctaagtgtctgcaaagcacaggcgaagaacgcatggcaaggaacggaaggaggcctaccgccagaggtctggggtggtgcgtggagaactgacagtctagcttctcggattcgtcggctccgtccatctccccttcatcactggacagtcggctggcgaggtcacctccaaccggtgggagtgggggctctggagtgtggccgctatgatttgaagatgtgctgctgcttatgctatttgcagatgatggtctaagggcaagagcggagaacaaacaaaataaaccaaatgaaccttttctgaggtaacaagatccacccagtttaatggtgctcagaaaacagcctgattaaggccaggttcggtggctcacgcctgtaatcccggcactttgggaggccaaggcgggcagatgacgaggtcaggagatcgagaccatcctggccaacatggtgaaaccccgtctctactaaaatacaaaaaattagctgggcatggtggcgcgtgcctgtagtcccagctactcaggaggctgaggcaggggaattgcttgaacccgggaggtggaggttgcagtgagccgagatcatgccactgcactccagcctgggcgacagagcaagactctgtctcaaaaaaaaaaaaaaaaacagcctgattagccttgccagtacctcagggagggcacattggtggtgactttgcataagggaaaacaatcaaggctgaagggtttgcagtgaccagctctctccagtgacacagtcaagttaggttctgccccacttgttgtccctggcgcagatgacaggaatgatgggaaagcccaacagtgtaagtggaacatgagatatgggaacgtgacaaagtgaactgaacctacaccagtcttctatgaattcagttacaactattcacccatttgcaggtaagtaagttgtacttgccatacagttgctttcctttgaaagtggaacctgacaggaagatcaaccaggtaaacaagatcagggcaatcaccaaaaatatcagtaatgaagaaatgcagtcctatgcatacgttctttgatacaaagctatgattttaggaaactgttatactggcatgaaaaaaagttttgtcctggtgatgggccactcattagtaccttactcggcacccatgcctgttacttaatattaagttgtagtttaattgtattttctgaggatgagtgtttcaatttacatttatttatttatttgtttgtttacgaaacactctcactctgtcgcccaggctggagtacagtggtgtgatctcggctcactgcaacctctgcctcccaggttgaagcaattctcctgcctcagcctcccgagtagctgggattacaggcgcacaccaccatgcctggctaatttttgtatttttagtggagacagggtttcaccatgttggccaggctggtcttgaactcctgacctcaggtgatctgcccacctcagcctcccaaagtgctgggattacaggtgtgagccaccgtgcccagcttcaatttactttttgacaagcccttttacgcactgtggggcatgattggctcatagtaggtgctaaagagatatttttttcaatgaaccaatgaatgaattctatgtgtgtataaaacaacccaacacatgtcatcttaattatggttaagcttataaaaaagcaatgtcacaataagaggtagaactacctgcttcctaggcagtaaaaaacaaaacaacacaaggcaaaaccaaaatcaaacacatccgcattagcagaagagttagatgaggaatagtcacagttaactgttactagcttttactacttctccactttcatcaggtgattgagcagggagaggtgacaaagatagggagaaaaagaagttttagagaaaaaaattgtttttctgctttctgctttgaaagctgctccttcaagtctcatgaagcagcactgctgatctgtctcccttttctcttattttcaccctggatactttgttgctttgaaatcttttcaggtctcaaatacttgaacttaaaacagagtccaaaagtatagtcacttaaaaacaaaaccacaaacgtgaaaacaacccaactgtccatcaacagatgacaagataaaatatggtatatccattcagtggaatattatgcaagccttaaaaatgaatgaaattctgctactatatgaatgacacttgaaagcatcacactaaatgaaataagccagacacaaaggacaaatattggatgattccacttacatgagatacctagacagaaagtagaacaagagttatcaggagttggaaggagcggggaatagggagggggtatttagtggatatacagttctggagatggatgacagtatgactacacaacattgtgaatgtatttaatgccactaaactagacacttaaaaatagtaaattttgtgttatgtatattttactataaaaacaaaacaaggccacatgtagtttttcagtgtcataagaattatgttgggatgacaatttatagtggactatcaccttcctgtactataaaaacaaagctgccattcattctgcgtgtctacaggccaaagaacgcatctctcccgacgttcctcaatacctgttcttctgtatcaggaagagcaacaacactattgtctgcttaccgctgaagacccaaataataaaacaatttagatgaggctgaaacataaaaaaaagaaaaaaaaccagtatccataactctgccacccaagatcaagtgttattagcatttttatttacatccttccagacgttgttactgggcacacacatgcaaatgcattttaaagcaagaactggatcacacgatcacccggaacatgaaatgtgggtagtacatactattttgagagatgctttttaaaaaacctagtgatgttgtggacgtgtttccatatatagaactatatcattttaaatattccccagtaatccatagtatgaatatatcacaatttacttaacaaatcttctgttgatgaagatttgtttccaaactttctaacaggctctctctctatgaagccctctccatcatgataggacctccttatcctgcaggagatagattaaaaaggagctggattttactaagtgtgataacagcatcatggttatatagaaaattgcctttctttttctgtatttatttttaatttttagagataggatcttgctctgtcacccaggctggagtgcagtggcatgatcatggctcactgcagccacaaactccagggctcaggggatccacccacctcaaccttgtgagtagctgggcttataggcatgtgtcacagtatctggctaattttaaaattttttatagagacagggtcttgcttatgttgcccagactggtctcaaacttgtggcctcaaatgatgctacttgctcggcctcccaaactgttgggattgcaggtgtgagccactgtgctaggcctttttttttttttttagaaagagtcttgctctgttgcccaggctggagtgcagtggtgcgacctcggctcactgcaacctccacctcccaggtttgagcaattctcctgccttagcatcccgagtagctgggactacaggtgtgcgccaacatgcccagctaatttttgtattttaagtagagacggggtttcaccatgttggccaggctggtctcgaactcctgaccttaggtgatctgccctcctccaccttccaaagtggtgggattacaggcatgagccaccacgcccggtcctgtctttagtttttttttttttttttttttgagatggagtcttgctctgtcacccaggctggagtgcagtggcacaatcttggctcactgcaacgtctgccacccgggttcaagcgattctcctgcctcagcctcctgagtagctgggattacaggtgtgtgccaccatgcccggctaatttttgtatttttagtagagacggggtttcagcatcttggccaggctggtcttgaactcttgacctcgtgatccacccgtctcggcctcccaaagtgttgggattacaggtgtgagccactgtgcccggcctgtctttacttttaaaagatgcatttggaaggcgtctgaggtgaaatgccatggtacttgcaatttacatcaaaacatatcatcaaaaaatgtagatgaagcaaatataattgcaaaatattaataagtaactgttaaagcaagacctgtaggtgttcaatatactattctctctacttttctatacatgggaaaaatttcataatgaaaaataggaaaaacaaaaacaagaagaaaatagagttagtagtacaggtatatgtaagaaagttattaaagaacttcctattttttggtattttatttttcttcggttttactgaggtataacatcttacacttataatacataaataaaattgtgtggccgggcgcagtggctcacgtttgtaatcccagcactttgggaggccgaggcagttggatcacgaggtcaggagatcgagaccatcctggctaacacagtgaaaccccgtctctactaaaaatacaaaaaaaaaattagccgggcatggtggcgggcacctgtagtcccagctactcgggaggctgaggcaggagaatggcgtgaacccgggaggcagagtttgcagtgagccgagatcgcgccactgtactccagccggggccacagagcgagactccatctcaaataaataaataaataaataaataaataaataaataaataaataaaattgtgtatatttaaggtatacaatgtgatttggtatatgtgtacactgtaaaatgattaccacaagttagctaacatatgtcacctcacagttaccgggttttttttttttcccatggtgagaacactttttatttttattttttagagacacggtctctctctgcctcccaagctggagtgcagtggagcaatcactcactgtattcacaggaactcctgggcccacaggatcttcccagctcagcctccctagtagctgggactacaggcatgagccactgagcccagtgaaatttgcttaagatctacttatttagcaaatttcaagtacataatacagtattattaactagagtcaccatgctggagattagatcccttgaatgtattcatcttgtaactgaaagttgtctagtatctccccatttctcccaacccttagcctcaaacaactggcactctactctctctgtgaatttggcttttttagattccacctgtaactgaaatcatacagtagttgtcattctctgtctgatttcacttagcataatgctctcaagttcatccatgttgttgaagatggcaggatgtccttcttcttttattgttaaataatatatataattatatattattttttatatatatgtattattattattattgttacttatttattttttttttggagatggagtctccctctgtcacccaggctggagtgcagtggcgtgatcttggctcagtgcaacctccgccttctgggttcaagtgattctcctgcctcagcctcctgcgtagctgggactacaggcacctgccaccacgcccggctaatttttttgtatttttagtagagatgggattaagccatgttaaccaggctggtctcaaactcctgatctcaagtgaaccacccacctcagcctcccaaagtgctgggattacaggtgtaggcctccgtgcccggtcttattattatttttttttgagacacagtctcactccttcacccaggctggagtacagtggtgtagtcttggctcactgcaacctccacctcctgggttcaagtgattctcctgcctcagcctcccaagtagctgggattacaggcatgcaccaccacacctggctaatttttttatttttagtagagagggggtttcaccatgttggccaggctagtcttgaactcttgacttcaagtgatccgcccacctcagcctcccaaagttctgggattacaggtgtgagccactgcaccaggctgaaatattatatatatatatctgcattcatccctcaatgaacacttaggttgtttccatatcttggccataatgctgccatgagcatggaaatgtgaagaacttcctgttaaacagggcagatggatcacacatatttctctcttctctcttccaaaatcttactaaaataacagtaaagagataaaaaaggcattagctttaaagaacaatgagatcagcagaaatgtggtgatacttacgacgatgacttcctaacatccatttaactcctaaaccaataataggaatctctcattttgcttgctaatgattggtttagaaaaggacatgagaaattttttaaaaaatattttttggcgtagagggcttttggaatgcttttcctcacttttaaaaagaggcatccagtctgggcaacatggtgaagccccatctctacaaaaaatacagaaattagccaggcatggtgacaggcacctatagtcccagctactcgggaggctaaggtgggaggattgcttgagcctgggaagcagaggttgcactgagatcatgccactgcactctagcctgggggacagagtgagaccctgtctcaaaaaataaataaataaataaataaataaataaaagagacacaaggctctggtgggggatgttgatagtggcggagggaggctatgcatgtgtgggcaggaggtatataggaaacgtgtaccttctgctcaattttgctgggaaactaaaactcctctaaacatgaagttcattaagaaaaacaaaaacaaaaacaaaagagacacacaggaaaggtggtcttcagcttcatctggaccttgttatatctgcatgtgcctggaattgctacagtcattttgctataggactttgaggatgaagccaaaagactgaagagggtggaataaaagaagggctgtgaaggcgagtcaatctctgatggttgggggctggtgctcctccacctctggacctcatgtagcatgcggtagtttcctaattatttaaatgtatggtaatgtatgttttctgctacttgctcctgaagcatcctaactgatacaagcatatgagattttaacattaagaaaacaggatgtggctggagaagtattaactaacgggaaaggaactgacctactatagaacctccaagaagctggccacctctaggacattcctagagctgcaaaagtcataggtgaggtgaggactaaatacagctcaagagttaaaggtcttaatacatggcaagtggacctaaaggtcatgtctaccaccttacacaaccagatgatgagttatcaccatttctgccaggacaccctcttctgtaccccagtaaactttctggagtctcgctttgttgcccaggctagagtgcagcggtgccatctcggctcattgcaatctttgcctcctgggttcaagcaattctcctgcctcagcctactgagtagctgggatcacaggtgtgtgccaccacacccagctaatttttgtatttttagtagaagcagggtttcaccatgttggccaggctggtctcgaattcctggcctcaagtgatctgcctccctgggccttccaaagtgctaggattacaggcatgagccattgcacctggccaatgacaataaacttgctaacaagagagcaaaggtttacttgccagagaagttgaactggagagattctagacacggggccatcaggctcagcgcagagtaggagtgaggcacagggctggacacagtggaactgcgggccatttctagtcagggcttccagattgcctattgccaggcacatcaccaatcaggtttctatctttgagaaactgaatggccccagagaaggcttccagatcttgcctttgggaatcctcaaacaaaaggctgagtggtgatcagacaaattttggtcgacaacctcacacacagacttccaattaggctgttagagcctctcttccaaatgtgcatggttagggatggcccaacactgctggagcatccccagtgtgagactgcccaaccaaacatcaaagacatgaacagaggaaggaaacaaacctggaaaaaactaagacgatgatggaaagagaaaaaactaaaaaacttatcttcaaagatattaggatgttattacctctgaaaaacgatagtatcttgtggtaaacaaccagataaagagaaccagatcctaaaaaataggaaagcatcataaatgatttaaaataccatttttgaagatacagtcaaagaaaatatttcagaaagtagaacaaggagagtaagagacaaaaagaggtaagagagctaaaggtccaacatccaattaataaaaagtcaagaaagaaagaataaagacaatagtggggagaaaattatccaagatgtaacacaggaaaacatcccagaagaggataagtatctccagattgaatgagctactgagtacccagtatgatgaatgaaaatgagctacatcaagagtgatcagctgagtgcagtggttcacatctgtaatcccagcactttgggaggctgagggcaggttgcttgagcccagatgttcaagatcagcctgggcaacacagcaagaccctgcctctgtaaaaaaataaaaaaattagccaggggcagtggcttgcacctgtagtcccaggtacttgggagactgaggtgggaggatcatttgaacccaggagtttgaagctgagataagctatgattgtaccactgcactccagcctgggttacagaatgtaatcttgtctttaaaaaaaaaaaaaaaaaaaaaaaaaaagaagaagagtgactattgtgtgaactttcagagtccccagtcttcagagaaaaaaaactggacgtgtgcaaagaaatgataatcagaaaaatattaaacttcttgataaaattttcaatgttacaagtcaatgaaaaaatgtcttcaaaattctgtagggaaatgattttcaatccagttatatactcaaatagattatcaatttaagtgtgagagtagaataaaaatattttcaagtgtgcaaggattctaaatattgacctcccacaaatcttttcacaggaagctaatgaaagaggtacttcatcaaaatttaaaggcacaaactaagaaggaggcagtcacttggatccaggaaacaggcgcttgaacacagaaagagcaaagacatgttccaggatgacaggaactgttttcattctaattatttaagcacagtttaatttttgaactatgtgcctatcttactctgatttttaaaaatgcaggctgggtgcggtggctcacgcctgtaatcctagcactttgggaggctgaggtgggtggatcacctgaggtcaggagtttgagaccagcctggccaacacggtgaaacccccatctctactaaaaatacaaaaattagccagcctatggtggtgggcgcttgtaatcccagctactcgggaggctgaggcaggaaaatcgcttgaatccgtgaggtggaggttgccatgagccgagatcaagacactgctctccagcctgggtgacaggggggagactctgtctcaaaacaacaataacaacaaaaaaagcagtgtaattaagaagaaaagtggctgaaacactctataataagttccagttgccagataaaagagaggaggagatgagtggaagattcctggggagtatgctgagtgtggaagctgtgctctagcccacaaaactggctgtgggagcaaagggagaaacagggacacatgacggtgtgctcgtgtgtgcacacacaccaggaggagggagttccgcatcatttcctttttgggctcatttccctcagggtgcatgcagcctcctggaggtgatatagtggtggatgctttcaggaccttttagctctgattgctgcactccagggtgatacctggtgggaaggagttcactggaaccagcttgggtctcggaaaagctgaggagtgatagggaatggggcaatgagccacaggaaggtgttgacacagtcacgcaagtttgtttagttgccgttcactgtttccccctccgtactacatcacccgtcccctgtctgcccgccagtctggtctaacgtcaaagcataggatgatgggtcttgtccagttcaactcagggaaatgcagagaaaatcccaccttaccactttgaggaagcagagcatcagtttgtctgagcgcattagggaagagagcagaaggcaattgaccttgattcagtccttaccatttgaccttaattcagtccttactatgtgccaggcatgaaagtacatttcttattccagccaccttaggtgagtaaactagtatctgcctttcttagatgagaatttttttttcccttttggtggaaaatggggtctcgctatgttgccaaggctgctgttgaattcctgggctcaagctactttcccacttctgccttcctaaatattgggattacatacgtgagccactgcgcctggcctcagatgaaaaaaactattataaagctaataagaaatggaggggttttgtgcctgtctgtacaacctcaaagccccccagactgagaaacagatgtagaaacagcacagggacaaatatataagaaatcagggagagaataaggcggggtgcagcagctcatgcctgtaatcccagcatttggagaggccaaggcaagaggattgcttgagcccaggagttcaagaccagcctgggcaacatagtgagactctgtctctacaggaaaaaaaaaaaaagagaattggcttgcagtgtggcaatatcactatcctaatgacatacagaacggaacagaagttgcttttaccccagactcatccctgccctttgtcaggaatctaagaccttctgcctgtctccacactgccctcgtcagtctaagattagctaagtttgcccttttatactttagactgcatgtgtaagcatctatgagacagaggggactgtgcccagattttgtggcaccagcttcctgcgggctctcagcctggcttgtcagatcccagccctctttgccctttccaacagtcctggtgggtttggctgggctagtcatccacaaccctcgggctttttggagcaagcaatgtgttcctttagagttggaggcgaataaactgaacatatgagtgtgttattccaggcccctcgggctgggggcagaagcacggagggcaggcatatggaaaccaggcagtgtcaaggccggcattcactgcctttgccttcctgtggagtgcccctcccactcactaacagctaccatccatggactgcttcttatgtgcttggtactttctcacttcactctgattagctctgttgtacagatgagcaatctgaggtgagacaggctaagaaccatgaccaagcttacctagttggtaggcacggagttgagatttccacttcaaatcccattccaacccttgttatctaactttaacttttctaattctagactcaagttccttttttagcaatccctgacaagaatgggttgcaatgtaagaatatgagaactaaaatattttcaaggttaacgaaaagatacgtatgaaataaattcacacacgttagcatttcccacaaagggaattcacaagtgggaggggatgacaataaattccattcatgtgcgatagtttttttttttttttgccaagtacagataatctgtgtagatgaaacatctattatatatacatcaatatgagtaaagcaacgtttttgtaagttttgtgtgattacaatattcaactctgatcatgcctattcaatctttaattgcaggggatcttgtcctaaactaagtgcaggacattttcctgattaactttggaaaagagctcacccctgagttttctggtgcctatctcaatcttgaaaagcatcctcaaagatgactctgtgggccgggtatggtggctcatgcctgtaatgtcagcactttgggaggccgaggtgggcgaatcacctgaggttaggagtttgagaccaacttggccaacatggtgaaaccccatctgtactaaaaatacaaaaattagccaggcatggcggcacacgcctgtaatcccagctacttgggaggctgaggcaggagaattggtggaacccgggaggcggaggttgcagtgagccgagatcgcgccattgcactccagcctgggccacggaatgaaactctgtctcaaaaaaaaaaaaaaaaaagattctgttaccaacctgtgtaatgtgttcctctgccccccccacccccacttcttttccagaaacattcttttctctgattaacctcacccatcctttcctgcttccttaacagaacacaaacagctggcatttctctatagatgaacattcccctgaaaattaaacccaaaaggaacagtcggagcagatccttcaggctccactgttttattctttaatggctgctcccttctttctctgttaggccaggtaccactgcttggtgagaagtgcctccatcagtcaaaaatagatggagatttgtatagtcaaagaaggctttcaaactgggttccctggagtccttggggaacccaaggatatccttgagagggtgtgggggacaatggctctgggtacatgtgtgagcttagccggcttcaggtggaggcaagtctactttcctatcaggtacccataataaggttgtgctggaatgaaaatgttcgatagctacaaagaagtttaaaagtcgctgtatatacaattgaagccccttccagaagtttggaacggaattgttgcctcaactctaaaacaagggtaatatccctaaccaacaccccacatgacagtgagaagtcattataaaatgatcttgcaaagtgaggggtggccaggaaagtagcatgtcaacggtgacagtaacgccacgatggtgagcatgatggaagtgttggggatggcaattccatctgaccgcgtcctcctgaatgcctgaggctgagctcggccataatgacagagggactctggctgtcaaactaggtcaggcttgcaccaacatggaaggcatcagggtgagagcctggcagatcaggagccactgctatcaaatatttgtttttgctttaaaaatcaactccctccccttcttttacgactatgtcctcttaaagcctatttgctacccgttgagattcacactgtatgcataaaaaacatcagataataccgttatctgcacttctcactgagtattattaatgtttcctttttataaaaattatggatacttgtacctcattcttttaaactctaaattcctgaaaagcggggtctagcttcattaatctctgtacccctgcctgagagtacctaacatggaatcttgcttatggagcgagcactcaataaatatttttgaataagtggttctctgtcgcattatttgggaattgagcttctgcccatcaaaatggacatgcatggattttaaattacttttaatccaaatgagtgttaattctgttttctattttttcatttctgtccaggacaaccacatagaaccccaaacaggtggcccagaagagtagctttcctggtgtggagagacatgtaaggacaaacaacctctgctatgccaatttcccctttcatcctgatgataggagagcgtgcaaaacaaatatcgtggcaactggactagcatggtgcagtgagcgtctaagaggtgctaacgacctattcacctgggtttccctactccgctccaggaatcgtcaactaatataaaagcccaggcagccaggaagtcacctggcggctgatgtgtcacagtttcaggtatttatttccagcttactcttgctgtgtaaaaacacacactgtctgatataagatctgcttgtctgccatgaagtccgctgctgctgacaatgatgatgacagtgatgataataatgatgacagcagtaaaatctgttgaacactatgtggcaagcactgggctgggcctcttatgtacattatctcatttaaactttactacttgccttaggaagtagtactattatgatttccatttaacatataatcagaccacatgccacagacccagcaagctagtcacttgaccaagcattcagggcttctatcgtcaaggtggtacttacctaggaagtacagagttgggtggtctggattttgcaggggatgcaacttttggttctggcccagagctccctgaagaccctagcagagaatcctgtgccggcccggattggcttggaagtatttccctcgtggaagtcaggagatgctctttatctttaacttctttttcccgggactttgctttgtgttctgccaggaggaggtcaaattgctttttccggcctgggactgccctccgatggcttagcgaatgtgtctaaggagaagagaaatgaaaagcacagcctctttgatcagcacataaacctgcttccccaggccctccatttcagaaatagcaattcatggaaatttagaggtgcttgaaaagtcaacttcaaggcaacagctcctgttctgtggctaggaagaggcagagaccacacgaacgcaaccatgccctacactcctggtgttaagaagccaaagcttcctccaaaaaatggcataggatgacgagcttcagcgcagaacccatgaaaacctctctgatgaaaggcaactgcgagggaatgctagagttaatccaggtgcaggtgggaggctcgattcggcccagacaaacagagccaccaagcagagagggccatcgccttgatcccaagaagcactagcagttcagcatgaaatacagggctttgggcgacccaatggcggccgccttgggtcagctgttcccctggccaccccggtgtggctggatcaggggcgcggcatatcatcctcccctccagggctgcctttcagggcgctgccgccgccgccgccgccgctgccgctgctcctgcatacattaaaacgtagcaggctttagaaccgcctgtgagtgcctataaatacaatttactgtctggcctcacaagtaacaggggaagcctagtttttttttttttttttttctccttcttaaaaagccagccagcttgaggcaggcactctgctaccatggacgagaagaaagcatttcccttacaaagaacagctgggggtcatgtcgaggttccacaccctgccgtgtgcagagagtggcatgcaaacatttcgacaaaggccccagcgagagcaggaagtattttttatggaaagagaaataccttgcaggtgagggatcttgtgcaaggtttctttgtctcgggatccaatactccacagtgtttatttgggtcaaattctctctctggtttaagaaacaaacaaaaaatataagaaaaaaggagactaaataggatttggcattaagactacattttttaaaaaatgcacatttgcaccaacaagtgagacattgtcaggcaatctgttttttgtttttttgtgttttgttttctcaaccagctgctaaaagtcttccagaaccgctcggggaaaatggtgctcccctctgaacccagagttcccaagtctagcttcggcagcaccgccgaacgcagcacaaggctcggggaatagggcgggagcaggcaccgaagggaaggagaggagccgtgctgctcttaatgctcttaacgctttattttacttgcaatggttccacaggtccttggcatttgggcatagctggctgcagaccagggagagccacctgagacccaacgacccctttcctgggctgctccaagagtacagacaccctgactccagctcctgccttcctgctagttttagccatgtaaatgggagattactccttgacatgtcagagtgacctgcctctctcatgcttgacaaagctctcggcgcaggctttgcacacagccttgctgaccacaaacaccatttacctgattgaggggcactctagcagtgttacaggcaggggcaggggagaaggctgaacttgaaggtgcagagagggcaggggcctgctaatctcacagctgctccccgcccccactgccctgggtctgatgcttcacgtgggaataaaacggggcaggctgccccaccaggatgaaggatgtctgtgcggagaggccaggcttccccagctcctgccttccagttgactgtggacagcttgtgcggaggttacttctaaggagcctgctctttctatacccatcttgggtccttcacccctgccaggaagacaatcatgctgtcctcaccttaaaaatgaggggatgtgaggtgatctctttttttcatttttattttttgagacagggtctcgctccgttacccaggctgaagtgcagtggtgggatcacaaggctcactgcagcctcgacctcctgggctcaagcctcaacctcctgagtagctggaactagaggcatgcaccaccacacctgcctgattttgttattttttgtagatacagggtctcactatattgcccagggtaggtgatctcttaaggatcttttgggctttaaaattccacctcttggatggcctgtgccgtttctggaaggcaccgagcaaacacataagtcctgcagagcaggaatgacacagccctctgggcatgtgggtagactggcagcagtgttgctggtggtagagggtgtacagaaattggtggtatctccttaagacccttgaatggctgcaaactcaaaaaaggttcctagctggaaaactgtctgaaattggtggagtaaactccgagcatataacaatgctcagattataccataataaatgaatgtattctattttcaaaagctttgagggtcatggggaggttgcaatggtgttactgatgatatgcacaagaaaactactctatacccaagacagattccctggctggttaccaaaatgcctcccccctttttttgctttttgtctgccttttctctctctctctctctctcttttttttttttttttttttttttttttttagcttcacttagaaaaaaaacctgctaggcctggagatgctggtttgctcggagccctctctggccaggctgcctggtgtggtgttttttttttgggtctgtcagagtcaggcctgtgcctggtcccacaccagcgcctcatgtcgacctggagctgagcaggctgttggctgagggtaggagctggctgccaaatgtgaaagtgaggcagaaacaagcaaaagacccgacgaaacaagacaacccacaaaatgcaaaaacaatgtgcggcaaaaaaatccccagacaacttcagatggggttacaggctggaagccacggccgtgcttctgctatggcgaggagccctcggcctccagccactgtgcccacgcctaccggttttctggggatgttgccaccacctctgaagagtgaaaccaagctttccatgcaggaagagccaggtgctgggggctcccgcccgaactgtgaggcccacagtgcttagggagagcaccaggctctacctttctttcttgacagtgggtgagcagcgcaggcagagatgtgcaaggtacaatgcctgctttatccgaatgctttgggcttgagggatttttcagacataattttaaaaagagttacagatgaaagatagagaaactagaactacagacaaatacagagtagacaataaaaattacccacaattccttgggtgcttaaaaatcaagcttaacccgaggacagtttctctgtcacagggtggctgtcactgtattttactttctctggccaccatcagggagtgcccatgatgtaagaagaagttatgaagtttatagcttctcctggtcttttggagaaagtaaaaactgccacgtttagttctacagcagatcgatccaaagcaaacattacccacataggggcctctaacaaataaccatcatcctgtgtgcctcttctggcaccccaagtgtctgctcagacaaccaaggagtagacccacaagagaccgccccagcaccctatcggcactgccagccctactgttcctgtttgggaattccaacctgattatgggggatcgacagttgtaaactcaactgcagaattaacctggaaactcccgaggccaaaggacagaggctgtgtgtccctgtgcagcacagctgttggcggggctgtccctcacatgccttgaggcaccatgagatccctgtgtgttgtccagcttcccagcagtgaagcttctatggaagccagggctagttcaacctgtttgtatgatacagatacacagaatcacctgctcacaagaccctcggaatctacagagtaggtcggtgcagagcaccctgcctcctgggttgctagggtaactcccgctaagcactgaactgagtgagggacttcatctgcccggggaagaagagacctggttttcccttgcatttttaggtggggttcctgtttgcaggtaaactctgcatcccccttaaaatgaaacagacctgcttaatgataacagcacatcactccttcgttatggctgcgactccctttcagtctaatcatgagtcagaccctgacgacactgacacatacctgaaagtctcctgtaaggcttgttgctgtttttggtgccattttggtgtttcttgtctatggtggttggcagaattcctttgccatttaagatcttctctggtgaaggtggcactgacttggacatcaggacaggcttaattaaaggaggggtggagacggcagaggacgaggtggaggaggcagaaactgcagtagtggttgtggagttcattttgacattggcaccatctgccttcactaggttaggaattttctctaaactgactacaggaactggaacactgaaaaataaatgaacaaacacacacaattgtcttctttgatacatctagtctgctgaggaaccatacccgcttatcattatcagaacatttccttatcacttatttatactccttctataagcaagcagcatgagtccagttttgatgggagagagttctgtgccctggaaaggatcaacagggggtgcgaggctggcacagtgtcaggggtggcatcagggctgactgattaccgcccgtgctgagctgtccccatagatcctgcaactccccacttcccgggccctataggttggccatttccaacacagcaccttgggcagaacaaggcgcctgttgtgaagctcaggaagagataccgtttgtcccctgaagacaatgtgccactgctgaatcacgccccctccccccgctgctcagctagtcccccagcccggcccggatcgggcctgacatctgcttagctccggagtgctgacaggatcacaccacaaggaggcatggcttcaggccagcgtgctgcacggcgtgctgtcggacggcttctggatcactctcacatcctggggatgggctcaaattgagtgagccgccatgtagcattatccaatattccattttaggcagctagttatgtaaataggcaattctcaaggctggcaggtgaaaggatgaattttaagaaggcagagcacaaaggtgtgcttcactcttcagaatctgtcaccttagcccccttccctgctatttctcctgtatgggatgtgcatttgatttctcttcttctttaatgctgaaggacctgcgtctggggggctgtggagaactccatctctgggtcttaaaagatgagatgaataagctttgctttggtccctgagctagattccctttcctcctggcaggagggaagaatgctaacatgggctccccagtcatctctgagctgagagtgaagcctacttagctatttgaatgccaaatgatctagaatatggcttttacattcctgcagacaatgtagggcaggaaagaggggctgtttttggcaggaaaagaatcttatctgtccacatggctggctggctggctctcctttctctaagattcattcacagattatttctttgatcaacttgttcatgaaattattttagccccctctcagcccctgccccttttatgactctgaaataggatcccagctgtttgttacagatctttgccagcgagaagggcacagagcagcggaacagattgtggctggacattaccgacttctcccttggaccacgtagcttcttggcctggggaagggtgacctggggcttcaagtcccatgtgaggggaaactagaatgacagttttttgtaacaaaccctgccactgccaattccgtccctgatcagagtgtctcaatgtctgagatagagctgaactgctgctcctttctatttaatggcaattctcaaagcactcccatatcactgaagaatggcacaagaaaccctttgagagtgagcacaccaagatgctagacaggtattacctggtgaaattagtgctgcattcctgatttttcccaaatgataaaaagatgcaaagcaatgtgatacagaattcttctaggcttattccttgacacatttaaaaagccacaagttaagaaatcagggtcctgaagagagatctgtacacccatgttcatagcagcgttattcacaatagccaaaggtggaggcagcccaagtgtccatcaatggatgaatggataagcaaaatgtagcatcattcagctttaaaaaggaaggaaattctgacacgggcaggagccttgaagacattatgttaagtgaaataagcctgtcacaaaagacaaatactgtataattccacttatatgaggtacctggagtagtcaaattcatagagacagaaagcagagcagtggttgccaggggatggggaagggagaatgggcagttttttttaatgcccgttgaacaactgtatagagtttcagttttgcaagatggaaaaaaaagttctggagattggttgcacaacagtgtgaatgtacttaatactactgaaatgtacattaaaaacggttaatatggtaaattttatgttatgcttattttaccacaattaaaaatgttttacatgtacaaactaaaaaaaaatgcaaattacaaaactcttacaacctaaattatacttcaataaacctgactttaaaaatacagatcagaggctgggctcagtggctcacacctgtaatcccagcactttgggaggctgaggcgggtggatcacctgaggtcaggagttcaagagcagcctggccaacatggtgaaaccccgtctctactaaaaatacagaaattggccacacgtggtggctcacgcctgtaatcccagcactttgggaggccgaggcaggtggatcaccaggtcaggagatcaagaccatcctggctaacatggtgaaaccctgtctctgctaaaaatccaaaaaaaaaaaaaaaaagaaaaattagccaggcgtggcagcgggcgcctgtagtcccagctactccagaggctgaggcaggagaatggcgtgaacccaggaggcagagcttacagtgagccgagatagtgccactgcactccagcctgggagacagagtgagacgccaccacaaacaaacaaacaaacaaacaaacaaacaaacaaacaaacagaaattagccaggggtggtggtgcatgcctgtaatcccagctactcaggaggctaaggtgggagaatcacttgaacccaggaggcagaggttgcagtgcactgagatcatgccactgtactcccacccgggcgacagagcgagtctctgtctcaaaaaaaaaaaaaaagtgtcagtggccagttgtggtggctcatgcctataatcctagctctttgggaggctgaggtgggaggattgcttgagcctaggagtttgagaccagcccgggcaacatagcgagaccattctctacaaaatagaaataaaaattagccaggcatggtggcatgtgcctgtagtcctagttacttgggaggctgcaggtggatcgcttgagctcaagagtttgaggttacagtgagctaggatcatgctattgcacagagcaagaccctgtctcaactcccccctgaccccactggcaccccccaaacccaaacatattggccaggtatggtggctcatgtctgtagtcctaggattttggggggccagggtgagaggattgcttgaggccaggtgtttttttgttttgttttgtttttgagacagtgtctctgtcacccaggttggagtgcagtggcacaatctcggctcactgcaacctcggcctcttgggttcaagtgattctcctgtctcagcctcccaagtaactgggattataggcacccgccaccacacttggctaatttttgtacttttagtagagatggggtttcaccatgttggccaggctggtctcaaactcgtgacctcaggtgatctgcctgcctcagcctctaaaagtgctgggattacaggcatgagccactgctcccagccgaggccaggtatttgagaccagcctggacaacaccgtgagaccatgtctctacaaaaaaaaaaaaaaaaattataaataagctgggcacgttggtggacacacacagtaccagctacatgagaggctgaggtaggagagtcacttgaacccaggagtttggggctgcagagagctaggattgtgccactgtactccagcttgggtgacacagtgagaccctgtcttggaaaaaaaaaaaattagaagaatctgttctgttcaaaaagatttattgatttaatttctcacccttgttctgatctgttgacttttatttctttagggaaaaaaatcaaacttcaagtgttgatatgaacacatggacagctagcaagaagagaaggtgctctagtacctgggcagccttctctgatgtattaatatttctttgtgaagccaagttagttcaggaaaggaaattagaacttgcaagttccagatctagttcttgttgcatgagctggtacgagttaacataacgcctctagtttctgtgaaaaatgccctatgtagatgttaggtcctcaggccttcagcagacaaagatatgatgcctgggatagaataatccagagcaattgtacaaatggaaatacatttaaaaaaccggctgggtacggtgactcacgccagtaatcccagcactttgggaggctgaggcgagtggatcacctgaggtcaggagttcaagaccagcctgaccaacatggtgataccccgtctctactaaaaatacaaaattagccgggcgcggtggcacatgcctgtaatcccagctatttgggaggctgaggcaggagaatcgcttatacctgggagacggaggttgcagtgagctgagatggcgccattgcactccagcttggcaacagagcgagactccgtctcaaaaacaaacaaacagcaaaaacaagccaagcagccctcaaatgctcatagcacagtctgcattactcctctaaagtcaacgtcaggctctgaatgtgctccttaaggcagccccacgagcacaggtgcaccaggtcccaacatttggaaccgtgccagttgactcatctctttggtgacacttcttcccaactgtgtgtaactgagcttgggccaggccagctaatgtctgtgactgtctcctaatttggaattttttctgctttataatgagtgtggcccaatcatactctactgtcaatgattccagaactcagctggatgcgaaattggagcccatcagaaacaggaaagacagcctcacgtgcagtcctctggattgaagaatgggaagcattggggaaaaaagtctgatcaagaatgtttcaaagatttcaaagaccaggtgagttggtaaggggctgggccactgagtgaacacctctgatgtgaggtaaaaggacttggcagaaggagagaagggagactgcgctcttttgggtgtgttctaagggtgttcattagctaatggagaagggcttagaagagtgaaggagaagaacctagagctgtccctgatacttttttctttggtgtcccttctctccctcaaaagctttgggctttctctctaagggaacctgccttggcctggactgagaagacacagaagcaggcagctgagtgatggtgggaaaggcatttgaccttgccatcctcttccccagtatacacgctagccatcgggccagcctttctttactacagctggcaacagccccaaagtcctgaactgagaaagcaaaggaggaaacggtcacaggatagtgccacagaatctggaaagccaatcccagagatgatgctttttgagcaaaaacattcagctgacataagagcctattaagagccccaccccccacctcccatacacacagatcccgcgtgtgcctatgctgcagccacagtgcagtcacagggaagccagtgtctcggaattgtcctctgcttcctctcactggccccgtgtgcatccccctcacttcctctgctgtcaccttccccagccaggaaagtgtcccagccttgggcacgccccttccagatggctgtggaccctgaatgacaggttggacttttttttccatttggaaagaatccaaaaggttctaacccctgctttcacagtatgggcatctcccatcttctttgtgtctaatcacagtaacgcaaacacctccatgtgcaggtggtgagacctgggagggggtggtgagttggcaatagcctgatgggtgactcagcaatttattacactgtttgcttaggtgacaaacaagcctggcagttacccccgagcttagccaaagcccttcaaagttcctttcccttcagtctaaaggatgcatgtgcacacttcccaaagtcgcacaattagttgcatttatcaactcacgattgtcctttctttgtggagcagtgtttgaaagggaaagatgagtctccactcttcccctgctgctttcataatgcctgttttgttcacttgggatgaactctttcagagagctcagggctgcagcctgttcccctgctgtgtctaatatgctgggagtagttctctcctcatcatctctgtacctctgtctcggtcctgggaaagaaacccaatgccgagaacaccctccctcatcccccttgctacgtgggggcgatatctacctctgtttcttttgtgctgctttagttgcccacgtcttcttcctttgtgcttggcctgtctgaatttatctttctagatcaaggcgggtcctctggctttaagaaacatggttctcttggcatcaagtagattcccctccctgcccagtgatgtctgcaaaagaacagaggtggagactcatgacggtgccattgcaagagccaccaatgtgccgcagggccagctgcccacctgccagctacgctttcctggtgatcatgatctatattctttgattatcaacagaaatgccttaagagaatggttctgaatgtctctaggtctgcagaaattattgccagcccttcttcacttaccagagcacggtaaagatgaatttgacaggcaggagcctgaagacatatggtatttgtgctgtgggttttgtgtgtgatgagagttctcagctgtctgatttcctccaccaattccttcgacaaaagcctatgtgcttatgctgctggcctggcagaattttgagaatctctgactcactggcagagccttagaagggccatatcacccagcctcttggcttccaagcagtgatagcattaagtcatccccaataaaaaggaatttaccctcttttaaaatgcccttggagaaggaattcaatttggctctcttggatgtattttggcagctactatgaggaaattatttatatccaatctaaattctttaagttgaagaagtacttgggagattctagaagtctgaggggcaggcaatcactaagaatcagggtaaataacagagacacaaagtcctactaccgtggtatgacagatacagttgatactgcataaatcctgacaagtgaataaatggtatttttgcggtgtgtctggaaaaatattgggaaaactttcagaaagcctgtctgtaaacacctttagcaaacagaaaacaggtattcaaccacagagcatggtaaataagaatatctgccagataaatctaacattattctgtggctgagtgtcaggcctggtggttagagaggaagcatagtgtctaatctctcctggcctttgcacagttttggattctctcccacataacacaccttcagtaaactggggaaatgtggtcagaccacacagttaccaggtgagtggtcctggcagcagagacaaaagaaaaatgggttagcagggctcaatttcagcctagagtgataccatgcagagctcgacagggacccactgccggccaagaaggtcatagtgtcttcatcagtgacttggatgatgggccaagactttgctcctcaattgggttaagagatgattagctgctgagaacaatgatgtgagatttcctcctgagtcagttaggtgggaggaaaaatgaacaagctgacttggaagaattgtaaaaatggccagaagcaaatcaaataaaatcagggagaacaagtatgactgaattgaaggtctgtgccttgtcaatattctggcaaatttatagaatgtggagtgttggaagatagtttataaggcttagataaggcttagaaatataggctttcaaatcagaccaacctagactcaaatcctgccttttctgttgctggatgcattacggtatcacagccttctggctacccggtttcagagcctcagtgagcttatcaggactctaagaatgagaaagaggacacctggcctggcaaggagtgagtgctggtttcagtcctgccttggtggggtggtctcatgcagtgcaaagcccacacaaacatatgtggctgccctgcctaacttatctcaggccttcctggctccatgcctcagtttccttatcagtcaaatgaagataataagagatatttgaagtgattaaatgaggtagtagataccaagtgcttagcatagtgccaggcacatagcagactctcaataaactctaactaaaccaaaagggcacagaggatcccagcatctgctctcatccaccgatacttgaaaggtatatatgtggggtgcaaatcatggtcaccatcagaaaacttctgcttccttagtcccttctggtcccaccgtggaaggaggggtggacagggtggaggcagaagcaccagcagagggtgggagcagcagccttccacattcatgcagagtagaggactccttctgggtgaggcagtgaggaagaaaagcagaacgaggtggggccagattcaatggcccttttccaggacctgtcagccctacttcacaagcccacctgcttctccatctctagtattctaggcactgcttaagcctggactagtggttaaaggtcccatctgtataggacattctggaagaggagtaaggaggaactccagcctcctcatgcacaaacatgttgtctcctgcaatcctgaagtatgttaggcattggggctctctgctggttctaagatgcctcccagagaaataactctataagcccccctctaggctgctccaattttctggaagcaggaggccccagcgcatgtctccctgctggtctgttagtctctcttgtacttctgttattcatggcttcccagggcatggagctcagaaggtggtctccaaacctgctgggagaataaggagtgctaagtgtcctgacattcctggggagtcctagtgccctaggactgtgaacaagtcagcaagtcagagaagaggagaagataaaaaaggaaaaatcgagccctcatgcagtagggcataggatgctgcacaggctgcctttgggaccagctgtgtctgcagcagtgtagccttgggcagggagtccaggagcgttttaaggataaccctagacctaatcaactgcacctgctcagtgcctttcctctgcaaatgagaacgaagagccacacaattccaatgaatggccattgaaattcacatcaataaggaaatggtatcagagcctgggagggcaggaattgagaacgtagagattaggaggcaatttgattctgcagggagcgctggtgcagggtgaggcagagccccaagcaccctgtccccagcactggcccagaacaggctccgctcaggagcaacaagcgggagcactcccctcggcagccaccagaggtcattggttcctgctgttcgagctgtaggctgctctgcagtgccttccagccagtacagcccagacagttactgtttcccaacagtcctggaggaaaccctgacccaaggggagacagggcaactccttacagaacaccctccatccccctgccaggaaggctgggagctggcaccttgagcagagaccctgggctcccatcctaagcctttggccttcaagaagctttttctgagcacgctgaaagatgaggaaatggcaaagcatcccaggctacttatcagtgctccagcttctggccaggtaccctgacacctgctgctcccagtttcctgccagaggaaaagccctcaggagcaccttccctcccccaggcatcactcactcactctgctttttccttttttgtattagaatccggttctgggcaggcagccttgcacctgaaccacctccatccagaaaacaa

SEQ ID NO: 598 - DNA, 88547 bp, Homo sapiens
atttataggtatcttagttgaatggtgggatagtattttaatccacaagattcattaattctgtatgtttctggactacaagaaaatgttaaactttgatgggggtgtgtgtcaactcaagctattataacaaagtaccataaactgggtagcttaaaacatagaaaattatttcttacagttagggaggctgggaagtctgaaatcaaggtcccgggaaggtggttttcattctgagcactttttaggcttgaaggcaacccttctcaccgtgcacatacttggcagaaagagagagaactcttacctctcttcctcttcttatgagggcactaatcccatcataagggcctcattctcatgacctcatttaaacctaattatctcccaaaggttccacctgcaaacatcatcacatatgggtgtgaggacttcaacataagaatttgggggagcaggatcagtctataacattaagtccataacagcttgtgtatgtgtgtgctcgtgagtgtgagagagaaaattataagttccgtgcaatcatgtctaagtgaagaatgacaaaaagaacatttttaacagtttcttatttcttggctagaggtctgcgtataggtctctccctgctgaagcacatttttattttctgtatttttatgcatcacaccccagtgcaagatttatgaaacttgagtccatttctttctataaatagaaacaactttgatcacaaacaggctgatttatgaactggaaaatacctaagacaagacagcctttcacagaaaccatatctttttaatcaacctacattatataatacactcttttacttaaaagagcactgccttaagtatgaattatatgccattagaaatattctcagttacaaaaggcccagcacttctatacatcagactaatgattagacaaaagtaatgccaatatttgaaaatacctgataacatgaagacttaaagttattactagtaacactaaagttgatttagagtttaagcagatagattgttttggaagaatagaaaatttgaagagaatatgtcaacgtagttacatacaaaggctgggttatctgaaccttcagaaaccctagcatgtgtgtgtgtgtgtaggaatatgtatgcatatattaggtaaactctattgtattataaagaaacttgctaaatctaatttttataattttagataataaagttataggtaagattatgattaactttaaaaagggttagatggatgtataatgagaagtctggtaggtttgtcacaaaagggcaataattttcttttcattatcctcttttggattttttttttgttttcttgtaatttaaattctcaacatctagatctaaagatatcaaagaagatattcagtcaatattgcacaaatgagagaaagaaataatgcacttctgtaagtacatcatgcctttttcaaaaatgatttcttattgtgtagccattgataaaatagagcaatataaaacatacttaaatgttttatatactacaacaaaaaataaattatagtaatgtaaaacagactcagtagaaacagatgcacccaatatcatgaaattatctacaatttttgaaattttttcactttttaaacactattatttttatattaagtttaaattctcttatcaaagcaataatggagatgcattcccccaaaaccaccacctagctctgctcatcattaatttcctttaaatagactttattgcttagaacagttttggatttacagaaatattgtgaaaatagcacagagatttcccatatacctcacattcagtgtcccctactattaatgtcctacattactataatacttttgttatgtttaataaatgaatattaatacagtattattaactcaaccctggactttattcaggtgtctttagcttttagctaatgttctttttctgttccagggtcccatctaggttaccacattacatttaagtgccatgtccccttaggctcctcttggctataacaatttctccagttttctttgcttttaataaccttgacagctttgaaaaatgctggtcaaatattttgtatatcgtatattttttattgggaattgtgcaatgtgtttctcatgattatgctagggttatgtttttgcaaggaagtcacagagaataagtgccatttttcatgaatcatattaagaacatatactatcaacattaattaccacaattaatgttgatgttgataactttgctgaggtagtgtttgctgggtttctccacgaaattactgatttacccctttttgtactataatccttggaagaaagtcactatggatagcctacacttaaggaatagggagctctgctccaactactaaagggcatagtatggacacaaattatttgaaagtttcctgcagatatttttctattctttttatatttgtttccttcaacttttatttttagttcagaggtgcatgtgcagggtagttacataggtaaacatgtgccatggtggtttgttgcacagatcatcccatcacctatgtattaagcccagtatccattagctatttttcctgatgctctcccttccccaacccttcccactggtgcccaatgtgtgttgttccccacccccatgtgtccaatatgttctcattatatagctcccatttataagtgagaacatgtggtgtttggttttctgttcttgcattagtttgttaagtataatggcttccagctttatccatgtctctgcaaaggaaatgatctcgttcctttttgtgtctgcttagtattacatggtgtatatgtaaaacattttatttatccagtctatcactgatgggcacttaggttgattccatgtttttgctattgtgaacggtgctgcaatggacgtacacatgcaggtatctttataattgaataacatatattcctttgtgtatatacccagtataggattgctgggtcaaatggtatttccacccctagatctttgaggaatcaccgcactgtcttccacaatggttgaactaatttaccctcccaccaacagtgtaaaagcattctttttttctctacaaccacaccagcatctgttgttttttgactttttaatgacagccattctgactggcatgaggtggtatctcactgtggttttgatttgcatttctgtaatgatcaatgttgacatttttttcatattttttttgcctcatgtatgtcttcttttgagaggtgtctgttcatatcctttgcccactttttaatgtttttttcttgtaaatttgtttaagttccttatagactctagatattagacatttgtcagatggatagattgcaaaaattgtcttccattctgtaggttgtctgttcactctgatgatagtttctttggctgtgcagaagctcttcagtttaattagatcccgtttgtcaattttggcttttgttgcaattgcttttggcatttttgttatgaaatctttgcctgtgcctatgtcctgaatgatattgcttagatcctcctctagtatttttatagtttggggttttacttttaactatttaatccatcttgagttaatttttgtatatggcttaaggaagaggtccagccaatttcaatattctgcatatggctagccagccttcccagcaccatttattaaatagggagtcctttcctccattgcttgtttttgtcaggttggttggaaatcagttggttatagatgtgcagtcttgtttctgagttctctattctcttccattggtcgatgtgtctgtttttgtaccagtaccatgctgttttggttactgtagccttgtatagtttgaagatgggtaatgtgatgcctcctttgttctttttgtttaggatttggctagtccggcccttttgtggttctatatgaactttaaaatagttttttctaattctgtgaagaatgtcaatggtagcttaatggggataacatctataaattatagatagcatctataaattactttgtacaatatggccattttcatgatattaattcttcctacccatgagcatgaaatgtttctccatttgtttgtgtcctttctgatttctttgagcagtggtttgtagttctccttgaaggggtcatttacttcccttgttagctgtattcctaggtattttattttctttgcagcaattgtgaatgggagttcattcatgattcagctttttgcttgcctgttgttggtgtataggaatgctagcaatttttgcacatggattttatatcctgagactttgctgaagttgcttatcagtttaagaagcttttgggctgagacaatggggttttctagctataggatcatgtcatctgcaaataaagataatttgacttcttttcctatttgaatatcctttatttctttctcttgcctgattgccctggccagagcttccaatagtatgttgaataggagtgatgagagagggcatccttgtcgtgtgctggttttcaagaggaatggtttcaccttttgcccattcagtatgatattagctgtgggtttgtcatatatggctcttattattttgaggcgtgttccttcaatacctagcttatagaaagtctttaacatgaatgagtgttgaattttatcaaaggccttttctacatctattgaaataatcatgtggtttttgtctttagttctgtttatgcgatgaatcacaattaatgatttgcatatgttgaaccaaacttgcatcccaggaatgaagccaacttgattcctttatttacataagtatgtactcctagatatttattttgtgaagtgttttatgatcatacggatttatttgtaatcttgttcatatggtcgattacattatttgatttttgtatgttgaaccactgttacataccttaaataaatccctcttgttaatgacatgtaattcttttcatacattgttgtattaacctactaatattccatggttaattattaacaatatcatccctggtatatcctatgcatacatatcaatcaaatgatacacatatatttatctatttatatttttatcaaaatagttcaaaattcctaagttatgttaaggaaactttttagtctttaatctaacatcaaaaagtaaagtgaagttaacacgaaagattgtagacgtgttttgtttaaaagttttcacacccaaacattatctcaaaagatcagaataaggctaagaaaagcaactatgaaacatattaaggatggaatccttacataatttttaactttgctttaaattacaaatcatcattttactaagtcactagcattgttaaatgtctcctaaattctcctctcctttttaaattttttgttagtaaatttattgctgtaacattttaacatgacatttttgatgtgttaggtagatatttatactagctttgttttaaattgattcagatatggatggatgcttttctcttcttgaattctttacttagcttattttctaattgattaaaatttgtctttaagtagatatatcatggatagcttctgtgttgtcatacctgagttcttttactacacagcctgttagtttattttatgcttggaaaacatgtaaattgagtgtaatgttcttaagttacactttccattatttagagctttccaatcatcattgatgtgtttgcgagcatttaaatgatgatagatagaaatttgaggctatgccgactggcttcccttcctgtaaggttttttccaccatttgatgacaaaaataattattccctcccacctgaatttctgtaatgtttctctataatataaatgatcataaagagtctatgtgattgcattatttctgccttgtttactctgtttcttgctatgttgaactaattttcttattttctcagaggttcttttggtccttgatctaattagttaggtctgcaagctacattttccttctttttttcttttacattatgtcttatagatattgttttcttaaattaaaaataatattacaatactttaagtcatttgttctgtgtcagcgtcataccaatctacattgttcatgggataatccttgcttttattttcataggttagtttgcagagctacctttccatttcttttcacttttttgtttttgttgttggatagctttgtcaagatcttttcttctgtctttgacagtcttgaccatgttcttatcatgtctgtattgcttatcttccctgcctcattactgtttaaaactagtgattttttctgccagccacattttggtagcctgaaagcatgacaggaaaggagatacttggatgagcagtgtgtagtctttgttagaatacctgagctctgcttcggtttctgcaatgatgttaaatgccctcacactgtgtcctcaatagctgccatagaaactagtgcattgtaacttcttaattaatgatttttgaatgaaagaatgaataaatatattagacatgagtacctgttattacttttctgctacagattagattctcaatttattatgtaatttgaaattcacacttctattagagcaaattagtagacgcatgcaatgctgcatgaagctgcttagaatttggatactgttgcttttactcctattttattaaccccagcaagtcacacctttgggcctaatattggagaagaaattcacatgctacccatgaaagtgctgcaaatgccaattggaagacttgtatgcttctcttacagtgaagggaagaaataatcaagaacaaaaattcaatgcaccttaagcttctccacccctttcatgtgggcagcactttccagaactcaccagttttaataagtgtatggtaaagatactgcttcagaattttttcttcatgtttgaggctcatattaagaatttctggcttctatttgcccatcctatgacctcttgggcttacaagcttcaataagagtactgaatgccaatactcttggcagcttttccagtttctagaatcattacttggcagcgatttttcaaggattttatttttaatgttcatttatttgaatactgaaagaaaatgatagtttgatgcagttcaattctgccatttttacataatctgttcaggcagaaattttgcccaagatctttaaagcaataatatgtactccgatattcttttatactatcatttccaaatattacaaccttctatgcaagacaattttattcaacgcatacttttatgtacttaatatatgactccttctagatggttagtacagtcttaaaattctgttaatattgtctttattacctattaacattattcatatcaaaggagtaaggattttatttatttaattaagattttagctgggcatgctggttcatgcctataatccagctctattgaattaagtaattttctattagatttgattcttaatcccaattcaactcattgtatgtagtttcatgttacaggtatacatacacctgtatttattttatataaaacacaatgtatttaattatatgaacttgaaatgcactcatattaataaaaaactttagcagaactgagaaaaagaaaattctttatttttaattgtgaaatcaatctataacacctaagttcaggagagcaaataacatattttggcaagtattcattaaggcaattacttataggtaactttcataactcttaatcagcagtgttatagtattcaaaattgaaaaaccatggcagaaaatcaattaaaactataagtaaacatttctccaagttttaatattctaaaacattttttatgaatctccacatgatgcaatttgaaactatatcatatctatatactaatattattttattttttatgcacataaaaaataattatacatcctggggtattgtcattattatgaggtttcttttggaaggaaaggagcataaatctagttatattaagtgtataattttgaaactttttttgtttgtttttgttgcccaggctggagtgcaatggcacaatctcagctcactgcaacctccgcctcccgagttctagcacttctcctgcctcagcctcccaagtagctgggattacaggcatgtgccaccatgccggctaattttgtatttttagtagaattggggtttctccatgttggtcaggctggtcttgaactcccaaccttaggtgatccgcctgcttctgcctcccaaagtatgggattacaggtgtgagctactgcatccggcctgaaacttatttttaaattaactccatggtatgaatatttctctcctattttaatagatggataaatagacgatgaattgatatacagatagacaactgaatagagatatagagagatgaaagagaactctagatagttattttaattgttatataatatttcaaaaccaagttttttaactgtggctttgtcactacaatcaatcttatgatcaatatcactgtgtgtgtgtatatatatatacacacatatataactatttactgtttatcataaaatattttccaaaaagttactctttctgagctaaatgataggccagaaactttccagaaaagttgtagcagctcatctttccaaaggtaacagttgagagtgcttctttcctcacagtctatcccacactcttgttctctctaatattcaggccctgggatatttaggcaaagatgaggagaatgtaatttcaattaatcaccatttttcagtctttctaatgcttttgcatttctgcactagagagcactctggatatagactgaggcccatttgcctccagcagcactaatgcttcacacttgcttactgaataaaaattactcccagagacatgcatcccaataacattagcaattctgtaacttcttgcttttagcgctggggtatgccttcatcaaaggtctaaagggaaaacaacaaacaaaccaaacaaaaaaccctacccgttaaatcaagaaagaaacagagacacttttgaggcaagagaatagggtccggagtcagggaacctaaggccaattcaggctgacttcctagaactaaatcaaaaggaaaaccccaaatttccatgcccaagtaacaaaagcaccacaggctactccgtttgcaacctctcctccttttctgtgtgacagatgaaaaactgaaagtacctctgattggtttcttcctgcaaccaatcagggctgttcatgggccaagtctttatttgcatagaagtataactttgtaactttactttagcctctgattggtcactttctgcaaccaatcagactgatcacaagacagtacttcatttacatatggtatacaccaagtaaccaatgggaaacctctagagggtattcaaaccccagaaaattctgtaactaggtccttgagccgcctgctcaggcctgttgccaccctgtgaaatgtgctttcattttcagtaaatctctgcttttgttgctttattcttttcttgctttctttgtgcattttgtccagttctttaatcaaagcaccaaaaacccggacactctgcaccggtaataggtttctgtcatgacaaagctgcttcctttcatgattcaaaataattgatttgcataaataatgagtatttctatatcacagtttattcaatattaagaaatcaacattacttcttaaaatattatcttttattattattcatttaatctcaaatcctttaaaaactaggaattttttgtggaagttttttttttgctaagtggaagtgttttgtttgacaagacctcattttgggaaaggtgggttagaaccttggggtagaaattataccctagacttggcactccagacaatatacctggcatgatgctgagaattatgagagggagtagttagcactcacagggtaatagagatgtaggttcttattagaaacttttctttaattatacgattcttagtctgagataagctagaataaaagattaaaacctattaagagtatggagcaggaaagaaactgtttacagttatatttaaaatagtaaataaaaatgctttactcatattaaaatatttgcatttcctcaacctttgctcaaggtaattgggcattaccttgcatgtgaagaaaaaagttgaatgtagtttttatgaggtacttttaaaatatctgtttatataagcaaaatatggtaatcttttgccatattgaattagttttgaaaaacaaggattcttatttatccatccagaaaaaagtacctaattcactcttaaactagtagaacataagaggatcactttgtttcaggtattgaatgtatatgtctatataaaacataaatatacattataacataatttcataagaaagacatcccatctgacaaggaactgtacaagtcttccttaatatacagatagaaaagaagtatagagaaaatgtatttctcctttcaatttatactatgtaatcactaatagcaaaagggaccagttttcaaaaaagctataaggacctcaacttcatccataatggaataactgacacgggaaatgaagaactataaaactgaacaattctcagatattcaatgaaaagcaggactgggctatgagctatgaaagagaggaaagggaaatgtaaaggcacatcagttgtccagactttgtgctttgaggcagttgctggactgcatcacaaaggaggaggaatttaagcagagcatagtgttctcattgaagtaataaaaccaagaaagaagttggggaagctgaagtagatagaatttgtggatcaaaatatggaagaaatgggatatagacaaataaagagctcaagaaatctttgacatgtcccagtgtctgtggttgagtatcaccttaatgaacctgaaaaataagactcaaaatcactaagctcatctgttgttacttacagatgaaagtaacaacctatgaaaaaaaatgccaacactttttacaaattgatgataaaattcaaacactcaccaacattattatttctggtgttcaaaaaggaaaaatagacaaagacacagtagatgatgtcacttgaataaacataatcaatataaacagactcagaaatggcagaggtattagaattatgaggacatcagaataactagtataaatatgttcaaggatttaaggtaaaatgtaaacatgataagagaacaaataaaaaattttaaaagaaatcaagatataatttaaggtgaaaagtactatatctcaaatgaaaaattagctgtaggaccttaacagtaagttagatactgtaaaggtcatttctaaacgattagtgaacttaaaggcaaatataaaatattcaaacagaaacacagagagaaaaattatgaggaaaaaaacagaggctcgatctatgggacaacatcagacagaaaaacataacaattattagatttccagatgaagagggatgggtaaaacaattttttttaaaataaaggctacaaattttccaaattttggctgctaacttgggaaatatatagcaaaatagaatattgttctcctcctcaataatgagaaaaacacataatccacaaatatttatctcagagagctgaaatcacaaataaaccaagtatactagattccaaaacatgacaatctcctcttttgataggaaaaatacatacattcttttgtcttttataaaacagaacaaaaggatgtgcaggtaaagaaaaaagattaaagaattctcaaggtgacactttgggtgagagagacagataagaatcttagcttggtccatttgcaggatacagaagcaatgacccctagtagcaaggaatatacctagtgcctagattgtgatttcttaacatcattcttcagcaaaagaaagtaggatagtttggttaataatagggataaagcagaaaaatatgattcacttacaaaaaacttatgatgccagaaattaagaaaatgctcagaaaagaatgaggtcttgtagaaagaacaacaaagacaatttgaaaaaaaggagatcttgtagaaagaatgaggtcttgtagaaagaacaaggaagacaatttgaaaaagttcctgacaactaaagctcagaagtttgagaaacaaaataaattcttgtgttattagattataagccatagagatttattttgagcagcaaaataaatacttgtgttgttaggttataagatatagagatacataacccacaaattaaaacagatgaataaaataaagaaaacaaaagaataaaagaaagagagagaaggaaagaaagaaagaaagcagaagagacaacactacttaaaatagcattccaattaaagatgtaacacatttttttttaaatctcatcaggcaatttctaacaaattgaaagattgatttttaactatagaaggacatggcagggcgtggtggctcacgcctgtaatcccagcactttgggaggctgaggcaggtggatcaggaggtcaggagatagagaccatcctggctaacatggtgaaaccccatctctactaaaaaaatataaaaaattagccaggcgtggtggcaggcgcctgtagtccctgctactcgggaggctgaggcaggagaatggagtcaaccaggaggcggagcttgcagtgagctgagatggtgccactgcactccagcctgggcgacagagtggactccatctaagaaaaaaaaaagaaggatataccaaaacctagaataaccaaaacaattttcaaaaagaatagcacagctaaagaactcacagtatctagtttcaagttttttttctaagcatctctgaaatctaggcagagattccaaaacctcaattcttaatttctgggcacctgcaagctcaataccatgtggaagtttccaaggcttcgggcttgcaccctcagaagccacagcctgagatgtacattggcccttatagtcatagcaagagaggctggaaagcaggtcaccaagtcctgcataaagcaggggtgtcctgtgcctggtccacaaaaccattttttccttctaggcctctggatctgtgatgggatgggctgccacaaaggtctttgacgtcctctggagacattttccccattgtcttggcaactgtttggctccttgttacttaggcaaatatccttagctggcttgaatttctcctcagaaaatttgttttttttcttttctatcacactgtcaggctgcaaatttcccgatattatatgctgtttcccttttaaaatgaaatgcctttgatgtcacccaagtcaccttttgaatgctttgctgcttagacatttgttctgccagacaccctagatcatatatttcaagttcaaagttccacaagtttttagtgcagaagtaaaatgtcaccagtctctttgctaaaacatagcaagagtaatctttactccagttcccaacaagtgcctcatctccatctgagaccaccacagcttggatttcattgtccatatcattatcagcattttggtcaaagccattcacaacaagtctctaggcagttccaaactttatcacatttttctgtcttcttctgacactcctaactttcccaacctgtgcctgttacccagttccaaagttgcttccacattttcaggtattttttgagcatcgcccactattcaggttccaatttactatattcatctattctcacatcgctaataaagacatacccaagaccaggtaatttatcaaggaaaagatgtttaatggattcacagtttcacatggctggggaggtcttacaatcatggaggaacacaaggaggagtaaagtcaagtcttacatgaatggtggcagttgagagagcgtgtgcaggggaactcctctttataaaaccatcagatctcatgagacttattcactatcatgagaacagcatgggaagacccagccccatgattcaattaccttacactgtgtccctcccatgacatgtggtgtatcagtccgttttcatgctgctgataaagacatacccaggacctgggcaatttacaaaataatgaggtttaattgacctacagttccacatggctggggaaacctcacaatcatggcagaaggcaaggaggagcaagtcataccttacatggatggcaaaaggcaaagagatggcttgggcagagaaactcctgttttaaaaccattataacttgcaataaccattcactaacaccagaacagcatgagaaagacccacccccatgattcaatcatcttccgctgggtacctcactcaggtgggaattatgggagctacaatatgagatttgaatggaaacaaagagccaagccatatcattcaacccctggcccctcccaaatctcatatcttcacatctcaagagcaatcatgccttctcaacagtcccccaaattctcaactaatttcagtattaactcaaaagtccacagtccaaagactcatctaaaacaaggaaaatcccttctgcctatgagcctgtgaaatcaaaagcaaattagttactttctagatacaatgggggtataggcattgggtagacagccattccaaatgagagaaattggcccaaacaaaggggatacaggcctcatgcaagtctgatcttaaagctccaaaatgatctcctttgactccatgtctaacatccatgtcacactgatgcaacaggtaggttctcctagtcttgggcagctctgtctctatggctttgcatggtacaatctccctcccggctgttttcataggcttgccttgagtgtctggagattttccaggtgcatagtgcaagctgttggtggatctaccattctggggtctggaggacagtggccctcttctcacagcttcatttgatagtgccctagtgggaactctttatgggggctccaaccctacatttcccttccacactgccctagcaggggttcttcatgagagccccgcccctgcagcaaacttttgcctcggcatccaggagtatccatacatcttctgaaatataggccaaggttctcaaacctaaattcttgacttctgtgcaccaacaggctcaacaccatgtggaagctgccaaggcttgaaccttgcaccctgtgaagcaacagcccatgctgtaccttggccccttttagtcacagctggaatgactgggatgcagggcaccaagtccctagacagcatacagcagatggaccctggacctggctcacaaaaccatttttttttctcccaaacctccatgcctgtgatggaagtggttgccatgaagacctctgatatgccctggagaaatttaccccattgtcttgtgaattaatattcagctcctccttacttatgcaaatttatgcacccagcttgaatttctccttagaaaatgggtttttcttttctatcacattgtcacgctgcaaatttttcaaacttttatgctctgttttctttaccaaactgagtgcctttaatagcacccaagtcacctcttgaatgctttgctgcttagaaatttcttccaccagataatctaaatcctaaatcatctctctcaagttcgaagttccacaaatctctggggcatgggcaaaatgccaccagtctctttgctaatacataacaagagtcacctttgctgcagtttccaacaagtgcctcatttctatctgagagaacctcagcctggacttcattgtccatatcactatcagcattttggtcaaagccattcaacaagtctcaaagaaattccaaaattttccacattttcttgtcttcttctgagtcctccaaactgttccaacctctgcctgttacccagttccaaatttgcttccacatttttgggtatattttcagcagcaccccactatactggtaccaatttaccacattagtccattttcacactgctgataaagacatactcaagactgggcaatttacaaaagaaagaggtttaatggacttacagttccatatggctggggaggcctcacaatcatggcagaaggcaaggaggagcaagtcacatctaatgtggatggcagcaggcaaagacagggcttgtgcagagaaactcccgtttttaaaaccatcagatatggtgagacccattcactatcatgtgagcagcatgggaaagactcacccccatgatttaatcatctaccaccaagtccctcccacaacaggtgggaattatgggagctacaagatgagatttgggtggggacacagagcctaaccacatcacatggaaattgtgggagctacaattcaagatgagatttgggtatagacacagccaaaccatatcaccaagtattggcaataatttgaaataattgaaaatctctttcattgctggtgggaatgtaaaatgttactgccaatgtagtacttttcttataagtccaacatgatacttactacatagaaccagaacactactataagaaaaatttgaaagtatgtcatgttcacatagagatttctccatgagtattcgtagcagctttattcataattggcataaatcaaaaacaacccagatgtctatcaactagtaaatggatgaagcatcacaaatccctgcatcagtaatcaatactttttagtattaaaaagtattacatgaagtggaacaaccatgcaaaaacactaacttttaactagactctatagaagtaaaaagacaatggaaacacatctttcaaggagacatgtttaaaatatatagagcatctataactcaataataagataaacaagcaagtcttaaaagtgagaaaagatttaaaaagtcatttcacaaaagaagataggcaaatattctgtaaatacatgaaaagacacttaccatcactaataatcagggaaagtcagattaacacacatgatggaacaaaggatactactttacattagtgagaattgctaaaattaaaagaccaaaaatttaaaggattgccagagatgtgaaaaaactagaaaattcacacaatgtttgtgaaaatacacaaagatataatgattctagaaaatagtctagcagattttttaaataaattaaaccatacacttattaaatgataagtgatttcaagtctaggtatttataaaagcttgtccacctaaaaactcataagaatgtatagtaccatttttatgggacctgacaactaaaaacagttcaaatgtccagcaatgtgtgaaaaaaattaaaaaattcaaatcaaagaatagaatactaataagcaataacaggaaaatactacccaattgttatggtttggatgtgtccgcaccaaaacctgaacttcagttgtatctcccagaattcccacgtgttgtgggagggacccaggggaaggtagttgaatcaaggaagccagtctttcctgtgctgttattgtgatagtgaatgagtctcacgagatctgacaggtttatcagggttttccacttttgcttcttcctcattttctcttgctgctgccatataagaagtgccttttacctcatgccatgattctgaggcctcctcagccatgtggaactgcaagtccaattaaaactctttttcttcccagtctcaggtatgtctttatcagcagcatgaaaacaggctaatacagtaaattggtactagtagagtggggcattgctgagaagataccagaaaatgtggaagtggatttggaactgggaaacaggctgaagttggaacagtttagagagctcagaagaagacaggaaaatgtgggaaagtttggaacctcctaaagacttgttgaatgttgaatcagcatttctatcaaaatgctgatagaaatatggacaataaggtccagactgtggtggtctcagattaaggtggggaagttgttgggaactggagtaaaggtgactcttgttgtgttttagcaaagagactggtgatattttgcacctgccctcatgatttgtagaactttgaacttgagaaagataatttaggatattttgtggaagaaatttctaagcagcaatgcattcaagaggtgacctgggtgccgttaaaggcattcagttttataagaaaagcagagcataaaagtttggaaaatttgtagcctgactattcaatagaaaagaaaaacacattttctgaggataaattcaagcctgtttcagaaatttgcataagtagtaaggaccctaatgttaatccccaagaccatgggtaaaatgcctccaggtcatgtcagagaccttcacagcagcccctcccatcaaaggcctgagggcccaggaggaaaaagtggtttcgtgggccaggctcagggtccccatgctgtgtgcagcctggggacttgatgccctgcatcccagctgctccagccatagtcgaaaagggccaatgtacagttcagggtgtggcttcagagggtggaagccccaagcctttgcagcttccatgtggtgctgagcctcaggtgcacagaagtcaagaatttaggtttggtaaccttggcctagatttcagacgatgtatagaaatacctggatgcccaagaaaaagtttgctgcaggggtgaggtcctcatggagaaacgctgctagggcagtgtggaagggaaatggggggttggagcccctacacagagtccctactggggccctgcctagtggagctgtgagaagagggtcaccatcctccagaccccagaatggtagatccaccaacagcatgcactgtgcacttggaaaagccacagacactcaaggccagagggaggctatactctgcaaagccacagaggcagacctaccccagactgtgggaacccacctcttgcatcaccgtgacctggatttgagacctggagtcaaaggagatcattttggagctttaaaatttgaccaccccattggatttcagacttgcatgggccctatagcccctttgttttggcgaatttctcctatttggaatggctgtatttacccaatacctgtaatctcattgtatctaggaagtaactagcttgcttttgattttacaggctcacaggcagaagagacttgccttgtctcagatgagactttggaccatgaacttttgagttaatgctgaaatgagttaagactttgggggactgttgggacagcataattggttttgacatgtgaggacatgtgatttggagggatcaggggtggaacgatgtggtttggctctttccccaccccattctcaactcgaattgtatctccaagaattcccacatgttgtgggagggaaccagcaggaggtaattgaatcatggggactggtctttcctgtactgttctcatcatagtgaatgagtctcacaagatctgatgggtatatcaggggtttccacttttacttcttcctttttctctcttgctcccaccatgtgagaagtgtcttttgcctcccaccatgattctgaggcctccccagcgatgtggaactgtaagtctaattaaacctctttttcttcccagtctcaggtgtatctttattagcagcataaaaacagactaatatacctattatgaatcaacgtgaaaaaaatctcaaaaacatgcttatcaaaaaaacagatatagttcattcatcttgaatcttacaataggaaactctaatcaatagtaatattgaacaggtcatacagagaataagaccagagaaggggtggggatgactttaggggccctttgagggcacgaagaacttcaatatatcatcaagttgggtctgctgtactttccattgatttgtctgtttattctctcattgtatttataaatcgcaattcaaaattataaaagcactgtctatcaaatttataactactggaaattcattcaaagttttatatttgatttactgtaagtcctcaattttgagggcattttgaatttctattgttttttatgcttaacacattaatttatgtatagttgtgaggtactgcattagcaactactggccagatgctgttttatattattgagctttgtgctaatgaacaaagttttctatcactttgcaacatactgttaattacaggaaagtaacacatattctcattatgtatactaaagttaattctaaaatagcaacaaaacttaagtggacccttcaaaattactcacatataacttaaacaaagtgcatgtatataaaattgaatcacctaattttgtgtgttccctctccttctttctctttctcttcacttcctccttaccatctactctatattggatgccattgtgaattgtgacttttttcttatatttgattttatttctctttttgaacctttataaaaaaatctgtttacttctccagagtgttgccaacaaagtataggagttttgtgttcttgcttgtattataattatatacatatcagttgacagctatgtccttcttcctatgtcaaatatggtattaatatcgccaagatattaaaaaaggagataaagatgagtcttagaattaaatagaaaatgtttgttttaaagaatgaatgaagagccagttcccccaatgaaataagagaacaatattctgtttatattctacgtatacctatttttactttgcttaacatgtgggatattcttactgtttactgtatgtttatctcagttgctaatttatttgcaattaagttaaattgcaatactccagttatgaagtgacaaaatatcttttcttgttgtttgagttagctcagtgagttatacaataacatacaaaaaagtcaaaatcatgcattcaattgataatcagaccatgctcttttaactaccacagcctccaactcaccctgaccaatatttcactcaggcaggtaaactctaagtcagaagtaaggcggcaagttttactttgttatgtaaggactgcaactttgaaaaatatattcaagttacatgcaggtaaactctaagccagaagtaaggagacaagttttactttgttatgtaagaactagaactttgaaaaatatattccagttacagagaatgtgacacagtgacatcttaataaaataagacagcaattttgctctttgcctgtcattaatattggaagcacgtctcgttaaaacttttccatagacatcatataatgtcatgaaattaaaatagctataaacaaacattaagtaaaattaaaatagttgtttcatccccttgacaatttctatcttttgtattacaggatatgaatatatccacttattgttctttctttctaatttaatgtattaatatatttttcactgtaaggtactagaattttataatagcttagaaaaatgtggtggtgcttgataattgaaaatatgttggcattgttaaagctaattgcccaaagatttaaaagtaaagacacatttaaaggcacaatcattatggtaattgctgcaatgaatgttgtgaacttttcagtatatttttaagcaatgccctggagaggtgtcatttccaacacattatttttgatatggcatctcttagacatttgctagtgaatactaaatttactattgaggatatatttcaataatttactatttattaaatcatccataatcaatgaaaaattaccattccaacaccatcaatataaatttcaatctagtgaaaaagtacaggaagttagattttagcatctgtggcagtaaaaaagctcaaaataaaatcgaagaattttacttggctgaaaagcaattgtgaaggaaaaagataggcttgagtgcataagattattaaaagtacaataccacagccaccttttgtttaagtatacacaaatggcagagcttgcacagttttaaaattgaagaaccttcatttaggatacattacctttttaaaaaaacttttcagttccacactctgtgaaagacacattctagcaaatacactcactcaatctaaaaaaactctatactctttcaattactgaaattcaatgtgcatttaacatctctaaatgtagctgatatttaaaaaactctcacaaggggttggaaaatctcatgtgagattacagggagctccatttggaagatctgctttgactattagatgttcaattggaattgatcaaaatggccttaaatttcctcttcagcttgagtaaacttgtctttttcttgattataggctcctgaccttcctttatttatagcatttacttcaggaaacttgcaagtgtaagttttttctctgcctctttgagatgtaaatctttctttaaaagcttcttgccagttttacaacccagaaatatctttctcacagacctgagaaccactctttgaaatgtactcatgaaagaagatagtacgtatcccccaatttttatgggagaagaagagcataacttccgtagaagtcttgctaaaagttgtaaaactaccttctgtcataaagttatgagaagtttactttgctttgtatgaagccaattagtatacacagatggccaatgttgtatcatatcctataataaatttcttctagctccttccaacctttgaaaaccctatagccttctacttcagcggagttgagatcagacttagttctcatctccctcccctattgaaatagccttgagtgaaaaattccttgactattcaactttgacatgattttttgctttgattgaatcaatgatcaaattattttagtaatttatgaaaagacctttaacttgacttattttgttgcacaatggaaaaacaaaagaaaacaaataaaaatatagatcttgaataagataacctggatttgagctcagttttctctattttcaaattatcaaagaatatagttcatatcttccctgttattgagagacaggactagttggatttcctaggccgactaagaatccctaagcctagccgggaagttgacagcatccacctttaagcagggggcttgcaacttacctcatacccgaccaatcaggtaggaaagagagctcactacaatgctaattaggcaaaaacaggaggtaaagaaatagccaatcatctattgcctgagagcacagcgtgagggccaatgatcaggatataaacccaggcattccagcaggcaacgctaccctctttggatcccctccctttgtatgtatgggagctctgttttcactctattaaatcttgcaactgcagtccattctggtccgtgtttgttatggctccagctgagctttcactgccatccaccactgctgtttgccgccatcggagacccgccactgccttccatccctccagatccggcagggtgtctgctgtgctcccgatccagcaaggcgcccattgctgctcctgatctggctaaaggctcgccattgttcctgcacagctaagtgcccgggtttgccctaattgagctgaacactagtcactgggttccatggttctcttctgtgacccacggcttctaatagagctataacactcaccgcatggcccaagattccattctttggaatccgtgaggccaagaaccccaggtcagagaacacaaggcttgcgaccatctttgaagcagcccgctgccattttggaagtggcctgccaccatcttgggagctctgggagcaaggacccaccccccaccccccataagattatcaccaagtaaatattaacaacatattaaattaaagaacaggaacacatatattgatagcaccttatgtttatttgtcatcactgaacttatttttgttttctatataatgtatagatttagaatttgcacaacatatgaaagattagacagaaatatgaataaattctgtctggttattaccattcaatattttataagttgctatctctaaaaagaatacactgagatgttcttttaatgtggctttgttgtagttctggcaattaacatatcaaacattaattcatttaaatgaaagaaaacatatcattattctaatatggctaagcagagccaagctgttgtgagatttgcatagacatatcatcaaatggcaatatctgatcagtgacaacacaccttccagtctacatatttttcctagttgtgtgatatacctttgatataatatcagtgttacaaaaattataattccactcactaatttgtagttgctttataaaagcactctctgagttgaattatttcatccagagctcctgacacacaacttgattttagctagaaaagccagtcaaataatatttcagaagctatcaacaaaaaaagtcaacagattaccctacataataataaagatcttttatattaaaaatgtcataaatacagttaatagacaagcaatattttagggaaaaaatgtacaacatatataaagggcaacagtttagtatataataacctcctaaaataaatagagtaaattaatcagtagaataatggacaaaagaaaggtacaaatacttgatttaaaaaactatgaaacaaactacagtttgccaacaaacagaaaaagatgttcaagaaaaccagcaatttttttgtgacaatcaattcaaaccaaaaaaattaaaactatacacctattagattatttttaaaaattattcttaatattcagttaacattgatattagagtgatattttatctaagttgatttttacagaaatatttaacctatttatgtgggtgtgtgaatgttcactgaaacactgtttataatggctacattttactcataatataaatatccactgattagggaatggttaaaccatgtgtgatgcattcatttgtaaaaattacaaaatcattaagtctttccaaaagctaagagttctaaaataatgttctaggaggacagagtttaaaaaagcaaaaacaaaaagtgatttgaaaattatgcataagtattaatatatttcatcccacatgttacaaaaaattatatatgtttgtgtctatgtatgtacacatacaaatgcatagacatactcatatcaaattttttattattgttaccaattggtataagattagataattaaagtagggcttttccttgcatcatgtatacttgtttagttttcgactatttgcttttttacaatgaaaatacattgatctgctgctagtttgcttaaattgttttcgttttaaaatggtaaaatataaaatagctaacatcaaagctattccaaaatttaattattttagaacaagaattttacctggaatgataaatttccagaagttatatttttaaaattttaatgatgagaaaatgctaaaagtatttaattacaggtattagatgtgtcatttctttgtaaaagtatataatgtccttacaattttcaagctataaatatgtaaatttaaaaaaattatcttgattacactgctggaaatagtcaaagatttattggggcttactatgaattccaatcagtgatagttaactggagccccatggtgatcacttagtcaatatcagataagctatgaggacatttctgattatcacattcttatcagattaaatttatttccagcaataactactcagtgggttccacttggaactcttattactgcttctgcgggatataacatttaagagggtagagtattgatgacattgaacaaacacataaaacttcatttgactttaggttgatcttcactaccttgcagaaacagtgccttacttagtttttcattcatgtagcctatttctgctgatgtttattctttgttttcaactgataactatatttaaatcacatatctttcttttttattttgtttttgttttgtaagtagttgtctcatttgctattggaattctggagttaacattgtcaaaggactttagtttaagccttcgtatgttcattcatattcaagctgagagaaagcacctatactgaattagtaagccgtgcttttatgaaccagatgctgatcccaaaaagtcctcaataaatagaaccctttctgtttctaggtttctgaacagactgaacaagaatatctaacacttctacagttattcagttcttatacataccaggtaatgttctgagttacactcttattcattcctcacaagtatctgagttaaatggaattttattcccactttacagattaagaagtgaggaacaaataaatgcaatagaagatgatattcctaatatgtaatagggctctgatttgaatgcacactattaggcttcaaatatacatatatatacacacatatatgtatacatatatacatatatatatatatatattttttttttttttttttttttctgatgggcaccgtggctcttgcctgtaatcccagcactttggtgggccaaggtgggtggatcatgaggtcaggaattcaagaccagcctggccaagatggtgaaaccccatctctactaaaaatacaaaaagtagtcaggcatggtggcaggtgcctgtaatctcaggtactcaggaggctgagacagagaattgcttaaacatgggagacagaggttgcagtgagctaagatcaggccactgcactccagcctgagtgacagagtgagactcccatctcaaaaacaaaaacaaagattttttttcttttttcttttccttttttttttcttttttgcaggggaatggggagcagggttgttttgttctgcctttaaatgcactgaagatgaaaataaaattaatttgtaagtgaagaaaattgtcacagaatgcagtctgactcagaagccaagctttcaaccactgttccgtactatgtcttttttgtgcgtgtctatgcttatgtttatatctacatatcactccatatttatataggatatatatggatatatatgcttaatttgcataccatacctaacacatagttattttagttcatgaaatatatctacttcataaattacatttttccaaaagctaactcatcaagtcagaatggagactaacaagtggagcacatcttgttcctgtgtaggttctatatacaggattagtttctttgctgtgaatcatagacaatttactatggccatctgggcttgaaaaccaagaggggttcctggctccccaaacagaaaatctttatgaaatgttgtagtcatctatgtagtacaactttgagaaataaagtgagaggtttgcctctaacaacctctggaattgaacccagcagtcttctctcttatcactcattgttaatgcatggcacttggtcatcagtgggttgagatttgtggttaaaagagaggccatgtggacactggacaaagatcttcaacttcactaagtctacattttctcctacctaaattaatataggaacaaatcactctgctatttatcataagtctctggcacatagtaagtccctggtaacatcaaaaaattccacaaaataaaaattatattataaaatcattaccaaaaagagtagatattttttaaaggaagaagaaagtgcaaacagggtagattaagggcagcaaaggagcataatctcagtgtaaagaagaggaaattagtcccctaggggatacaaaatcaaagagcaagaacccaggagtagaagacagacaaaagtctcagttgatcttatacttacagtaaaaagaatctggtaagaaatgctgaaatttgaagaactcctcagatcataaattcagcaagttttggaatgactcaggggaatttgaatgacagttctccagaactataaaaaaaattctaaaaacatatttcccattctcttatataataatatttacattgaaatctgggagtttattctcagaaaagaacagctttatccttgaaaacagatcattgtatgctcttataaagaactctgttacaactgtaaaaaaagaacagtcacgatatagacatgacattgttatctaaaatttcctcttgtttcagtgcaataaatagaagtagagtgatgtccactcaaggttaagtgtgagtattaacaagaagtttaaagccttctcttttataagttgaaagcaatcaaataattacatctcttaaaagacattaggaaataactgattttttaaaagctaaagattagaaacatatatgcagaagttcttatgaatttgtaagcagtgaattactaataagtatgctaaagtttatactgacccatatgcagaagaagacttatatataaatacttgctgttggattgttttcagtagcgacattggaaacaacctaaaatcaatagacttgctgaatacattaagacaatcccatgcaatacgttgttatttactaattagtaggactaaagtagatttatgtgtgcaggtatggaaaaaacaatctaaggtaaaataagtaaagagaggaaatggcagataaatgtgtggctatgtatgtatgcatatttatgtctcgaagtatatataacagttgtgtgtgtatatataatgtgtgtatatatataaaacagttgtatgtagttgtatgtatatatagatgttgttgcgggaatcagagaaacgtagagaccaatgggtgaaacaggaatattttattaagtggtcactggcccagcagattaacatccaaaggctgagccctgaacaaagatacacttgacttttatacacacttctgaaagggggttggctggtttgaatggcgcggtgggaacttaatggtgcaaaactcgtggggcaggcaagcaagcttacagaagcagaacaaagtcaattaatcagactgtgacgggtttcgtaacccaagcatagcttgtgaccttgcagctgcattgaaggaaaaacaggaatttacaaaacttgggaaattgagaaacagtagagggatgaggagatagtaaaggaatttgtttttcttgtccttgctctgatggcgtgttaggaaagtctctgggactcattcctgtggactctgtcttcctggatagcgttatcatgtctcggccagggccctgcctattgctggccttggagtgattcagccaagtacaggaaaaacttgtttttctcttttaacttctgcttcattccccgctttgatgctttttacaaatgaggtttaatagaaagcatcactattaattaattcttcatgtaatggtagattttcttcatttggcaaaggttgatatttagttagagccattagttgagtggtagtttgcctggttacacaagcctctgtggtcgattgaatgtgtttaacaaggaggggtaagaggcaagggagtattaagcaacttcctagtatggccagaactattcttattagagttttaaatcctccaagggatgagaaccagcctcaaaagagagaatcaggagaccatcctttccaagtctggactcgaacatgggctaatttttggattttggcagttatatcttcgatgacttcccattgtcataaatttctaggcagcaattagttagattgaacttcctgcatacccctcccttctgggctaggaggtaatctaaggccagtctattttgataaatagcatttctcatttttgtggcttgctggacgattagatttaaggtccttgcagtgtcattagtaatgatttcaagcactgcctgtaactctatgatgtggttgaacatgtaaataggggtgcggccatacattccatcttccccccaagtggctggtccataatattggattattctttcagggggccatttgtcatccttccaattccctgtggttttactccttttatctctctttttagtttcatcgtagacagggtaccctaaggctcctccttgctttagagggattggaaagaaggacagtctaattgtccttagtacacaaaccactgtccattttgctggcagttgctgatattcgcttggcccatagatccagtagaggccagagggtgcctgccaggtatttggagcttcaagttggtaccaagagtggtttaaagaagggaaacaggagaaggggctgggatgaggtgatgtggaattatttttgccctgccatgaagtttttcctagcatttcattgtaatattggtgtcctaggcaagttaattctcctgctgggtctgtaaagggttttccccagtgagcaatgcagaatcttctgataatagaggtttttaagagccagacactcgagctcgtgcgcgttggttcaggagaggagacagagtgaagttatcttggggcattagctgtcttgctttccatggccattgatcccccatgttggttcttacgcaaacatagcatgaggagtcctgtaaactgctagctgtgttttcagctagttgggcaaacagatttccggccaaaggagggggctcaggaaacttctggttgatatgctcatagaatgacttgaaaactctgaattgttgaacaggtctggattttcttcatgatatgtaaaaataacatttttaaagacagtttttccctcttgatttttggttaaataggagtatcctattggtgcttctattcctgtagtctgtatctgtatgtttggctttaagatggtgaaatttacaagactgcaagcatttgctttacagtctgggtctgctggtatttgggtaaacatgacctgcctttatttagtagcccatgttgcgcagtcccaggtggagcaagccgggggagttctaacacttttacaacaagttcctacaggaaaggttgagtctctgaacgttgcctggcaaatatttaagtacaaggatatggttcctttgtggaaaggggggtaccttgttttcgtttaaaagggctccctcttctgacccgtcacagatttcgaaccacgtcccaggtaagaatctagggtcataacacacataaggctggttatttcctgggtcacaaattgagtaggtggtctggttgtgagtacaatttcctaggtgggttccaatacactcacaataagtatggtataatagagttctggtttatagtgcttcctgaccatgtagtatgagtgcatacctcttagagttctccgtttaacatagataaggggaccagcaataataaggtaaagagtagcatactcatacccagcaggcacaaaagaggtgtttacccagaggagggggttgagcaaagcaacaggacaatagtaaaacaactagtgttacaaggaaaattactaggctcaatatttctagccacatttacttccctgatgatgactcaagctttggccatgcatagactagtcagcttccagggtgactagagcagggctgttgttgtctccactggcgactcagtctcaacacaggatcaacctgggggatggtttgggtcccaatggctggtccatttgtctcgagcttccggtttcagtcaactgtggtaaatccaaggcacaattcctgcaactttaacagcagtgggagtggacaagattatagtatggagcccatcccatatgggtcccaaagtggttggattccattgcttaacccaaacagtctccaggtttaaatgggttcgctggttctgttaggcttatgggcattctttcccgtactcagccatggatttcttgcatgactatccctaaagcctgcatttgtctccttaaggtcaatttccctagttcacagagatcacccttaatttgacctatgatagggggtggctggctgaacaaggtctcttaggtagaatacccagtttgtttgttgggggtgcatcagactcagaggaggaccatgggcaggatctgatcccatcttagatgagtttcttgacaatattttttcagtagctgtttgagtgtccagttcatgtgcttcacctttcctgagctctgcagccggtaggctgtgtaattttcattttatttttaacagccgtgttagttcttgaactatttcagctacaaatgccagaccattgtctgaccctagagttaggggcagtccaaatctggggataatgtatcttaacaatactttagtcacttctcatgctctctctgttctagtggggaaagcttcgacccatcccgagaagttgcagacgagcaccagcatgtactggtagcccctcatttggggcatcttgtgaaatctgcaagtaggttttcacagggtgtggcccccatttcctgaattcccggggggccaagtgggcccttgtcttgggttgttctgggcacaagttagacattgtttacaaatgtcttgggtgatggcagtgagccatggcacatagtagcatttctagtgccattttccccatatgagttccttaatggaattgtcttacaaacttgaaactcccatttcagggatagctagtcccccattggagaatttccaccattctccttcaatgtactttccagattctcaggcaaaccaggccttctcatttgaagaataacttgagacctctgggagggagggatctgggaggagaggcatatctagggtttctttcttaaaatgcagtgtagtcattgttgcccatttggcctccctgtctgcctttctgtttcccatagtctctagttttcctgccttttggtgactcctgcagtgcataatggccactttctctggggcccatacagcgtctaagagctgcagaatttcttctttgtgttttatttctttgtccctagcagttaagggtcctctttctttatatatagccccaagaacatgcaacatggcaaaagcatatttggagtctgtataaacattgatctttttgtcttttgccagcaaaagagctcatgtcagggctattagctctgcctctgtaggcagaggctgaacctccactactgagtccaatgttaccaccatatacccagctcagcggaccccacccagtataaaacagctcccatctgtgaagtattcaacacctggttctctgagggtttggtctgtaaggtctccctggcttgagaacaccttgtctactgtttccacacagtcatgaaggggggctcccaactctatcaggagcaaggtggctgggttaagggtatttaccgtttccagagttatataaggattttcacataggagaccctgttactgggtcatccttggatttgataaccaatgatgccctctctggtccattaatgttataaccaagtgcggtacccagatggtcagttgttgccctacagtcagttcgtcagcttcttgtgccaatagggcaaagtcagttagtgccctgaggcaaggaggccaccctagtgctatggtgtctagctgcttggatgagtatgccactggcgatgccatgatcccatgacttgagtcaggacccgtatagccattccttttcattcacggatatatagaaaaaaaaggcttagttatatctggcagtcctaaggctggggactgagttaagccttccttgatttgcttgaatgtcctctcctggtcagcctcccagaggaggggctccctttccccctgctttgtggcttcaggtaagggcttggccattactgcaaaatttgggatccagatacagcagaaccctgctgctcccaagaattcttatttgacaccaggtggttggagttggaagcacacaaacagcctgcttttgttcaaggctgagccagcgttctctttggcttactatgaagcctaaatactggacttttcttagatttgagcctttttcctgaacaccttatatccagctttccacagaaggtacagtaggtcttgggttccttggaagcagtccttttgggttgggactgccagaagaaggtcatctatatattccagcaaggcacagttataatttggcagggtgtaggccttgaggtctgaagccagtgcttcttcaaagattgtgagagagtttttgaaccctcgtgggagtcttgtctaggtgaactgtgaatcacccagtgaaatgaaaagatgggctaactggtgctaggtgaagacagaaaaatgcatctttcagatctaagtaagtaaaccaggtagcacttgctggaataaatcccattaaagtatatgagtttggtaccactgggtagatggttacagtagcctggttatagcgcgtaagtcctgcaccggtctatattcaccagatggtttctgtaccagcaagagtggagtgttccagggtgactggcatttgactaagattccatgtttgaagagccattctaagtgtttgtgaatgtcccatatgtcttcttggaaaagtgggtattggtgaagcggaactggagttgcccctggttttaactctactaccactgacgcttgattttcaggcagcccaggtgggttatcttcagcctatactccaggaatcctataaaatagctcatgcagttcatttattcccagttctggtgactcttttgtgtatagtctccattcctcagtctgtgggatggtaagagttaataccatggcctttgggtaagtcagttttaaagtcatatccccttgtggcccaaaagcaatcagcgcttgcagtttttggagtaggtctcttcccagcagggggactgggcaatttgggaggtttggaactcatgctggattttttgtcctcctatgacacacctccttggctgacaaaatggcctcttctctgggaccccagtggccccaacaacagtcatatgttttttggatagtggccctatgggccaggttactaccgagtgttcagccctggtgtctaccataaagtccattagttggtcccctatttccactgtgaccatgggctcctgggggcctaaggagatggagcctagtctggcctagtcttcatattcttcagtctccaccagcccaataaagtcagtgtctgactccctcagggtgcagcaagactttgactggtggccttttcatttcacagccctggccattttcttcactgctctgtggacactagtttttccagtgtcccttctttttgccttgtgcacgttgatccctacctagccttgagtgactttcaggtctctgtccaacctggccctttctgcatcggcatctgcatctgcatcccttgtgatgctagtttccctttctgtgagggctgccactagcagatcagcctttttcctgagcctccgctcagcctcccttttagcctcctggttgtggttaacgtacaccttggaggccacttctaaaagctgggtggcaatcatacctgcaaaatcctctagcttttgcagcttccacctgatgtccccctgggcttgtcctacaaatgccatattcaccatgcactgattttcagcggcctaaggctcaaacggagtgtaaggttggaacgcctcagagtctctcataaaactggctagggctcacatagattccctgaagcacttctgagatctttcctatattgattgacttttttccaccttccctcagcccttgcagcagtgcttctcagtacctctgcaggtgctgaaactgggttgcattattcgggtcccagtgaggatctgtttctgggaactgaccttgagcatatgtctggacattaaatgtgccttctggtgcattggtttctagccagtggaggtaacccactggtttctgcctgggtaaccctttggtgctcctcagtattaaacagtgtcaggaggagctgcttgcaacctggccaagttggattgtgtgtcaggaagatggactgcattagatctatgagggcctggggcttctccatgtaggagggaatataatgtttccagtttaggagatcagtggtcagaaaaggctggtagaagaaggtccattgccccccttggacttgaccctgttcatcataatacatgggtccctgcacctccctgagaggcatttgcatagcctgggcatgaccagtttagaggcagcccgcttgatcatcttgactttccctcttaacctcttggggctccaatctttccttttggggtgggactcagggcatgtcaccatctgaatctgactccttgggggccattggcctcagtaaaggggggtagattgagatatatggaggaagaatttctatctcttctggcagttcctgcaaaagtggtttttcctgtggctttccctttgttttggtggctgacagcgaagctgatttttctttcactgtaggctcagctcaggacatgagtgttttgcaataagctgctaagcagggctacagccacacaggctgagtttggactatatttagccatgagtcaatataaggaaattggtctgggtgctctggctgtaccccgacccaagtcaccaccttaaatacatgatcaattgtttccctatctattgttcctttggccggccattcaatacgaaaagagggccattctatttcacagagagttctcaacctctgggggatcaacttgatcccataatcccgcctttaacctttcataaagttctttaacatacattctaatgggatgggttttgatgacttccctcccatgtcctccctgttacagcacaacacattcactctcacttttgcttcagaccaattagtccacctcctccgcgggagttttcagacaccacttagctttaatggagggtttgcatgagccccaaacccgggccaccacgatcactaaattgtgaggtgcctccctaagccatatgcagtagccctggaaggcattcgccattagtcccggttgatcccacacttcgctcggagtgtatggtatacgctaagaggcctgtggcccccacacttcactccctgctttggttccttctggaactgcctctttcacatgcattcacacacttctccactcccagttcccctttctaggctggggtgtcagtttcatagagcaataaatggttaaaaataaagtggttaagatttgttcaagcacctaattcacaaaaacaattttctagtctctttgtacaactagcttatatttgttatgtgtatgaaaatgtccttgcttgtgagtcaagtgtggaatcctagggaaagttatgattgcaaatgaagcattgaagttctatagcagtcattggatttgtcttttacttctctccaggactttcctgacacctggaaatgtattattttccacaacaaagtctgggaaatttatattttgtcattgaaaatagaataccaagattagttaagtaatagtccaagagaagatattgaaagcagatattactattaatagatcaaagccacatccaatgcaagagatatagactgaatcataagtatattgtcatgatactatgggatataaaataaaaatttcctcctcttcaaagatcctggtgtatttggataaactaagccctaattactgtactttaaatcatttaaaataatctgacaataatattgtactatacaaagatacatttattcagtattacttaatgggatatttattgagtgttattgtgtgctttaggcattggatgtacaaaatgaacaaaatagacaagattctgatctaatggagtttacattcaattgcacaaaagagataatgagtaaatcaaacaaataaatgcataacaaaatggcaagtaatgacatatgctatgaagaaaaattgagtaagataaggagagagagccaccataactaccgtttaagatagaggagctagaaggtgacatttaaacaaaaatttgaacaaaatttgagaacaaaccatagaaatgtctggatgaagaacacacaagtgaaggaaacattaagagcaaagttcttgaaatgaattaataattgtcatatttgataaagagcaagaagtccattgtattctaagcctggcacagaagcagggactgatttcagagaaataatcaggattgaaatcatgtagattcattcaagctaaggtgaagggttggaacattattccaaatgtcattaaaagccttgggggatttgggatataagaatgtgatgagatggtcatcacattacatcagaaatggtcaatgtaaattctctataaagaataaactgcagcatgctactcataaaatgaatgtgaaagtgtcctattcacctaattttggggggaagaaattaagaaggattggcattacttctttaaatgttcatcaccagtgaaggcaactggccctggactttcctttgttgggaggttttcaattactcatttaatattcttgctagttatgggtacagtcagattttctatttctttataatttcatcttggaaggttgtgtgtttctaagaagttatttcatctagattatctaattttttgccatataattgttcatagtagccttgtaggattctttttcaattctgtggatgagtggcaatgttttctctttcacttcctattttatttattcgagttttctcttttttacttaatctagctcattacttatcaatttattatatttcaattttatattttgtttctttgattattttctattttttattcttcattttgtttatttctgtcctaatcaaacttaaaaaaaaacctctgcatagaaaagaaacaattatggaatgaaaagacaacctacaaaattggagaaaatatttgcaaaccatatatttgataaggaattaatctccaaaataaagaagaaactcctacaactcaaataacaaaaataataaataaagaagtaaatagaaacagtcaatgaaacaaataacctaattttaaaacggcaaagaacttgaagagacattttttacaaagataatatacaaatagccaacgagtacataaaaagatactcaacatcactaatcactaggaaaatgcaaaccaaaaccacaatgagatatcaccttacacctgttaagatgactattttatatatatattatataaatgtataaaatacaagctatatatttaataagctatatatatattataagagctatgtatattatatctgtgtgtgtgtgtgtgtgtgtgtgtgtgtgtgtgtgcacatgcctgtatgagtatacaggataacaactgctggtgacgatgtggtaaaattggaacccttacaaactgtgagtgggaatacaaaatgatgctactgctgtgcaaaacttatggagacactaaggagtttcctagcaacaccatatgatccagtggcacatatctaaaaggattaaaaccaatgtctcaatgaggtacctgcactctggtgttcattatagcactattcactatagtcaagatctaattgtccatcaacaggtgaataggtacaaacaatatggcacattcatacaatggaatattaatcagtctttaaaaaaaggaaatcttgccatgtgtaacatggatgaacctggagaaccttatactacatgaaatagccgttcaaaggacaaacagtgcatgatattacttatgtgaggtgtataaaatagtcaaacactcagaagagggtagaatggtggttaccagggacttggggaaagaagaactgtggagttactatttggtgagtataaagtgtcagttatccaagattattaaattctggagattttctgtaaaacattgtacctataattacagtaacagattgtacatttaaaaatgtgttaaggggtagatatcatgttctgttctttccttgatacaaaataaaagtaataaaacttttttaaaataataaatactaagggagggagattttttcagagagaccagatagagtctgattatagtagtttaggtgagagatgatgatattatgccttagaatttgtaacctatcatttcagtaatcattttgtgtgttacttgtatgcttgttttctaaatcaaaattttattcctgatatggtgtggctttgtgtccccacccaaatctcttgttgaattgtaattcccaatgttgggggagggacctagtaggaggtgattggatcatgagggcaaatttcccccctgctcttctgaagatagtgagtgggttctcacgagatctggttgtttaaaagtgtgtaacacttcccccttccctgtatctctcctgctgtactgtgttaagacatgattgcttccccttcactttccaccatgatcataagtttcctgaggcctcccagccatgcctcctgtacagcctgtggaactgtgagtcaattaaacctcttttcttcagaattacccagtctcaggtagttctttatagtggtatgagaacagactaatacaattcctttctataattctcaaataagcatatggccttatgacttagaagaaagaagaccaattgatacattgggtctgaaaaacatatataacttaaatgctatttgacactggctaaaagtctctgatgttttcttttattacttgccaaaacattccccaatcactcttttgcatttgcttcatacaattcagcatcatcttctgtcatctctgaccagctgctctgattgtgaaacttcaaatagtttctctaatcaccagcctcccatgactgtgttttaagttctgaaaacaacctgggataaatttagaaatcaagaacaaagcacatatgagactctagatttaacagcttgtgccttttaatggcatctgttatcatgtctttgaaaagctatttatcaccccaactccctactgtactatttgaaatgggtggcttttttatcttcctcacccaaacattttatgtaagcaagatcactaggatgagaataggaatatccattttaaaaagaactgatttctgtgtgctttggaaaaacttaatgtgaatcttgtatcacatatacaaataaaattaaatataaaaatttccacaatatttcaaagtacctatagccagtattatcagcttgacatctaattggatattccctcagtttcacacagacatggaaaacgtgatataatcaaacagagtggaaggtaagaatataatggttgatattaatgtttcattttatgccattgagcaagtccatcatcctcatgggctacgattacctcacttgagaaattaaaagttttattcaaatatacttaagttcactttggggtctgagatgttagtattttttagaaataaaaatcttccatgtttagttctcaaacaaaattgtaatgtgaatcactaagaaataggacaggtttgatctttcactctacttgttctatgcattctattaccaacatagacttttagttgagtgcatattaaattagtgatgcacaatacaaagtaatttagcttatagtaaattttaatagttgtacaattgaattttttattctagttttagaaaaatagaagtgtttgtacacatttcaagaacatcagtaagtctggtaagattttctttaagatatctgttaggtttggggtgtttttattatcttccacttgcattaattcataatacaagtttttctctctcttcctttcagcatctcaccagtttctttctataagtagtgttaaagtttgttcggcagcagcagattataaaacaaactaatctcatgagcaggagaaaatcactgggctcaaaatcttgcctgtctggagacagtcagactttccatcagggacctgccatctctagctccacaaatctactcctacaggctctttgtctgaaatgaacaaggtaactccatgaaacataacatgcttagatgttctgttacttactatttccctttattattcagtttgcagaaactctgtagactatatctcttgaagccatgaataaaccccatcgctattcatggaaaaataatacatgacatttttattttacagacaatttcccatctacagaaatttaatacttaaattcatgataaatgtgtagagtcagatagagtgtaacgatgccagtatgtgtcaatttgctactttaatgtgttccgtcattttcatctctcctgttttctgagtgatagtaattgatgctgcaaaaggacaaaccaatgtattgtgttcctctcttcaggaagcaaaagtagcatcttcctgcattgaaatgaaagccaaaaagggcatgagccaaaggagagaactaatttagttatataattttagaaataagatgtgagctcagtttgttcaaggtagggccaaggcatctgttagtcatagtcatacacatgtgcaggtcaagattcactttctaaagcctcactataccccagtaaaaaatagaagatcaatataaacagccataaattttagatagttttatcagtttccaaagataagcatcaatcagaagagtaacatcagcaaaatggctgaccaacagacccttgaccttgtccccctcacaaagtcaaccagagcaatgactaaacaaatacatattaatgaaaataactgagagagagggccggagtgcataagaggagtaacagaaaccctgttgagcacagaaatccaggatagccacataaagaatagaaaaaaatcccaggcttccaccatcccatcccccaattgagattagctgggagccaggaggaaattttccccacagcatggaggtaagaaagaagatcgcaacaactcttttcaacaccttagacattgataaggtttggctctgtgtctccacccaaatctcatcttgtaactcccatcattcccacatattgtggaagggacccagtgagaaatgactaaattatgaggatgtgtctttcccatgctgttctcatgatagtgaatgggtctcacaagatctgatggtttaaaaaatgggtgttgtgctgcacaagatctctttgcctgctgccatccatgtaagatgtgacttgctcctccttgccttctgccatggttgtgaggcctccccagccatgtggaactgtaagcccaataaacctttttcttttgtaaattgcccagtcttgggtatgtctttatcagcagcatgaaaacagacaaatacagtaaactggtaccagtagagtggggtgctgctgaaaagatacctgaaaatatggcagtgactttggtactgggtaacaagcagagattggaacagtttagagggctcagaagaagacgggaaaatgtgggaaagtttagaactccctagagacttgttgaatcactttgaccaaaatgctaataatgatatggacaatgaaatccaggctgaggtggcctcagatggagatgaggaaattgttggaaactggagcagaggtgactattatgttttagcaaagacactggcagcattttgcccctgctctagagatttgtggaactttgaacttgagagagattgttaggatatctggcagaagaaatttctaagcagcaaagtattcaagaggtgactgggtgctgttaaaggtgttcaggtttttaagggaagcagagcataaaagttcagaaaatttgcagcctgacaatgtgatagaaaagaaaatctcgtattctgaggagaaattcaagccagcagcagaaattttcataagtaatgaggagctgaatgttaatctccaagaaaatggaaaaaaatgtctcgagggtatgttggagatcttcacatcaggccctcccttcacaagcctagaggcctaggaggcctaggaggaaaagtggttttgtggctgggcccagagtccccatgctatgtccagcctagggacttggtgttctgtgccccagctaaaatgggccaatgtagtgctcgcgccatggcttcagagggtgcgagccccaaactttggcagctttcatgtggtgttgagcctgcaggtgcacaaaagtccaaaattgggtttgggaacctccatctagatttcagagaatgtatggaaatgcctggatgtccaggcagaagtttactgcaggggtggggctctcatgaagaacatctattagaacagtgcagaagggaaatgtggggttggagctcccacacagagtccctgctggggcaccacctagtggagctgtgagaagaaggccaccatcctccagatcccagagtggtagattcactgacagcttgaactgtgcacctagaaaagctgcagacatgtaatgccagcccatgaaagcagccaggaattcagctgtaccctgcaaagccacaggagcagagctgtccaagaccacaagaactcactacttccattgacatgaactggatatgagacatggagtgaaaagagataattttggagttttaaggtttgactgccccattggattttgtacttgcatggggcctgtagcccctttcttttggccagttgctcccatttggaatggctgtatttacccaaagcctgtaccctcattgtatctaggaagtaactaaattgctttagtttacaggctcataggcaggggggacttgccttgtctcagatgagactttggactgtagacttttgagttaatgctgaagtgagttcagactttggaggactgttgggaagacatgattggttttgaaatgtgaagatatgagatttgggaggggccggggtggaatgatatgttttggctctgtgtccccaccctaatctcatcttgtagctcccataattcccacccattttgggagggactcagtgggagatgattgaattatgggggcgggtcttcccagtgctgttctcatgatagtgaatgggtctcacaagatctgatggttttaaaaatgggagttgccctgcacaagctctttgcctgctgccatccatgtaagatgtgacctgctcctccttgccttctgccatgattgtgaggcctccccagccatgtggatttgtaagttcaataaacctctttcatttataaattgcctagtttcagatatgtctttattagcatattggtccatgaaaaagaaccaatacagacatgtacagatctcacctcaccactggggtcccatatagttcttacagtcactaagcccagctaagggagctacccagaattaaggtagctgtgctcttccagagaaggagcttacactgttccccaccccagtggccacatgactgctgtcctatatcatcttggaattagaactaccagagtgtgtcttacactgggggcaagcagtcattgctgcccttcattaatgagactaagttgccagtgggccacaccggtctggtgggctaacatcccaaagccaagctgcaagcagatgttatatccttccttgtggaaccaaattgaagtagaaccactccaaccacttatccccttgttccctgtgcctacagctgaagtggtaccatctctcctaagaaatattaccttagctgtcagagcagttatgtctccaaggtgcctgtgttgaagcagggccctatatgccggaaaatgttcctttggctgccaagagcaatcacatgccccagaacctaaggagaagagccacctggatctcaggaaaatggtatttgcactgtgcataaatatgtctatccagctcacagacatgagcttaagctcattgccctctgaagaagtggaactctggctgagctgagaagctaaacatcccagagctaagctgatgtagtaccccatgtcccataaaaatagagcagtggctcagctgccacatttcatcatacaggcgaaacatctctagtaccctgcttgcctggagctggactagcccccttaagcatgagctgctaagatacctccctccctgtggaatggagccatcactgagctattctctaccttgctgcagggtccaaatgatggctgtactctgccattctgtgtttcttgctgctgctgcaactggcctcacagactctgggataccattgaattctaccatcccagagtatacagtcaatactacacagtgcttcattccctgagatccaacttgctactgtaccctattaaaatgggttttctgagccctgtttagtcagatttaaccccttgggtagaatcacagctagaacctgacaccctgagtcgaaactgctaattggtgcctcagagtcacagattctggctctgtggtcaatctacaccctaccaagccacagagagtgaatcatcagccaaagaccaaggtgccacaataggtttgcaagccccttagcctatgactgtggccccacagccactccaagcacctgtgcctggaacccagtgctactgcagctgcttacaggctatgtcagacttgagaaggatactctcaatttgaaaagtggaaatagaaggacacaaaaaacccttgacactgaggacattaacaacttataccgccactgatgctcccacaaacttccacagcataggccactgaggcacctgaagtcattggtgagattgaatgcagctgcaaaagctgcacagagaccacactactgcacctatccagaaatgcttatcatacccttcacaagcagcatactaaaacccaaatgcaaatgaaagtctttctctacaaagaacactcaagaaagttttgaagccataattgctctaccagatgcacagacattgacaaagaaacatgagaaaaataaaaaataaaggaaatgtggtgccatcaaaggaataaaataactccttagtaacagatcccaatgaaaatagaatcaatgaactttcagaaaataaattaaaataattgtcttaatgcaactttgtgaggttcaataacaatacagatggacaagtcaatgaaattcaggaaagaaaaactatgatatgaacacaaattcaaaaaaactataaattatttaaaaaataaatggaaatcttgcagctgaagaattcaatgaatgaaatagaaaaatacagtaggcagctacaatagcagacttgaccaagcagaagaaaggctctccgaatttgatgatcagtaatttgaaattactcaaagaaaaaaatgtaagaataaaaaagagtgaggaaaacctacaggtcttacaggaaaccgttaaaagaacaaatgttcatttgatgagagctagacaaagagaaggaatgaacgaggcattgcaaatctgcttagtaaaataatagctgaaaatgtcccaagtctagagtgagatatgagcatccaggtacagaaagtttataagaccccataaaggtcctctctaaaacatgttatagtcaaatgtcaaaagtaaaagccaaaaaaaattataaaaatagcaagagtatcaaggcacataaaagggaatctctattagactaacagcaggttttctgcagaaacgttgcaaaggaagagaatggaatgatatattcaaagcactggggaaaaaaaacttgccagccaagagtcctagcaaagctattcttcagaaatgagagagaaataaagtttttcctatacaagcaaaacctgagggaattcatcattacaatgctgatcttacaaaataatgctcaagggactcctgtatctagaagtgaaagatgataatcattatcatgaaaacacacaaaattatgaaattcactaatatagcaaattcaaaaagaagaaagagaaaagaattctaaattatcactatagaaaaccaccaaattgcagtgataaacagtaagaggaagaaagaaacacaaaatataaaaaaatgaccagagtacaatgaacaaaattacaggactaagtccttacctatcaataataaccttgaattaaatgtattaaattcagcacttataatacatagacttgaagaatggaaaaaaaacactcaattatatgctgcctacaagaaactcacttttcctgtgaagttatatagactgaatatgaagaaatagaaaatgtactccatgcaaatggaaaccaaaagccaacaagtgaggctacatttatatccgataaaacaatctttaagtcaaaatctgtaaagagagacaaataaggtccttatataatgataaaggtattaattcagtaagagtatataacatgtctaaatatatatgcatccaataacagagcacacagatatataaagcaaatattacctctaaagggagagatagactccaatatagtaatagtttgggatgtcaacatttcactttcagcactggacatatcattcagacagatgatcaacaaaaaaacattagatttaaactacactttagactaaatggacctaatagacattacaggacatttcacccaacaactgcaaaatatataagcttctcatcagcatattcaccaggacagaccacatgttaagccacaaaacaagtctcaacaaatttaaaagaattaaaatagtatgaagtattttttctgaccacaatggaataaaactagatattaatagtaagaggaacttttgaaattgcacaaatatgtgcacattaaaaaacatgctactaaacgatgaataaatcaataaaaaattaagaagaaatcaaacaatttcttaaaacatggaatagaaatgcaacatgccaaaactagggatacaacaaagggagaattaaggggaaagttaatagcaatcaatgtcaacatcaaaaatgtataaagatttcaaatagacaacgatgcatctcaaggaattagaaaagtaagaacaaattaaatttttaaaaaaaggtagaaggtaggcaaaataaattttttgaaaagagaaacaaaatcaatgaacacttagctacattaaccagaaaacaaaagaagaccaaaataaataaaatcagaaatagaaaagcagacattatgtataataccacagaaatacaaatagtcattagagactatcatgactattacaactatacacctacaaattagaaaatccagttgaaatggataaatgtttcgacacgtacaacctaacaagattgaaccaagaagaagtagaaaactggactaaaccaattacaagtaatgagattgagtttttaacaaaaatccttccatcaaagaaaagcctaggacctagttgcttcagcgctaaacttaaccaaacatttaaagaattaataccaattcctctcaaaattttccagtaaatttaaaagtagaaaattcttatgaattaattctacaagaccagtattaccctgataacaaaaccagaaaatgatacaacaaaaagatgaaaattatacttcaatgtctctgatgaacatggatgcaaatattttcaagaaaaccctagcaaaatgaatctaatagcacatttacaaggtcatttatcatggacagatggaatttatcccagggatgcaaggatgattcaacatgaaaatcaataaataaaacacatcacatcaacagaatgaaggaaaagtatgatcatctcagtagatgcagaaaaagcatttgataaaattcaaattcaatactctttcataaaaactgtcaaaaagttagatatagaaggaatgaacctcaacatgaagcccacatataacaaactcacaaccaacatcatactaaatggaaaaatcttgaaagcttcttgtctaagatatggaataagacaagggtgcccacttttaatcaacatagtactgaaaatcctagctagcacaattagatgagagaaataagcaatggctatccaaattggaaagtaaaattctccctctttgcagacaacataaacttatatttagaaaaactgaaagactcctccaaaaactcttagaactgataactgaagtttttaaagttgctggatacataatgaacacacagaaattagtagtgcttccttacaccaacaataatctatcaaaaaagaaatcaagaaagcaatctcacttataataatttcaacaataaaataacatgcccaggaataaattcaactaaagaggtacaagagctctgctatgaaaactaaaaaatacagatgaaagaaatttaaaaggatacaaacaaattaaaagaatcctatgttcatggatgggaagagctaatattatgaaaatgaccatattaccagaagtaatctataggttcaattgaatccccaggaaaataccaatgacattcttcaaagaaattatgaaatttgtatggagccataaaagactctgactaggcaaacaaccctgagcaaaaagaataaagctagagtcatcacactaccggacttcaaaatacactacaaagttatagtaatcaaaacagcaacttggtggcataaatcagacacatacaccaaagaaagagaatagcaaataaataaataaatctacatacatacagctaattgatacttgacaaaaatccaagaacattcattggggaagggacattctcttcaagaaagtgtgctggaaaaactggatatacatatattaaaaaaacagattcctatctttcatcatatataaaattcaacgtacaaggaactcaaacaacctaacagtaaacaaatacacaatccaattaaaaatgggcaaataagctgaaaagatatctctctaaagatgacatacaaatgaccaacaggtatatgaaaaaatgttcaacatcattaatcatcatggaattgcaaatcaaaatcacaatgtgatattatcttatgctatggttattatcaagaaataataaatgctggtgaggaggcagagaaaggggaacttttatacactgttggtaagaatatgaatgagtccagccattacacaaaacagtgtccacacttttcaaaaaagtgtccacacttcaaaaggctaaacatagagttaccatgtgttccaggaatcccactactggattcatataaaaaaatctgcatgtcaaagagatatctgcactctcatgtttactgtagcattgttgacaatagccaagatatagaatcaacctgagtctccattaatagatttatcttttaaatgtggtatatatacacaattgaatactatttggccaaaacaaaagaacgaaattctgtcatttgtggccacatggatgagcttggaagacattatatgctaagtgaaataagcaaggtgcagaaaggtaaatacctcatgttcccattcaaatgtggaagctaaaaaaattaatatcatagaggtagattgtagaataatagttactaaaagtgaggataggtggcggggagaggggatagtcaaagttggttaacatatacaaaagtacagctagataggagaaatgcattctaatgttctgttgtattatatggtgattataaataatgacaatgtattgtgtattttaaaatagcaagaagagaggattttgttgaatgtttgcaacatgatgaaacaataaatatttgaagtaacggatattctaattactctgatttgctcattgcatgttgtatacatgtattgaaatacgctgtaccccttaagtatgtgcatcaattatgtgtcaattaaaattatttaaaaagcaaaataaatatgtataaacatcttaaaaagaagtatcagtaaattacctgaattgtgccctcaatttttcatctttatttttttggttaagtattaaattgtgtgcctttttaactaaatattttgtttaatttcatttaatcaaaaactttcttctaaatcttcactaaactcggacaccatcatgtcctaagagaaaagtataaaagttttgttattaaattagctcataaatacagaaatatatatgcaatatcataaagggggtatcacttaccagtttttttaaaatttgtaattgctaggtttaagatgattgtgtaaacttcagctttcagctgtcagttttatatcacctgcctttcctgtacacattattttcatctgttacagcaatgtgttaattattttgtactgtagcttgttacagtttaataatcttaagttgatgaaacaaaacaaggagaaatcagaaattagaattcatattacttccaggttttaagaaaaatgtacatagacgtttgtaaaaccaagtatgtgtgcctagataccttatttgaaatgatgaaaattgacacacatattacagaatctcctaaaattagttcattaggtcctatggatctttggataaattggagaggatcagaaaaaataactaatgggtactaggcttaatacctgggtgatgaaacaataagtacaacaaacccccacgacacaaatttacctatggaacaaacctccacgtgtaaccttgaacttaaaataaaagtttaaaatgggataatttgaaacatcaagaaaatgtatgcatcatgttagtgttacttgctatacctatactgttcagttgtatgattttttgttgttgttgtttttgttttgttttgtttgttttgtttttgagttggagtctcactctgtcgcccaggctggagtgcagagatgaaatctcggctcactctgcctcgggggttcaagcaattctcctgtcttagcctccccagtagctgggattacaggcatacaccaccacacccggctaatttgttgtatttttagtagagatgggtttcacaatgttggccaggctggtcttgaactcctgacctcaggtgatttgccagcctcggcctcccaaagtgctgggattacaggcatgagccaccgtgcctggcctgtgtttgttcttaatttgctgtttggaaaggtttgatgtacatttaagttctattgacacttgctataaatcttacaatatttactttaaaatatttaaatgaaattatatctcaagtatctcagacaaatattttatgccttaagttgtaggtgggctattggtatgtccatatgacttttttcaaatttctccgtaagttatttttgtcttccagctgctgtgctcctcagaattttttaaaacattcatcttgtttcaaaggtaaaataagtctgaaacaaatattcttaattatttactctgatatttatttactttttctaattatatgactagaggtccttcttggatccaaatatttgtctagagtctattctatcagtattaatgataaacgcaatccatttagcttagccaatattaatctcaaatcaatgagaattgtactatcattcaaatccaatgtttactactaaattgttagttctaattcataaaatgttttagatttatctaagctaaaaataatctaaataatctgaaaatgaaatttgtgcataaaatgagatgttaattcagggatttgtttttgagatgttcattatgctggagaggccacagacatgcagttctattatataacccttagtacagctgcttagctacccacattattctccttgggttcagctctctggagtttgccataatttatatcctcaccaacagttttccctataggggctgctatatagagacctcatttcttaattacagtgcaaaactgcaagcattaaatttagccacaatcacaaaaatacctatatatgtatctgtatgtgactataactttaaaactgaacagcagtatacatgtccttccatatgtaaattttttttggataagtaaaagcatatttgatatccagattatttttgactaagtaaaacagaaaatgtgtgaatatcagactggatgcaaactaggttccaaatttagaaacacaaactcaattctaataacgattatttattatatcattttatttagactcaaaacgaaatactagacatttaaaaggcttttgataagaatatctttttaactttaaatcttctatcgaacattaatgaatcatcaaacatattttatatatctctagttataactagaatttttagaaacacaatattcaaaaaaattattaggcagccatcacaacccatatcttagagatttaggctgaatctcattagataaattaagttcccaattgccataaagtagagataaattagaactcaagaatcattttattttcaacataatttaatctcaaaagagtactgttaatgagaaaaacataatgattcttaagattctaattaacttaccatgtgagatggaggggaataaactgaagtactgaaatgaagcaaaataaaaaacatccaaaaatttagaattaatattgtgaaaattgtcatggtgtaagcaattacaaataattttatcagaaaaaatagtggaaaacactaagttattagtgaatgtgactacggaacatattttcaataatcagaaatataatccagattgcttttaaaattcatatttaacaaatatatatgataaaacttgtttaaaagtcaactatttctgaaatgcatatattttccaaagtgtttcttgtctctttatgacctcaaaggcaaacacatttaatatttaactatttcatttggtgattttctccatagatccaaataatatgaatatactattatatattacataatcaatttaaacttcttactataagatagtattattctttggctaatttatacctttcagtttccactcaatataattatgcctaaatttttacttaaaatcatttagtatttccgtgatgatttttcaaatattcctcactgctgagccaagaagtctactctgattacatttccttcctttaaaacttaaagtttcttaaaccttgaaaagagttaaaaattcctatccctccccatttgatttgattttctttgaacttacaaataaatcaccacacaaactccagaaattctgtaaaatgcctcattttaaaatttcccatattgccaaagctttcatctcatttttaagcatgcttcatgtttccactctcaagactacttgtgacatctgactttctactaaaatagcatctttgtgcacttcagacctgcgatacaaccatcacacagatactccattttgctgtgatcttgctttttctcttccttccctccttccttctttcttttcttttcctttcttttttcttttcttttctttctttttttgtttctttctttctctctgcccctcctttctttctttctttctttctctttctttttcttcctttctttctttctttctttttcttctttcatctctttctttctgtctctttcttttgaatctctactgtgttgtgtgttctgttccctggatgacagttctgcttctgtcttgacttctcttgttttgatagaaaccattttcaaagggcttctgtaaaaaaagtacatgacagtcaaattttctatactttctatactttgaaactaaaaatactttattctactctgatatttattagtttgaatgaataaataattttagattgcaaatacatttttcttctaaattttgaaaatattttctaatattcttgtttctattgcatttaagaaactgatattattctgatctaccatcctttgtatttagaaaacttatttgttatttgaaaaactttagtgttttaattgtctcctaatcaccctgttaatgagggaggactgtcactctgagttatgggagatgtttaaaacataatatcctacactggagagataagatcaacagcgttttattagttacatgtacctacagttcagggaggtggacactgtagtggtttgcactcaggaacagggtgaacggttagaagctgtgggaggcaggatttgtagtatcacgaagctgaccttatctgtaggagcaaagtggtggttggggaacatttgcagtgagaccattagaggcactcccaatttaccaggtgtcaaggcagagaataatattagttttaggacttattttagtaacatctctttactttctatgctgtaaaattccatgataatatattttcataagtttatttctcatttcctgaaccaagcatgtagctctttgaatcctggaaattcatacctacacttctgagactttttttttaattatcattttaagaatttcctttcctctattttcacttttcttttttttttttttttgctgaagttctgttttatccaggttttgacttcttcaattactttttcttttttattttctcctattgagcatcatcttgtcttccatttctttttcttgaaaggtaagatttgacatttctacaaatgattttactatttccataaatattatttttgaatttttgacttttttctctgaatcatttttaagcactgtttaatagttgtcatatcctctccattttctctgaagatattactagtatatttcttctcctattattgtctccatttttttctatttgtttgctttatttatgtcattcatttttaaatgttggcagcccatttaaacttacaaacaaggccctaaaaattgaaagttctatgtggattgaatttactggaaggcagtcaagtctcctatttgggtggtaaatataaatctgtctgctgttgtttaggatctacataggcaaaagggctgggtagtctcatttttgtataatgcaaactgggaattattgaactgtatactcagaatagcaccttctccttaacttccacttttcctaaggtccctaatacacaaaatacacttccctgctgtatacctacattgggtagaagatctgagggactaatatagactccccctccctttttttttttttttaactaacttttcatcaagccccgttttttgtgccaatactcacgctgtcacagtacctgatgtgtctgtttccatgtctttccaaaggctctctgggtctgtcactacacccctacttcttcagctgcatcccaacttaaaggcaattagttatgacatctttttctttgctaagttatttctcatttattcttctgacttatgtattctaataccgtgggtcacttttgcaaatttatcctactttcattgcagatgaattttgtggttgtattccgtgacatccttgttaatttgttaagatttttttttcacagatgaggtgggaagcagtatctcttttccatgacattgaaaccagaagcttggacaggaattaaaaaatttatttttctattttttatgaagcatctcttgtcattttggcattctttcttgtcaaatcattgtgaggtgggaattcaaaaattacttcaaaataaagatacattgttaaaaattaatatagacaactataattcttaaagaaatatcaaagatggtggaggatttagggcctatttttaattaatttgaaatatatttgaggataaaaataacactaatataatcctttggttatataccaaaggattataccaaatatatacccaaatatatatatttgggtatatatcaaatataacccaaagaataatattagtgttatttttatcctatattaataattgtctatattaatttttaacaacatatctttactttataaatcatgctgctataaagacacatgcgtacatatgtttattgaggcactattcacaatagcaaagacttggaaccaacccaaatgtccaacaatgagagagtggattaagaaaacgtggtacatatacaccatggaatactgtgcagccataaaaaatgatgagttcatgtcctttgtagggacatggatgaagctggaaaccatcattctcagcaaactatcacaaggacaaaaaaccaaacactgccttttctcactcataggtgggaattgaacaatgagaacacttggacacaggaaggggaacatcacacactggggcctgttttgcggtgggggtagtggggagggatagcattaggagatatacctaacgtaaatgatgagttaatgggtgcagcacaccaacatggcacatgtatacatatgtaacaaacctgcatgttgtgcacatgtatcctaaaacttaaagtataataaaaatatatatataaaaaattaaaacaaaacaaaaaaccactaatatcttgaaattactgtatttcttcagagtcaaagtagggaaattatttttaaaatcctagatctttgcaagagatttgagctactaagacaccaaagagatttaactatgtagtgtactactagaagttaacttcatataaggaatcagagcatgtctgaccagatttatgctttaaaatggaatttaaatgtatgttgcaaaagttttcatcagtggtgcaaaaaagtaatagaaatttaaagttattatattcgtttctctctttccttttataaacatcaggattcacaattttttaagagaaataagatagttgatcatgactatctacccatacattggaaaaacatgagaagctttgacttagacctcatcaaaattttaacagcattccaatacttaccatctttcacatctaactctttcacattaatataacttgttccaagaatgtagactatactttaatccttaatacatcataaggtaccatttcccaatatgtattcttcagaatgctcacatgggagacacacttacagtaaatgtttctgaggtcagtatttttagaactttgactccaaatgactttttatgatatttgaaatgcttattcacatactgcaagtagtgctgatccatgccctaacttaatactctttctcatcatgttttgtcaaacttatctgatccagaactgttgtttattatttatttctaatataacatccagacactatttatttcagcaaagtttcacaaatttagttttctatttttctatggttattttttgttctatttttatttgttttttaagtcagaaattcataacctaaataagatttaacaggagttagctaatcaagacatttgaggtcttaaaactctgtgaatagtacatataagccaaaattattctacttgtataaatataaaatgtgaggaaagagtaataaatacaattgctacttcttcttcttcttcttcttttttttttttttttgagacggagtctcactctgtcgcccaggctgcagtgcagtggcgcaatctcggctcactgtaagctccgcctcccgggttcacgccattctcctgcctcagccttccaagtagctgggactacaggtgcccgccaccatgcctggctaatttttttttctttcttttctttttttttttttttggtatttttagtagagactgggtttcattgtgttagccaggatggtctccatctcctgacctcatgatccgcccgcctcggcctcccaaagtgctgggattacaggcgtgcgcgcctgacctaaaattgttacttctttcttcttatgctatatgttttcagagctttaaaaagacacatttaagtaagtcaaaagataacctctcaggtaagataggaggttttaaaatacagcaataggtgcaagatgttgattttgttgctaagatctttttttttttttttaatctgtggttctaatttgtttcatcccttttggttctcacttgttttaaccggtacttctgaagcctgtggtttgtctcacttcaattaaattcataggatttatactcccttcttcatcactggttttaagcaagagattcccatcaccttactctcaggagaggtctctaggctcaacttccagggtattttttatgtaagtaatggagtattaattcaggaaagaactacattgcattatacattatatttcagaagtatttaggtgccaaataggtactttctaaaacttgaaaaaagtacgaaagaacacaataagaatgcatttagttactctctattaaaaacacgatactcctctccgtgttcatgactgctttcttgttgctgacttggtttccaggtactaatttacatacagcaaaatccaggatacttaatccattccccagctgagtgcttcttgtacttcatgatttgatttagcattcttgagtctggactctattctgtaataatcctgatatgacgactcaagaagggtctggactgcttttgacaggcaaagaaaattctactgtagtcaaataagaccacttctgccgcagctcctattgaccattgaagtctgactgtcagcttgactgcaagtggaaaactggagcacttacatttcacagactttatttgcacatgttccaggcttattattttcagggcatattttgttggagagctgaaatcacctttttgaagagttgagaaggaaatgagaatagaaaagactttttttaaagagacagaacattgtcttcaatcctcctcacttcatataaaagagcatttaaataaatccttgctcttataagccacattaccaataattttaggcagaaaaaatcaaagtggatattattgtagcttattcaaactaatttatttaaaattggctagagatgtagctcctacaaagaacccagcactatatatagcatcaatattactaaaaagaataagaaggataggtactcagggattatgggtgaagacagacatgtaaatacatatggcaaaaactgtgattattctaataatagaattatgtttcacaagttgtggtagcaaaggctaaatgcacatagaagttaagtagtgagatagaacttgacatataaaccccaaatagagaataatcattaaattaatttattgagaatgctgtgtgacaaattatgactttgattattaaagactttaccgatattgccttatttaagctttcccggaagtcttcaagattggtcttgtgaaaggagaaaaagtatataagaacagagaaatgagaaggacacaacatgtttgagaaagagatgagttgttttgtgtttataaaatgaacattacacaccggggcctgtcaggggctaaggggctaggggagggatagcattaggagaaatacctaatgtagatgatgggttgatgggtgcagcaaaccaacatggcacatgtatacctgtgtaacaaacctgcatgttctgtacatgtatcccagaacttaaagtatttaaaaaaaaaaaaaagttgtgttttgaattgagaaggaaccacttgggcccagatagtaaaagtattttaatttattgttgtgttttgttctattgttttattttaaactggaagtaatgcaatgttatcaaattgttataagtaagagagtaacataattagatttatttttaataattttaaaatcattacagaataatctagttaacccatgagatgagcaaaagtgaaagaaaaaaaccacaggagagtatcaataattaagaaggatgcaaagcaaaagtggttcacaaacactgctagtaacagccaatttggacagcagtgggaatatctaattaaatggggaatgtatatacctcctggcgcattagtttctcttctaagtatataccctagactatatttgacttatgttcgcaaggagacatttgaaaacatcccttgcaatgctatttgtagtggatgaatattagaaacaatcaaaatatgccatttactgggaaacagagaaggaaaatgagctgtaagttgaaaagctgttgagaaactaaaaccttccataggtaaacaaatatatatctcaaactcataacattgagtgaaaaatcaggaagtgccaagcaatatttttatttgtattaaaaactacataaaaagaaaaagtgtatagcaaactcaaaacaacttttgccccagagaaacagaaagggaatggaacttggcataataatgaacactttagttaagcttcatgtgaaaatatgacccatgtgtaatttttttttaattaatgcatttttatgtcttgaaatctaaaaataactaatcatgggaatggaaaaccttggtgattatcctaataatcttttagtttttatatattgaagaaacgttaaccacaatagaattatcatgtgaggagagcacattctcaatagtttagataatgcaagagtgaaatgaaataccagtagtaaggatgacagtattagaaaattaatgaaatggagctgtcattaactgaaataagacaggatagaaaacaggtttggagggggagtctagaattttagcttgaacaataatgcatttgacttgcacaaagttatccaaattaagagagttgtaataaacgtaggaaacttggccaggctcacgcctgtaattccagcactttgggaggccgagactggcggatcatgaagtcaggaggtcaagaccagcctagccaacatggtgaaaccccgtctccactaaaaatacaaaaattagccgggcgtagtggcggtcacctgtaattccagctactcgggaggctgaggcagaagaatcgcttgaacccgggaggcggaggttgcagtgagccgagatcgcgccactgcattccagcctggccaaggagccagaccggggccgggcagggtgggggcgggggcgggggaagatatgaaacctaatataccagaaaaaaaggaggtgtgtatttagtattcatgaggataaatggataaagtaacctaaggagaccacagatcgaaaacagaagtgagctcaagacataattctaaagtagctactgtttagagggaagagaaaaacaactacaaatatgtttgcttgtttttaaaaacagaattgacatatattcagtaggtaagcagactgctgaagaaaatagtctactatgtcggttgctgcaaaagatcaaataaaaagatgaatgaaaaagtcactgaatgtgacaaaagattgctggtgaaagcacaggcagaaaagagatgacaatgagtgggtaaaatcttgagaaaataaatgaaattatttatatcattgttataacataatttagtaaaaatcatttgtatagcatacataattgaatggggatgatctggctaaaagcaatttttaactgtgaattgaaatttagtaaggtgattcagtttttgccaatataagaaaagagcctcttccgaaatccccaaatcccatcagaaaatagttttcattagtagtttgtaatgaactaatctgcaaaatcctctgaatactttgtaaagtttgtctttaatcactaaatgtaaactaaacaacaaatgaacatatttggccatattattaattatcttaatgtttaattatgatatccaattaactattttggctgaaagacatcactgacaaacatgagaagttaatagtgcaatatatttatttatatagactggtaaatcttgtaaggtagattttatctgatttgcattttctagaactgaaaatcacatttattgaagagtatagatgctctaatatgaactttacacctttttcactcttctaagttgaattatgggaaatacctattcaaagttaattagtttcatgtcatttaagaagttaagttatattatttctacctgctattttaaaatcaaacattttaagaggtggtaatgaaattaaatattaaggaaacagtaagatctggaaaaaaaacaaaccatttgaacaaatagggaaggtatatattactaattgctggctttaacctgaggatattttcaactttttcttttctgaaagaaattccctatgacatatactgatcaagttttcaacaattccaaaaggaatttctctgtcttcaaattctgtaaactttcatcatcatatgacactgctcatgttgccactttgtaaaaaatgtctttattagtattgtttccgtgtcttaatttgtttcttatccctctgccttttgctacttaaaaaacatttttattaaatttgataaataataaaacgaatgtatttaagtgtacgatttaatgtgtgcatgtgtgtgcctgtgtgtgtgcatgtgtgtgtgtgtgttaatgtggaattaaataatttgtgcccagagggttagcagttgtggttttcaaaatatgtggataaatatttacatgattctccctacaagaagagaatcttaaattcattatcctcagtgtaggctgagatagcttcgaaataataaaatgtggtagaagtgatggcatgttactttccagaatcatttataaaaagactgagctacacctttggtttcttctgtttctttctagagatttttgtttctctagacaaatttaattctagataaattgtagataattttatcaggttgaggaagttattttctatgtttgctgacagttttttttataaaattagaaatgaattttaaacattgtcaaataattttattcatttttgagatgattctgtggttagtcctctgtagtctaatataggaaaagatattgactgatttttcaatgtttgaataatggaattcctggaagatattccatttagtaatgtgggttatcctttctatatgtatttctatttgctttgctaaaattttgttatataaatgttggtcagtaattacatttctttgtaatatcttttaggatttctgtttgttttattgttgtactgattttgatattggggtaacactagccttgtagaattcgttgggaagtattttctccttttcaattttctggaagggattgtgtggaacagatgttatatcctccttaagtgcttgctagaattcaccagtgaggacatctggtccttaagttttatttattctgggatgttttacatttaatataatttgttattatatatgcaactattcaggttacctatttctttcttcctttattctccttctcctctttttgttagccaaactaaaatccttatttggaattcatgtgaccatcaatttcctttgttctgttccagtagcagtccagagtattatttgccacatctgcttaatctcctccaatctctgccagtttcttagtctttccttgtttcacaggaccttgacacttctaaacagtactgctcaggcattttgtagaatgctccacagtgtgagtttacctgatgttttttcatgaatagattgaggctatggattttggagaaaaatatcataaaggtacagtgcctttctcatcacatcatgacatcacatcacgacatcacatcacatcacatcacatcacatcacatcacatcatcacatcacatcacctcacatcaaattgtacaggcatcaaaatgacattgctagtggtattaacccctgaccacttgggttaaagtggtatctgcctgttttatctactgtgaagttaagcatctttatttttctatactttatttgttagaagtgactcattaagtctaatcacatactcaagaggttgtgaattaaagtctccttcctgggaagaggaacatcaagaaatatgtggatatatatggccgggcacggtggctcatgcctgtaatcccagcaatttgggaggccaaggcgggcagatcacctgaggtcgggagttcaagaccagcctgaccaacatggagaaaccccgtccctactaaaaatacaaaattagccgggcgtggtggcaggcccctgtaatcccagctactagggaggctgaggcaggagaatcgcttgaacctgggaggcagaggttgcaatcagacaagatcgcaccattgcactccagcctgggcaacaagagtgaaactccatctcaaaaaaaaaaaaaaaaagaaagaaaagaaatatgtggatatatgtgaaccaccatagtaattaacatatagaagaaattccaccctgtttaataaaggaatgagaaatatccctgcccctctgtgaatcttagaatttatttcaaccaatccttttggagagttctgtgctggcctcaagtcattttttcacattcatgtactgggcatttagctgaagactcaaggctgacaccctgcggttccatggtccttgcattctgtgaagtcctctcccatccagttctccgccccgtgaactccagcctcctttcccccggccctgaaatctcagctccattgcagtgcacaggactcttcctgagtttcttctccctgcactatggcctgtaaattatctccaggaaatagcctgggcagtaaaggggcttaccttatttattttctacatctcaagcatcactatccttcattgcctggtgtctgacatagtgaaaaccattatttcatgtatttttttctgatttttattttttcccgatcgagtggataattctgtctctgttactacatcttagttagaaacaaaagtctttgccccacttttatttctttcattgcctatctaattcataaaatcagaaagcctatatcctttacctacagttgacagattgtttaatagccaaagtagatttcacccttcttgaattgatctcttttcttgattttttaatatctgaggaaatatttattaaggttaacatctaggaatctcaagtttaaaaaatcctagggctgccccctttttttaaaaaaaaatctctctgagcatcacttttttatatttaaaaataatggataaataaataatacagacatcacagttatgttctgaagactaaatctgaaaagcattaaatgcaactagcacagtgattattagcacatagtagaagttaaatggcctactataatttccatcttcgtgagcagcaatattgcctgaattaccatcatcattccaaatatctttgttctttattgtaactactttgtgtattttgccttcctcctttcatttaaacagggtcttcccaaattatccttctatttgtcttatctttataatctttattcttttgttgatatttcgttccattgttttaatcatgtctgtgctgttgataattgccaacctcgcttccagctattatctcttcccagagatcctctcccatgactgtgactttattctgcctaacttcaactgtctttcacaggtgaaattcaacacgtttctcaacaccagtggccccactcacctcaagctgctttctcttaccatttgtatacaattcgcttattctccattcttttatgtcctacagatcaaaacactaggattaactatgatcatttctcttttttccttaaatgtaattctttatattcattaccactaccctatcctatttcacacttaattttacttgattagagaattataacactcttcaaattaatttaataatctctatacactttattcttttgaccattttgaaaacatttttttcttcctatatgagtgtcaaacaatataccaaactaaaaataaatttaagtaaggtgcttgtataaactaaaatgatggtctcaaatttaggagttagtgccactgaatgataggattattttttaatccacataaagacctttgaaaaataaatgagttggaaaggtggctcacatgattcattctgtatacttttcaaaatgtgatgattgactttgtatgccatcccgactgggctaagaaatgcccagatagtctttctagttgtgtctgtgaaggtgtttctgaaagacattaggatttgaatcagtacactaagtatagaagatcattttcatccaagtgaattgacatcatccaatccagtgaaggtcagaatagaacaaaaatacagagaaaggacaaattcactctatttcagctgtgacatccatcttcttctgccctcacacaccagtgctcctggttcttagactttgtactcaggacttacaccattgccacgccttgccctaggttctcagcccttcagctcagcctgaattatgctgccaggtttcctggttctccaggttgaagactgcagacaatgggacttctcgacttccataaattcacgagccaatttctacaataaatccatacatctagatctacatctaaatagatcctattggttctgtttctctggagaaccctaatacacaaaattaaactttcttgctcatatacttactaaaaaaactttctgttgctgtctttccttttaagtgaaatctaacctttttttttttttttttttttttttttgagatgtagtctcactctgctgccaggttggagtgcagtggcgcaatctcggctcactgcaacctctccctcccggattcaagtgattctcgtgcctcagcctcccctaagattagatttaacctattcaacttgacgttcaggttatttgcaatatgcccatcatattttcagcctgcatatcccagtacttctttaggtacgtaagctattttctttctaataaaccgctattgctcaaaacttctccatacactccacacctcccctttttgctcgcttcttcttttatttccttatttgaagtatccaccccaagtttttccctctgaaatttctgcttgttaaactctatcactccctccatgaagctcttcctggtattttatccatattaatctattttttctctaatcttcctcactgcatttttaaatgtcttttgtagtatttatggcattttaacttttattatctgcattatatgtattcattttattttattttataatcagtttatgctggattataaactccttgggagtgtttgctattatttattagctacgtattttaaaacaagctatgttgtacttaatgcacatgcaaatatttattgatttacatttgatttttaatgtcaggtttacaatataatatttttttccaatataaaaacttacctgaaagttcattcccataaatattttggttttggcaattatgctgtgtgtaatatataatgtggatttttcccccaaagtaagggtattttaaaatcacaatgaaggctccagtgcaagtatcattactgacttccctcagatgtaggagttgtgataagaggtttgctacaaaaatttcaacttaagctgaactgccaggaggcagaagaagaacacaagttctcttcaaagctaagaagtgactcaaatttgtaatgcttcttagaattcatctctctgttaaaaatgccctgttaagcaacaagttttatcccattagcatattaaataatgaatacaactcatgatttggtatgtgttcaaatgtatacacaacttgtgcacacactgcaattttttgaatcccacaaaataaaatacaaactttactttttgttaatatacaatttaataagaaacacttttcacaattatttataaataacacaattacatagctatcatagatataaggaatgttcaaaaatactttaataaattaaatgtgaagctcttcacatatatgtacaaatttccttcaagttcctatacagcatcaatttaaccataagcaaaatgtaattcttagttgctcttatttatttttatgttctatatataatctattaaatttattattatttggtttttcttcatgccttggtctgtttctaacaaagatgttattttgtaagtcatgggtacatatatgttgatttgagtgtttcttgcaggaaatcatctgagtacttacacgattgcttgagtgagaacacaagatcccataaaaacaaagaatgaattcagtgtattttcttcagtcagcatctctcctaagattagatttatgcagttctatttccagtttaatagctattttggtcatgagaatggacagatactgtgtcttcatcagtccccaatacgatttatgtgatgagactttggtacaggaatgttaatgttttatatatttctgacagtagtaatgtaccattctattttgacctttccaatatgatacagatcgattatctgggtactttatttcttcctttgtctactactgtaaaagtctattaagaaaaagggcaaaatcaatcaaaatttctaatgcgttagataacaatccctcagttttgtcgagttaaagtagacatagtttcactgtttaaatacatccataaatatgttcctgtcagcataagccttctattatttttaatatagtatatatatttttcttctgaattataattttatgtaatatctaatctcatgcatttcattgccagctacaaatttcataaacagaaacaaagaaagaaattcatgatgtttagcttctagattctagacattcgggtgtgtgtgtgtgtgtgtgtgtgtgtgtgtgtgtgtgtgtttgacaaaatagaaaatttcctctagatatgatggacaaggtagcaaggtactttgagaaatcaaatctagatgacttttcgaagtaatcaaaagtttctgcacacacttgaaaggtggctagaattaatatttgaatgcataattttaaattatctattaatgataatgcagacaatgaggaaagaataatctaagtcttttatcattccaaaagtcaacctattacttcatggtttaaactgactgacttttatttgctccatacaaacatatctgtcataaaaaccaaatatttcagtctaaaagttctctaagatgcatcaaaatcattgaattaggagtgtgagagacgtctaataagtgctgtcctgggatctcctggctcatgcctaaggaaataaattaatatcaattcagtgattaaatgcacattaggtcaggtctgctgagtcaataatttccattttcaccactgcatggatgtaataaaataaatacagtgtgttatcttgaagttaaaattagtgtttttgccacctataggcagcttcaaagatattgcaaatctttgaggatcactccttatatagtttagacaaacattataatttttatttctagtgtgaccgtatttgaacatttgggacaaaacacataatgtacacttctctccaaagtgaaatcaaaaggcacaatacaaccatgctgtggttgaaggatgtaacatagtttgaaacaaaaataagggaaaagaattgaaattgcttgtcttgtcccttagtaatcttcactgtccactcaattttttttataacagaaggtgaactataatatctctttggagaaaagagaaagagaaagaaggaagatggctagaagctaacatctgtttatgtttatatggaaattgatggtacaattaagctgtaaccctggagttatctgttcctgagttttccctagaagaaatctgggagtcatcttgattactttgtttgtcatcatctatatctaatggatatttaaggctccttaccctctctactgccactgtcttttacattcaacaaatatttgtccagttactattttgtggcaaacgctctgtcttcaatttcacttggatttttgtagctatttatgttgtctgtgcctccaattttagctttatcagtgatattcactacattgacattatatgattttaatgtctatagatacatattttgaagagctcacatagctttatggtttacattcacaaacattaatgtcattacatattccttcagaaattggctactaactttcactctagtaagatttctttttttcttacttgaaaaacatcttaaattgcttaaaatagaaatagcatgttctaggatattttgtttgcaaaagttggtcttttttggggggcttttttttttaacctttttgtcaattggctaatttctactcaatctcttggcttaccagtctagattttataattccactatgtgcttccatcacaacttgtttttccttttaccttagcacttatcacattgtgttttacttccttttaagtaaatcttttagtttgaaatcattgtagattcatacacaaaggtgagaaataaggcagagatccatgtgcctcttatcaatttctgcctatggtaacatcttgaaaagactatagcctaatatcaaaaccatgatgttgacatggataaaacctaccaatcttagccacatctacccagatttactttcactctgtgtgtgtgtgcatgtgtgcttagttccatgcaatttcagcatgtgtaggttgtatgtccaccaccacagtcaaaatagagaacagttccattaccacaagctttcctcagattgccacttataaccacatccaatggctgatttcctcagcctccaatcctgctctgtatttaacaactagtaaccactaatctgttctccatttcttttttttttttcatttccagaatataaatagaattatttagtatgtaacattttgggaccggcttttttccacttagcggtgaaataaatcaaatgtggcctaaatggatgcagagacataccctattcatgaattagaaaacttaatatagaaaaaaagaaaattcttcttaaattgacatatagaatgaatggaatttctggcataattccaggaagacttttgtagatatagacagccttattctaaaatttatattaaaagttatgggccctggaatagcaatgtttttccatagaaaaaatgtagtgggaagaatcacttgacctaatacaaaggtttgctatatagctatgttatcaagacagcatgatattggcagagggatagacacatagaccagtggaacagaatagagaaccagaatagatgtgtaaatatgtacaactgatttttgataagggtcaaaagcaattcaacaaatgatactgcagcaattgaacatcctatgacagaaaaaaaagcattctaaatcgcacacataaaaaattaagtcaaaatggatattaacttaaagtcaaatacaaaacacaatgaaattttagataaaacataccagaaaatttgaggaattgaggtttaggaaaagagttcttagacttgatgctataagcatctaaattaattttaatggtttgtaaggtctttttttgtttgtttgttagagatagagtctcactaaatttcctggactgacgtcaaactcctgccttggccttccaaaatgctgggattgcagacatgagccagtgtgtccgggaaaggattgtgaggccttgatgataagtaatgatagtaagcaacatgtctcattcatctttgtaaaacagatgcctatagtgcttgctcatttctaaccttcttaactggcttttgtttccaaactgcaaatcaacttttcactctttggcagcatacaggcatatttcattattatcattatcatcatcatcatcatcattcacagtaatttccaaacttaaaaaatccttgggaacaaagtatcactcagtcagaaaactgggttttcctctcatcagcaatggcctgggtagtttccatggacttggtgctgtcacaggctctggtctccctagggcaagtcaacattattggttggtagcattttacaacacaaaaaaaacatgcagttttggggagaagacacaaaccttgctcctgggcccagcaggaaacaatgaaagggcaatgtaagcacagctcacttcccctggaaaagaaggaaacaagctggtacaccccaacactttgccttgaatataattcaacaatattaccacgatctccttccagcagtcctcatgtggggactccaagatctagcacttgctgctaaattgtcactgcccaagatgagcttcaacccctcaaggaagtcttccaacaaaagttttgttacactgtcaataattctgtcaagttgagtgatgaattactctatcttgcccttctaactcttatttccatacatcaaatatactattttctccattctttgcatatgctattgcttctccctggaaatttcaaatttcaatcatcccacatttcttttccagctatccaaatctgtcatctttcatcatgcattttatgactgcctacttcaagataccttctctgaagatttccaattcaaatgtcccttctgacatcctataacatgtaatatcttacacatcatatgctatttttattgtgcttacttttctctgtgttaaacctattttaattttttgtttgtgtgttttgttttttgtttttttggaaacagcgcttcactctgtcagccaggctggagtgcagtggtgtgaccacagctcaccatagccttgacctcctgggttccagcgatcctcctgcctcagcctcccaagtagctgggaccagaggtgcacaccaccatacatggctttttttttttttttttttttttttgagacagaatctcactctgctctccaggctggagtgcagtggtgcggtgtcagctcactgcaaccttcacttcccgggttaaaatgattctcttgcttcagccccctggtagctgggattacagggacgtgccaccacgcctggctaatttttgtatgtttagtagagacggggtttcaccatgttggtcaggctggtctcgaactcctgacctcctgatctgcctgcctcagccttccaaagtgatgggattacaggcgtgagccaacacgcctggcctaacctatcttaattgtttaataatctccgtgagattgggcctattggtaggtttaataaatatgaaatattaaattttctaattggatatttctgtgtgtgtgcatgtatacacttacacatatacaagtgcagttttttgaattgactttttatttaatcaatttttataaaagttcttggcagtaactttgattcacacagccaaatgtttggtttttatttaatataatcattgctatatgctgctgaaacatagtagattgttgggacagattataagtgtgtgtggggaggtatgtgtaatgtgactctttagaagtttgaccctaaaaagcctggtagaacttggggtaccctgaatacaatgttttcaatatcttggataaatcatgcaacgtgtgatttagcacttcgcatgattactgtgattcacatatatttgaattcacactgatcctctgtgctaaattcagttagatgccaagatttagaatttgggtgcatccacaatatttttcttttttctgttgatctgcttgttgtgattggtgattaccagcagctgccgtgcacacttgctgataataagagatgtttagtgttctattttctagtttctcttgtttcaaacgctccgtgataatcagcttatctgcacttggctttgacaggatgagattatctttacccctgtgagtttagttcttccatcatggatataaatctttatggttgggcacatagtgatgctgactggagaataggcaagactaggcttcattctggctccaaaatgggaatcagcccctctctctggtagaaaatatttagagaacttggtcatcagacatgcttgtctgcatgtcccctcattgttgactgctttctggagacagaggactgtttcttaatagcacttctcagaagaagggccaaacatctagaactctgcaaagataatgaaaaatctctcatatctgcaggttaatgtgaatgtgaggttacatagacattccgcagacattctcctttcttatttgcatggctcagtcacaatataggatccaagctggtctatctggaagcagagcctaaaaatccacattctctgtttcagctcacgtacccgtcgtgtatctttgtgccagagtagctactaccaaagaactaagatagaaggagaaaaacccattgattgagagtgatggtcttcattcttcttaaggactatagcttctttagcaaatcattcagttaaacagcatgaaaacatggttccctgcactcgcgttttaacaattcatctattaaattatatatctatgtaacaaacatctagtccgtaatatgaaatacataaaacacttctaaagcaatattttgtcaactatacgtaagtgacttttatttcattggtttctgctgaaaaaaggttgcttgctaattgagtatatttcaacttgggaatgatttgttaattattggttactaaaatgtactgcatattagtatcacttaagagtcttttaatattcctgcttctcaggtcacacacaatgccaattaaaccatattctctgggaatggggcccaggcattgacggttctttgaaagcacacagaggattctaatgagcagccatgtgtgagaatcagtgattaactaatcactctaagtactcatatcagaatagtcatctcctctggcttactgggataggcaaaatttcaaatttgtttgctcatctttagcactttagcatatagatagatagttggatctagatatagatctagatatgcactcttagtactgatttgctcctacttagccattgtaagcattcccatttctgttaaactctaaaaatatatgaaatatttttgcctcaagtatcctatttctatggctttaggcatcccaacaaaattcatgatggttttcctgtaagctttaagtgttggaggcactttgttctgtttgctgcccaataaatctcctgggcctgaaaatggcatccaaattacaataatgggaatgtgcacatgccttgtaactggggtggatcagagagtaaaatattaaataatatatacagtgaaagcagctccagagacattttctggaatctgctgtacgatattcaagtctcaatatttaggtttttatagcatcttcgtacatgttacttcctgcttttgttcatttcctagcatgcatttcatgaatgaagtatccagcaggatgaaataaaaatgatcatttatctcccattgtttcttatcatatttgtagattaatagcaatatgaattcatgttgtgaaggcgcatcctagtttggagggttgattttcgatacatgtctctgagatgtgaatatcagttatcacatagaaaatattgaagaaagttcctatttcaatactgctttcaccttgtggttactgattattgttgccattatcgattttagaaattcctaataagtaaatgcacatgagaagtccaaacagtaatgaagtgtatttactcagaagaaaagttctctctttcaaaactccttcaaagttttaatcccttctgagacataacccctgacaacaacaatctgaattcagtgtgagttaaaaatataaccacccttataaatgcacacacctatatgcataaacaaacatacttctttatgcgtagaattgcatgaaaatatgtttgcttacagagatatgagaaaaaaagtgtgttttatttttctttctctgttttcacagtcactcaatatagcacagaatgcctctgacaccaaatgtgtgaagtttttccccacacaacaagtaagcaattctgcagtggacaccagcaggctgtcctctaattcaattctatcccaacactatctacctggagatagtgtcagatcccaaaggttgaggattcagtcttgaaagactggcccccacatcagatgctagtcaaaagcatgggttatgatttgtgcttctgactgaccagttgtgaatcaggattcctatgaccctttccttggatttgattaatttgctagagcagcttgcagaactcagggaaacactatgtttgctggcttattataagggatattacaaaggatacagataaatggccagttgaaaaagatgcataatgttgggtatatggcaaacagtgtgaagtttccatggcctctcaaggcttgccatcctccaggaacctccacctattcagctatctagaagctcctagaacacagtttaaaacaaaattgtggaagcttgactaattaaatctttggccagcagtgatcaacttaaccttcggccgtctttcttctccctggaagttaggtggggtggtggaggtgaaatttctgatcctttaatcctaccttgttttttccagcccccagtctccatcctgaagctatctgggagcccccagccaccagggattttattagcataagaaaatgctgttatctttctgaagattccaagagttttaggaactgtatgccagggaataaggactatcaccaaatttatatttcacaaaatcagtttctgttttaaattggattgttttataggcattggtgttctgaaacttgctactttctaacagcagtgaagacattttcatgtcagtaattattatttctttatacagcattttatttttattgaggtatagttacagtaaaatatacagaccacagtttgatgaatgtcaaaccaacactccaatcaagatagagaatactttcagtgttctgatttgcatgttcatgcaacatgacttttaatgacaacacaatatcgatttgtatgaatatattatacttttttattggtgttaactgaaaaatcacaagctttataaacttagaaagcagagctttatttcttatgaagtgttacaatctgcagcctctagctaaaactaaaagcaggtacttcagagaaaaaaggagaatctgagatctatgcccagtgagattagatacacatacctattcatttatgaggtagtcttaatgtatgcatactgaataaacatgtatgttacatatgacccaggttttctttggggtggagatataagatttaagtgcattacaattaggccttatacatctaaggtgaagtagagactggaagtcaatcagtgcacagcccctgtaaactggccaaagctagtccatggttggtggtcccttatcagtcaaaagttgcttaaatcagtcttttgtccagtcaaagctgtagttatggtttgtagaacaggggatctagttagtcagtgtctggttgtcagtgagctgcaattgctttaatattgcttatctggaggctagtgcttatttggctgctagagaaaaagaaaagatcttgtggcagttagaacaagagtttattctttaagtgtaggggtgcataactaaaactttggcaaatatgaccttaggtctttataatttggtgccttattgccacaacgagtctgttctgtcagtcttatgttcactattttaaggttaatgctgatcagttttgtctaagtcacaaactggaggggttataacaaggcatgtccaacctcccatcccatcatggctgagaactcagggtttaaagtttccctggggtccccttggccaagacaacatctattcagtttgttggggagcttaggattttatttttacttctcaatttctcagtgtcttattgataagcatttgtactgtttctattttctccattctaaaaattaaaatcaatatccatgtcatttatacctgtgcacatgtccaggtgtttcttcagagcagatacccagaagtacaaatggtcatgcaaaaacactggtgcaattattcttctaataatacttttaaatgtatcactttggctgactggccaattttccttcttgttatgagaacagggagccagatgtaaagccccataatgaccaaacacagaacagctctacttggggtatgaacattgtagtatgtttcaatcttaagtggagctgaattctttcttcttattactcctctatatttattgtgaaaatctagttttatattaagctttgctgctctgtttctctctctgatcccaataactgtgaaagaagttcccaagtacccactgctttgattttaggagtttatctagaggaaatcatagctatccacccactcctatagccatgagtggttgatttatttctcaagcagttcttcaattaagtactgatatagtcttgctacagctcactctttgttgattctaaacttggagttcctcagcagcttatatggcaaagtctgttctcacctatgcaacagttttattttatgcctttttttgcttgttgtttcaatttctttttccccaaatatgatctcatctgttttttatcttttagaaagtacacatttgtatcagtatttgttaactttattatttcctgttttattgctattatttattttaaaataaatgtattttctgctaattcaatgacattaagttgaaattagatgggaagaagagataaatgtgtgtgctcagtccgccacttggaagtagaatccgaacctgcttccgaaaaatacaacttagttcacatggtttcaatgactgtggcaacacataatatgtaagcaatatctcctcacatttttattctatttctgaatctaatagtaaatcgttatactatgttgttttttattctttatttttaatacatacaaaagaggcaagagtttaaagaaaattctcaacattattgtatttaaaatacctgctaataaacttcatatctgagcatttttagtcatttgtatgtgtatatgcatgaatgttgtatgaagatatatttttaagagttcagaggcagtttcaacttgagatagcacttgactcagggtttttgacatgtatttgataatggatggttgattccatgaacagattatgagaacacacactgccttcactcctcttctgagatgcttgtagctatctttcctgaataaaaaaatagcttctagaccctgggacatatcgataggcaccaagacactttgatcctaattccagttcaagcaaagagaagaaattgctgacttacttgtataccatgaaagcaggcttaaatgagttataagacgttacactaaacaaacaagtaacaattgaattaagagaaaaataatagaatttacttcatagagaggcttatttccaatgtttaaattttatcacacgctaaatgatgttaaaactctttttgcaggaaattggacctttataaactaactttttgacaggagatccctatcaagattttttgtgaacttttttcttttggttcatccatacaaaaagaaagagagtgaaacaggaagtaatttgcctcagcttatatagtgaaaacacttaggactccttcatatagagagctctagaccaaaggctgccagagaccttgaccttgaatgtccacggcataatgtatactgcttgataaatcagagctcctacaaatatcttgggaaatttttgtaacattagaattgtgaccagtattaataatcttccaattaggtacaaagaaattttaataacatacagtgctgtgtcttataataggttttacattttttaaaatgtttaaaattttatgagataaacttttgaaaacttgcttcagaagaaagcactaaagtctagcataattacataaaacattttgaagtagaaaagagaaaatttcagctccaaattagattttcacttggaatcagtattttaaggtttattgagaagtagtgtaagaatttgatttcatatttgaaatattgagagtagtaagtcacttcaaccaaaaaggggtgctttaaaagaattcttcataaaaataaaagattttatagttatgaattctattactagtacttagagtttttcttgcacaaattcaaaatatttctagctgtgaagcagaaatcaacatataattaatttttgatcttatcaaagcagtttaatcaataagtaagtaaatcatattaaagtctacaaagctgtgtttacctgcacaacaaaaagaatgtttcataagtgtcgaatgaaaattgcaagattctttatgagtcagggtgagctaagctgccataacaaaaatacagatataacatacgtttagcaagatgttaggatgaaaaaaatatgtacgtgtatttttatatgtttatcaaaatgtcaagacttgagctatatatatatatatatatatatatatatatatatatatatgtatttcttaattaagagacaatccctctatcccttccctggggaagatattataggtcaatgagaaaagatgcatttatgtatacttgtggggtaagagtgaagagagggtttccagattcaaatagttacgtggagtctcagactaacagtaattcttcatcttcagcactggacttccaagatcatgctggctttcactattcaaggcaagaagaatggtgaaagaacatggaagagtgcacatatatcacctaaaataatacgtctgtatgtgaaatgttttaggtaaattaaaaataattaaataagaatgaatataggtgagataaagttttaggagaaatatttcaaaaagatagtaattgtatgaatgttaagaaatttaacttttaagtaaaaaacaacttgcttttccagctttatgagcaacattttaaaacattaacagttctctttttggaagattaggttgacatattaaacagtttagaattcccagttatttaaattaatttttaataggatgatcttaactttattacattataactgagcaaacattcacattccccaagaactcatatattaacagagcatgcagctgtcaagtatttttgaaaaggcaatcaaaataactgtgaaactattttttatggatgacataatccaaatgcagaaatgcattagaacatcctctgcatattccatggcttaatgaccaatctcatcttcattcagcatttttcatctacttgtgcttaaaaggattgaagtaattctaaaaccagctttcatataaacacaatatatttttccaaattatgagagctgtcagaatgtaaatgtagtatattacctgagcaaaacataagcctcttaactctcatgtcttttcacagctttacctttgaaaagtattaccaattgcaaatcagtcaaatgttcgaaatctttcaaatagtggaagtatacaaaatgcagcaactattaaaattagttaagtacagcaaagcttcatgataaacaaaatgagacatcttttcttataaatacattcactggatgcagataatgtactgaagttctttatttgaccctctctatttgagataaggaatataattgacttggataccgaaggatcgaatgttaccatgtcaagttgaaaatgattaagtgatttttaatccagtaattagagcctaatataacacagaaaattgttattgaactacaatacctcaattttattttttcatttattgataagtaacctcctttggtgacaatgtatactttgctcgatagatcggattttgaaacatgtcatgtttcataagcaaatatctcataatttaccttgggttattataaatattgagtctttttcaatagtcataattttttattaattgatttgtgtatgtctttcaactagtaacctctatgtttagtacagacatctttcactgttgtattcttagcatataaaacaatactgagcatgaactaatggctcaataagtacttttaaataaatgagttcatgaccttgagtaaaccatgtaataatgctaatattaatatgctatatgtcacaaatattaataaaatatactattactctaaaaccttttcatataagatctccaaaagatttaaaataagcaaatctacttttgcattagaggctttcttgttactttaaacatagtcattccagttttcttaaattgccaaccaagcctaatttttaaccaattatcatagggtatttatatactaaattaagtgagggggtgaaatgttacatctcagtttcaggattttagttttcttcttttcaaaacagtccctatccattccgcaaaacatttactacttctttcactaaggtattgaactgatcatagtaaacttagcaacctacacccttctgattagttcaaaatgggtttccatcattatttcccctgttctacgttctattcaattccagtattgtgataatggtgttctctcttacagaactattgtgctacttaattgatgtttgttatatacttggagatctttggatggtagatgatattctggtgccaagtgcattattatttcattaaaatcaatgcctagatgaaatgcattgcagaaggtaatggcctgaaaagtgttttctattaccaagtggaaagaatatatttgtttggcagctttctaggtacagtctaagcaggtggccaccagcaaactgacacctagaagagaaatatttcattcacactatttagattttaattgaattatttacaaagaatataaattctgagctatttttgctaagtggatcaatcactttatacaaggacaaatgaaaacctacaaggaaaaatataaagcttcagattagatttacaagaaaatgcttactttaaagactcagtttagtgtagtgaaagaccatgagcttgtagtcaaataagttgggcttgaatccagggcccatcagtgttgcagttccatgacacacagactggatctgtcttgttcactgttgtattcttggcatgtaaaacaatattgagcatgaactaatggctcaataagcacttttaaataaataaatgagttcatgaccttgagcaaaccatgtaataatgctaatattaatatgctgtatgtaacaaatattaataaaagatactgttactctaaaactttttgatataagatctccaaaagatttaaaataagcaaatctactgacctagatgaggttgctttttgctttgattctctccttttagcttttgaggtttttttttttttaattgtttagtttgtagagactggatctatgttgcacaggttagtctcaaactcctgggcacaagcaatcctcccacctcagcctcccaaaatgcagggattacaagtgtgacccaccatgccaggtctctccttttagttttaattgaagttcagaacaacctatatcatgtttctaacacaacattaaaaacatgaaagtgcacagattactttataaaatgttaattatgaaattatgagacccaataatattcatattataaaatgtttaaaatatagcaaaagataaagaacgcattttaagataaactctaaccaataccactacttgaagataataataattggcccttaaatatatttctttattgtggtatacacacatacacaaacacatgcacatacacatagtcatacatgtatgctgtgtttttacttcatattgtgaaacacccaatattcttcaaaacactatttagagagctgctaaatagactttttattactattaatttaaaaattaacaattaactgaattaaactgtccaacatttgattaaaataaacaataacaaagtgaagaaatgcgtgtttgaaaaattcacatatttatttccttaacatatatcatttaatgaggaattattgtttaaagaatattaataaaaatgtgaggctcttgatttaaattattaaataactctaaagattgtaagaattacactgccactagcagtccatttgtacatatacttactgcttatttatgatttttttttccttttcttttttatcttttgggtgtccgttgcgggaagtcagggaccccagatggagggacagagtgaagctgcagcagaagaacataaattgtgaagatttcatggacatttatcagttcccaaaattaatacttttataatttcttatgcctgtctttactgcaatctctgaacataaattgtgaaggtttcatggacatttatcacttccctaataatactcttataatttcttatgtctgattttactttaatatcttaatcccgttatctttgtaagctgagaatgtatgtcacctcaggatcagtattgtacaaattgattgtaaaacatgtgtgtttgaacaatatgaaatcagtgcaccttaaaaaggaatagaataacagtgattttcagggaataagggaagataaccataaggtctgactgtctgtgggttgggcagaatagagccatatttttcttcttgcagagagcctataaaaggacgtgtgagtaggagagatatcactgaattcttttcccagcaaggaatattaataattaataccccggggaaggaatgcattacttgggggaggtccataaacggccgctctgggagtgtctgtcttacgtggttgagataaggcctgaaatactccctggtctcctgcagtaccctcgggcttactaggattgggaaattccagcctggtaaattctagtcagaccggttctctgctctcatcagacctgtttcctgttaagatgtttatcaagacaatagatgcacagcaggacatagaccctcatcagtaattctaattttgcctccaccttgtgatctttctcgcccttggaagcatgtgatctttgtgacctactccctgctcgtacaccctctgcccttttaaaatccctaataaaaacttgctggttttgcggctcagggtcatcatcacggtcctaccaatatgtaatgtcacccctggaggcccagctgtagaatttctctctttgtaccctttctctgtatttctcagaccggccaacacttagggaaaatagaaaggacctaagttaaaatattgggggctggttcccccaattgtatgtagtaggcatatatatttatggggtaaaactaagcatatttttaatgcatggaataagactagaaattaataataagaaattttggaaagtataaaaatacatagaaatcatttattcaaaaattatgttttatttgcataaatttaagggatacaggtgcagtttttttgcatggatatattgcataatggtcaagtctgggattttagtgtagccatcatccaaataacatacattgtacccattaagtaatgtctcattcctcacctcatttccatcctcccaccattctgagtcttcagtgtttattattccacattctatgttcatatatacacattatttagctctcattcataaatgagaccatatggtattggactttctatttctgagttgtctcacttaagggcctctagttcacccatgttgctgcagaagacacaattgccttctttttaaaggctaaatagtattccattgtgtgtatatacatatatatacatggggactagcagtaatgcacgaagtacataaaagcacctatgtaatagtgctaattgattagtactgacatggtagtcaaagtatgtgctgagaaagaattcatacacagttaagagatctatatacatgcatatatatgagaaattttctttatccagtcgcctgttgatagacacttaggttgattctatatctttgctgttatgaataatgctgtaataaatatatgtgtgcaggtatctttctgacataatgatttctcttttctttggacagatatccagaagtgggattactggattgaatggtggttctattgttagttctttgagaaatttccctagtattttccatagaggttgtactaatttacattcccactaacagtgtataagcatttctttttctccacatccttgccaacatctgttattttttgacttgtaataatagtcattctgactggggtaagatgatatctcatgatggttcttattcatatttctctaataattatctacagcatttttcatatgcttattggttatttgtatgtcttttgaaaaatgcctattcatgttttttgcccactttttaatggggctatttgtgtttttaatgttattgtttgatatccttgtatattatattctggatattattcccctataagatgaatagtttacaaatattttctcccattctgcaggtcttctctttactctgttgattatttattttgctgtaaagaagctttttagtttaagtaagtcctatttgtctatttttgtttttgtttctttgctttgagatcctagtcacgaattatttgcctagaccaatgtccagaagcgttttctctagattttcttttagtattttcatagttctcggtctattgtgacatatgtatccatatttttatgcattttctagtattgtacttgatagttttcatttggttcataattaattaaatgaaaatatatagtagaagcttttcatgtaacaataacatcaattattttgtctgttatatatgttcccatatggaacaaaggcttttaggcagaaacatgcctggtgttttggagagacaaaacagtgatgacttgtgtagtaataaatgaagaacatggtattaagagttgatgtctgtggtggggcattgacagccttatggacttttcttttttttttttttgagacagagtctcactcggtcacccaggctggagtggagtgcagtggcatgatatcagctcactgcaagctctgcctcccgg

SEQ ID NO: 599 - DNA, 85028 bp, Homo sapiens
tttttccattgtgtagtgtgcattaccttcataggggcaaagagaatgccccaaagcagattcaaagtgtataactcaggattaagaaaaaaggcttcaacgtttgcattttaccaagatagaacaaagacatcaaggagagtcctgatgggcaaaaattacagatccagatgaaatagtccagaagtctaaggcaaagaaaaactaggtaaaaatacaaatatttttctttacatttagagaagggaggaagacatggccatggccacctcatagtgataggggtgcttcaacatgtccttaaggccacacccaggatcattctgaatcatcagcacatatctgagataatgacagggatgggccagtgagagcatcctgtgcatccagtgggatagtaaagagagtttcagcttttgaaatagggctgagctgtctccatgtcagccttggctcttgcctagtagcgggcctttgtagaaaatcaaaagggaaaatgggacagtttccttcaacaagacgttttactaaactaaacttctcatacgtccaagagtgaagttctgggacttgctgctcctgacacatcactgaggacagatgactggcatttgcacaggaggtcagagagcaggaaccattagagggctggggctgttggaaaaagccttacctatgagatgagactgggaaagtctcccaagaagtgtctgtgttcaacgaatgtggatcagaaagaacaacagtgataataacttggagcaaaagttccaaggcagaacctaggtagcactattggagaacactccagagcctggtttgactgcctcagagacattatataaggagcttggagaagtcatttggggagttgaaaatgggccaaagacatagagggactaaaatgccatagtaactagtgtagacactctcatctcttgctgcccgaagtgtgatctatggaccagcagcatcaacatcatctgggaaaagatagaaatgcagattctcagggcccactccaacctcttgaatcagattctgcattttgacaagatccccataggattcttgaacacactgataattggagaagtaccactccagcatttagtggaaacacctggtactaaaactgaaggcacgctcaggaatctccattttcaacaaacatcccacgtgagacaaataagaagatggcaaataccaatcagtagtgaggagcatgttggtctgatgaagattagtaggatggatgtaagagacaagcagcaatcatttaaaatacactaacaataatgtagacatgatgatatttatgagtaaggtcagacaaccgattttaaacaacctctttgattctcagcttggcacacaggaacacaggatagattaagtatcaagaatccctccttgtacctagaaaattcattccaaagatagtacctccattccttcttcctccatccctggactgtagaaagcagattccccagctggggcactcagctattagtaaccgaagtactgctcatagagtacaagaaatagtggctgaagtgtggcaggcattctataaatgtggttcatgttgttgctataataacagcaattattactaatacctttgctatgcctcctcacctgtccagtttgctccctctaagttgggtttacttagctcattgagacttctaagaacctggatgagacaggcctggatttgaggcaaatcagcacaaaacttcagaatccagtaatctcctccttctcatcccaaggagactgaagccaggaaaaggagctgatgagttccaattaccttttcagaagatagttagaataggaataatcaacttactttacaaaatcagaaagtgtatacatcctcttttttcaagtatgatgacatggttatcctccaacacaagctctaactttcaagttttttttaaaatgacaatgatattaataatgatgaatgctgatgaaaatattctaccttgccaaattactttgtggttccttaaaaaccacaagctctacgaatctcatcatatcctaatgcattgctttgtacagacccaggaaggagaccagcctctatcattcatcaaagtgtccttcctaatgcagtctacgctcccttcagaagtccatctgcacacccatcaggcttccttctcactcctgtactatgaaagtgctgccttcagtagactttccccccatttttcccatttaaatatttataactgtaatgcagccatgccctagttcatcaatagtgattcttcttatattcaatgaaaaagaaatgtagaacattagtgagttagaggttggtctctcttgctacacgctaatttgtttctttgaccagcctctgagcttgcagctcacatcatcccaactgtgccacttggagggcatgaagtttcaaagaatatccagccctctaggatcctttatgtggtatcccagccaataatttggggagaaaaagtgttcaatccttttctcaaatgtacaccaaaataaattctagattaattaacgtttaaaataaagtgtttaaaagaaaatagagcgctaatatttccctgccttgagaaagacttttaaggaataatattagtcagaagccttaaaaagaatgattaatatgtttaactgaataaaaatataaaacttgtaaaatatttttaaagccatgtattattagtactattaaaaagcaaataaatatcttgaataaatatttgtaatatctgatgaataaacatgtaatattgtatatggaaaaagctgcttaaaataaataagaaaaatgagaaatatttgaaataaatttttaaaatctaaatggccaagcttataaataggatattcaaaaaagaggaaacacaatcaaccaatatgcatacgaaaagtgttaacctcccttgtatcaaacaaatacaaatcaaagccatgctataacacctatttttcacctactaatgtcctatatactgctagtgatagtataagttgattcccattctctagataaccatttgccaacatttaaaaaaactttaaaaatgtgtatatgcttcatgccgcaatgccacttgtagaaacatatcttaattaggggtagaggtgacgtctattaaagcaaccaacaataatgaacatgtatataatggaatgctttgtgaccataaaaatttatgatctagatctataattattaacttaaaggttgttgttgatatattgctatatcagaaacaacaagtttaatgaatagtatttttcttataatttattttgggtaaaatgaaaatgatgatatgcttatgtttgcagagggcaccaaaatagtattactatgtggctggtatttaatagcttattaattaaatattttcttttctgtattatataattttctataatacgtatgtattagttattgtaatgcatgttggttaaaaataaaaatatgtaaatatttacaatgcagaggggagggagagggagagagtcagcaaacaaaatattcggaaggggtcccctctcatagtaagaaggtaagtagagagggctcaccctttcagagcgactagttgcagagggaagagaggccatagtgggttgtctgtctcctttgcttcgagtcagattttattgctttgtacactttctcaactatacaaggaactattaataaaaagagttaaacatcaacattgctcacattggactgccagcaagtgagttgcctaatggtttatttaactaacataagtaatgtgtcactatattactgatgcaatattctgaagaacagtgatagctctacgtttcccttgttatgttagaagcactttttaaaattagcaaataaaaactatatatttatggtgtacaaaatgatgttttggtatttcatacattgtggaatggctaaatgaagctatttcacacatgcgttacctcacatatgtatgtcttttttgtggttagaacacttaaaatatgctctattctcttggcaattttctagtatacaatatatggcttctaactgtagtcagggtgatgtactatagatgttttgaacttacttctccatatctaactttgtatcctttggctaatatgttcccaatctcccttctcccagactctggtaatcactattctaacttcctgcttctatgaactcaactttttaagattccacataaaagtgagattgttcagtatttgtctttctgtgcctggcttattttactaacctaagtgttcatcaatggatgaatggataaagaaaacgtggcatatatacacaagggaatgatattcagccttaaaaaaaaaggagctcctgtcatttgaaataacatagttgagcctgaagggcattttgataagtggaataagttagaagaacttttgagtgaaccccacacctgtgatttttctggccagcctcttcgtttggccttccagaatactccatcagaacacattatcctaaccatgcctattttccttaagagctgcagcataaatggcagaatcactagaagccatgccacaaactggaataaaaccacaaaattaaagttttaaattaggaaagaaaaatcttcatcctttggaagcacaaaggtcaaaatgcactgagaatatcatggagacaatgaccacttggttcaaggaaatggtgttcattcacataatcacagcatcatataaataagctaatagactgtgggccacaaacctggtgaacaggcataaatgtacaggtcgttcttagcaggatttactgaccttgaaagtgagatggaggctgatttaacagaggcaggtcaaagagatcagtttccaaatagtcacttatctattcgtaaatgaaaatcatctttgaataaattagtgattctcttggtgcctgtgaggccccaaattattctggcttttcattgtaaatgttttgggtgtcatgatttcatttccctttaaaacacatcctttactagtaaggactttggaaccttgtgtctgaagttcagagaagctaccagcaggtggcaatattggtttattgagtaacatcacaggtatgtgtgggcacagactgcgggtagctccatggatactctccctaagatgtctagtttaattctttcaaaatacaaaactacttacacagcctccagcacttagttgagaggagggaactctaatcataaacgtatatacttatatagaaaggtaatgagaagcaaggttctcttttcaaatataaatcaaagtcaaaaaaaattataggtagtttgagtctcatggttagctgtcttattatcaatgttttcataaattctataatcagagcttacattcttccacatcctcagagatgatctttgcctttcttccagtcctgcacattctagttattgtgagatttaagcattgttctatgactccacaaaccaagtaaacaaagtccttaattatctctaagcaagggtgctgactacaatggtcaagaactccagccccagtatcaaacagccatgaatttaagttgttcaccacttacttgggcagagtatttattctcgttaaacctaactgtcttgctctataacatagtgttaaggatacacctgcctcataggattaaatgagagatcatgtgtttaaagtgctaagtttaaggcagtatgcctggcacatagtaaatcgtcactaatactattatcatgacttaatgcaagtccctgactgattgagtaccttttcttttgttttaatggtcagattttaaaaatggaatagttaacttaccattgcttgtacactaatcacaaaagatgcagaagggtaattatcaaagggatgcactctctcttctaaaactgatttcaatctcctctcctaactgtcctctcagtctgcacttttgcaattacagctcttatcaatgttgtattccattggcctgattcaccagccccttggctttccctgcagctgtctggcagcttagcttttttcccttatctctactactttaaggaaagctcttacttagcaggatcacttcttttcgttatctttccaaatattccaaacataaccaagatatactgaaatgactgcacacaatcattttattttctacaaatcccctccaactctatcccgcttcattgtctcattcctttgtttattcttctgccataattggccaggtcaggcagccagttgaagtaaacattttgccattaacctattgaccgcagaactttctgtgtgaaaaacctggcttgagagctccctcctctcctgtctcttctctgcatccttctccctgcttccacctttatctaacagatgcagcttaaagaaaatctagttataattccacttcaagatccattcaacgaagacacctgcattttatcctcattaaggatgtgctacaagctgaaaacattacagcctgaactacaaatagtgcccctttctttacggctgattacagcaacttggttgtggtagttggtatgcctctgtatgtttataacaaaggatatgagatggaattaactacatctagcttctgttatgacttactctacctatgctgaggcttgttaataatttgtaggactttcagaatcttaaccaactctatcttgctctgctagaaactattctaccagaaactgcaccctcccctccaaataaataaatcaacagcagggtgaaatttcttgcccagactgtggtcctcttaccactcaatattctccatgaacctattctgacactttccttccatctgagatgctgagtataccaatcccaatggtcagcccataaatagtaatagaactctaactcatgatccctataataatacgcctagaaagccaaaccgtaactcctaaagaaattggctcagaaaggtcaggacttgaccttcttaatgactgtcagcttccctattttttgtctccactctgctttcaacttgggaccaatccaaaaaagccaaaaatgatcccccaaacccatcacataagatgccccacctctggttagcctaccttcagcttccccatggcaataatgtccaatcagagcacaactggaactatttaacatgtatgtatttgttgaacaaagcttccgcatccccctgcctgtcttggaattaggcaagtgatggtggctgattcccttgctgtagcaagctgtgtgtgaatacctccacttattctgctttgaatagtctttgttattcccccagtattactagaggttccactgagacatggtctgcaccacccactgtttctgtccctaggtttcaatcaggtgcagtacccatggatacctcttacagcttgctgcttgtggcttgcatccatgcagatgtggaaagtcagcatgaggtctgaactcagctatcttttcactgagtcccttggctgtttattctgtttggtacccaagttttgttattgtctcccatttgtttgacatccttggcaggcctttcctactcaccctctttgctttatttcattcttctgtgtcggactgtctgaaagcgtttatcattagaatgagaatcccagggtagagcacaggcatgagtcctataagcctatagtttgagctggtctcacagactttcggttctctccagaccagtttccatttgtacaaactttgctgtgagtcaccaacaaaactggacgaggtcttttttctattctattttgtttttggggtcctgaagttttgctttgattcagacaagagttttgtccctgatgttcagcctactgtgtccagaattggtgggttcttggtcttgctgacttcaagaacgaagtcgcagaccctcgtggtgagtgttaaagttcttaaagatggtgcacccggagtttgttccttcagatgttcagatgtgtccagagtttattccttccggtgggttcgtggtctcgctgacttcaggagtgaagctgcagaccttcccggtgagtgctacagctcttaaaggcggcgcatctggagttgttccttccttccagtgggttcgtggtctcgcggccttcaggagtgaagctgcagacctttgccatgagtgttacagctcagaaagctggcacggacacagagtgagcagcaggaagatttattgcaaagagcgaaagaacaaaacctccaaagtccagaagaggacccgagtgcattgtggctgcttgcgcagctggcctgcttttattcccctatctggccccacccacatcctgctgattggtccattttacagagagctgattggtccgttttgacagagtgctgattggtgcatttacaaacctttggctagacacagagtgctgattggtacgtttacaatcctttagctaaacagaaaagttctccaagtccccacccatcccagaaacccagccggcttcacctgtcactggcatgcgtcgcgggactttgcggcacctagccagccactctggcagcccagagggagctcgccccccagtcaagcccagcaggtgcctgccggctgtgccgctgagtgcggggcttgcggagcccgcgcctacccggaaccgcgccggtggccacccgtaagccccagctcccacccgcgcgtctccctccacacctccccgcgagcagagggagccggctctggcctcggccagccccagagaggggcccccacagctcagcggtgggctgaagggctcctcgagcgcggccagagcggacgccgaggccaacaaggaaccgagagtgagcgagggctgctagcatgttgtcacctctcactaccaggggatatacattgtcaggtctgcatttataggcagctgacttgttgaggacctgagacatgaagtacacaagcattacttttgactaagttttggcaggtctcatgaggttaagactaggtcttctcctccaagaaaaacttctgcttcttttatgtactgtcattgcagtcgtaactcttgagcatagctctctaaatggcacaagttcacaaaaaaaaatattgagaccaaaggctacttcgacttgaaaaaaaatgttcatttgagaggtgccttaggaaaaaaaaggaataagatttctcaggcctaaggagcagcgtttttctcttgtgcagaggtctccaaatgaaattctgatttcttcactaaaacttcttcactaaaagatgctttggtctaggctaaccctcggtttgacaaacttaaaaatcaagcgagatgcatttccctagtaaatccctgttttcctagtccttcagttgcctccttatatccaggtttcccttttgcctcttcccccttcattatattatctctcctgccactcttccatcatctcctcccttcacttctccttgtctggactccctacattttccaaatgattctcctaaaaccctaaaatcccagttgcctctaaagacccatccgtcctagtcccaagtggtcccaggcatgtaggcaattctagaatttaggcctcagatctgagctgaattaaaagctataattaaggattttcctaactccacacaagactagcacgtactcatggaataatttagactattttgagtgcctacaacccatagatacttgacctatgacaacttaaatgtatgttggttggaacctcagacactaaatcctaaatgacaaaaatggaccggaatgactcaaaaaggagacctagatgatccctctttccacaataaacctcagggtagaaaaaaatatcctagtcctgaaacagctacagtaaaaatagattgggctataattcaatcatgcaaacagagaaaacatgacactataggatatttgtcaatggattacatgtgaaattggagactcaatttagaaacagaaattagcataagaagtagactcttttacctgagttacaatatcatacagaacatttttaaagggcttcagaacccaaacaagacaagacccaaaataaacttaagagacctgcagatcaaacagctaggtagctcactttctgacccatcacctaccgaaaaggatacttgcaagtattaaaaacagaagagacactggaaaaaaggattgtcccatcatgcaaaataaacaccaagtcaaagaaaaatctctcaattcagatctgtgagggtaatctgaagaaagaaaaagcacccaatatcctaccttactgtaaacactcaagatgaattaactgtaatatagatggtcaacctgctggcaggtacaagagctactctgtcttcattacaccctgttacctttgttcagcctcttccttagagcaaacatacaacataggtggtaggtttttcaaataatgcacagattgttcctatatctcaatctttaactgtaatccttgggctcttgagtaaaaaacattccttccttctctgtgataaaatccctgaaattttaataggaagtgacttactttgcaaattaaactgtagtatgaaatgcaaaccagaagaactatttcttgaggttccagagtcctcctctattcattatcaaattgtgtctgctctggtatgtctttgcctcctccattacatttgatgcctaccacagataaagctcctgatatatggattagtttcctattgaagctgtaacaaattaccacaaacatagtggcttaaaacaacacatatttattattttacagttctgtaggtcataagtgcaaaatgggtctaactgggctaaaatcaagagtcaccagagttgcattagtcctagaatctcacagggagaatctgttcccttgcgtattttatcttttaaaagccacctaaattccatggctcatggcctcttcctccactttcaaaagaagcagtggggcatcttgaaatctctctaacacaagccttcttcttctacttataaggaccactgtgattatattgggcccacctggataatgtaaaagtcaactaattagcaatcttaattccatctacaaactgaacccccttgacatataggatgacatagtttctggtcagtaggaggtgaacatctttgaggggctattattctgcttaccacaacattttacctgacattgcatgggctaaaatttctgctgatataggaaaaataattagagggaaatctattaaacttcagacagattctaccagacagttatccaaactcccccaatatccaaaagcaaaggaaggacttaaacctatagataaaagccttatatcaaagaccttcccatactctacactagcctttgtaacactcccgttctgccagtaaagaaaccaaagaagtgagaatattgatttgttcaagacctcagggccatccacaaaattattatccttaatttccccatagaatgtaacctaactaccatcctctcatcaattccaaatgccagccacttgctgcactgggacagatctctgctctgcccttttcagagtgtctgtagtgaagtcaatgcctttataccttcacctggggagtgcaacaatatactctgacagtcatgccttaggggttcactaaagaccctcctattttcctagattctcaaataagacttaaaagacataggtttcccttctgattcagttttgatacagtatgtagataatctcttactttgttcacaggacaacaaagcctgtaagaggaattccacttactctcagtcttagcagaaaaggacataacatttcaaaaaataaattacaattatgtcaaaatagagtcaattatttagggtatgacctatgtataaaggggaaaacatactctcattataaagacaattcaacttgtcctggccctctaataaatgacaacttagagaaattctaagtttaattgatactgaagataatgagtgccaaacttttctgggattgcaacatctctttatgaattgactagggcttcaataaaagatactctcctctaagaggaaaaacatgaacagggcttctgtaatccaaagaaggctctttaagagcctcaccttctctaagtacccttaactacaaaaagctcttttatctatttgtgcatgagtaatctggacaggttgaggtttaaactcaaattcaagagaagcatcagaaacacactgcttactataactgcacccatgacccggttgcacagacttagcctccttgtctcaggacaatagccactgctgcaaaaattgtcaatgcttctgctgaattagttcttagctccccacttgacttcatggttccttacacagtacagacattactactgactaagagcaaacaatgcttttcagccagttggttaacctcttatgagactctgttactgtctccctcccacattactaaaattcaccactacagtaccctaagtcctcccactctcctgctcctaccaaaagaagggaaactttacaattatcttacctaagtgaaggaactttatgtacctcactcagatttgttagagattcccattggaaactctcacctaatatgatttgttggcggatgtctcaaaacagaaacttgaggttatcaaacaggatatgttatccctcactaatttaaggtctcctttagagtacacttggccctccacatctgtaggctcctcaaccaagaattccaccaaccacagatagaaaatattcaggagagttttccctaggttttcttcaagtattgttatagtatcaggtctcacatttaagtctttaacccatcttgagttgatatttgtatatggtgagagatagaggcccagtttcattcttctgcgtatggctatccaattttcccagcatcatttatggaaaagcgtgttcattcccaatgtatgttcttgtagactttgtcaaagattgattggctgtaagtatgtggctttatttctggctactctattctgttcattgatctatatgtctgtttttatactggtaccatgccgttttggttactatagctttgtagtataatttgaattcaggtaatgtgatacctcctgctttgttctttttgcttgctttgggtattcgggattttttttttctttggtttcatacaggttttaggattttttttctaatttcatgaaaaaagacactggtattttggtaggaagtgcattgaatatatagttttgggtagtatggtcattttaatgacattaattcttctgaatcatgagaataggatgttgttccattttttaatgtcatctacaatttattcattagtgttttgtagttttccttgtagacatcgttcacttccttggttaaatatattcctaggtattttgaggttttctgtggctataataaatggggttaccttcttgatttgattctcagctagatgattattggtgtatacaaagtttacttatttttatttgttgattttgtaccctgaaactttactggattcatttatcaaatctagttttttggtagagtcttcagggttttctagatgtaagattatatcatcagtgaatagggataatttggcatccttttttttccagtttgaatgtcttttctttcttcttgcctaattgctgtggctaggacctccagtactatattgaataggagtggtgaaagtgggcatatttgtattgttccagttcttagaagaaatgataggcaacgaagattttgaagggtggaggggtgagaggggtgaagatgaaaagttacttaataggtacaatatgcattattctggtgaaggatacactaaaaaccctgagttcgccactatgcaatatatccatgtaaccaaattacacttgtaccccataaatttatacaaatagctttttaaaaaaattagaaaaaataatacaaataaaaaatacagtaaacaaccatttgcatagcatttacatatattaggtattttaagcaatcatgagatgatttaaagtatagtcatgcattaattaatgagggggatactttatgagaaatgcattgttagataattttatcattgtgcgaacattacagactgtacttacacaaacctaggtggtatagcttactacacaactaggctatgtggtacaccctagcgctcctaggctgtaaagatatacaacatgttactatactgaatagtataagtaattgtaacacaatggtaagtacataggagaggtacagtaaaagtatggtattataatcttagggtatcactgttgcaaatgaagtccgtcattgaccaaaacattgttatgtggcccatgactgcatacaggaggatatgtgtagattatatgcaaatattacattttatataggaaagttgagtgtacttgaattttggtatctgtaggaggagtcctgaaactaatccccagcagataccaagggaggacactctatactcctccaactgaggtaccatcagctcaggtggcagaacgtattatgcttactagagcttacaatctaacaaaaccctagaaagtaaacatgcatacatagagcaggtatgcttttgcagtagtacatgactttgggatgctttgcaaccaaggaggtttctcatctctgctggaacttccatcaaaaacagacaggaaacttttatgcagtctaccaccaatgggcatttaggttgatttcatagctttgctattgtgaatagtgctgcagtgaacatttacctgtatgtgtttttatgcctaccaggggttgtagggtgggaggagtgagaggatctataaaaataactaaagggaactaagcttaatacctgggtgatgaaataatctgtacaacaaacccctatgacccaggtttacctatataacctacgcatgtacccctgaacttaaaagtttaaaaaaagaaacttttagatgcttcctagggaggtgactattacaaaggttgaagcccatacaaaaactgatagtatgaaagtttggggaaaatgctatagcagatcattctgccaataagcaggcttcaccaaggttatgagcctaattaaactctcaaagaataaatcccttgaaatattcaaaaaggccgttatgaaatatcaatgttaagttcctaaaaagtcctaaaaaggaagaatggaaaaactctggttgcacatttcacacagatcatctctggcacccccaatgaggacactggagacatgaataacttccaatggatatgaacaaaatttctctataaaactactcatcatggtacagacaaattggttactatcttaaatcatcattggtggggaagatttatggactgatgaggctatttttagatcatgtgtcacctgtcaacccaacagcatcttggagaaactataaaggtggatgtgaaacctcaagaacccttaacaccctcagataggttttgtccaatttccattctccatgaaacttgtatgcctattttcaggatcggttgaaacatttccttgctgaaaagctacagccttcacaatcagtacaaagctccttgataatgcatttctaatttggggcataccaacttttataacaagtaaccaaggctcatgttttatgggagccattgtaaaagaaatttgtaatgcattgtcccttactcaaaaatgacactgcctttattactcacaattttctagaaaagttgcaagaaccactagcatcattaaaattagcaagctttctgaaggacgtgagcctcctttgggaggccaaagttatttccaccagcacttatggccatatggtccacctgctcagagaattactggttatctatctatgaactggtaactggaaggccccttcatttatggacaccacctacagtattagactaccctgctacacaaaaatatgacaaaatagcaaaagaggctcatgtagtatactcagttttatcaccaataagttaagattgacttcttaacttgtttacaatcctttcctacacagcctctttatgatcttcaacaggagatcctgattattagaacagacattagaaaaaactgttcttgaacctcccctgtaagggaccttatcagatacttttaacaacaaatacatcattgaaactccagagatcaatccttggattcatgtttcataactaaagaagcaattcaatattctatacaactggaaggctactccaacagaaaaacttaaacagaattcttagagatattatagaaatagttggtcttcagaagcagatggctgatccaaaacctccagaaaaagatgatcttggacagtagacagcttgcacccaatacatccaacctaaaacccctgcattcttgtttgtttttcaatcttcttacctgttaccactctccttattttccatagagctctgattgtcatccactaataatggttctttttctcttttttttttgtctattataattaagtcagaacatactcattctaatgccattcttatattttttttttcaaaaataagccactgccctcaatattacagactgctgtataggtcaaccagaaccagaacccctgataaaaaacctctgagcaatcctagtctcatcaaatgataccccagcaaattataatcagtgacatttccacttgtacctacatggacaaatgactttaaacaaatcaacctaagactttgctgttgtctctctataccagaaaaagaaccaattcttactgcctgtttatcagactctatataattctaaatttgaattccataatcttcactggacaatgggccaattacttgatgccaggaagacagtaatagagattcaaataggtaaactcagctaatgtgaggccttggttccaacctcatgtcatgaataattctttttgtccatggctgtccagttcgtgacaaaaattcctggtctcatctgcctcaggctaacacctcaagtctttttggtacacagaggccctgattctataaatcatcaaggctggaaattctgactcaaatacaagttccaaaatgaggccacctttgaagcattctatcagggagaattactgactcattgtttatatgaataatcagaacagtgttcccaacaccagaaatcgtatacatagaaaagactaagaaatttaacattaactctaacagaagttattaacagtaccaactctgccctagatgtaatacacatcagtcttaactcatcagcagtagtaatgcataatatcattgctctaatttcttgttggctagccatggtggaatctgtgccaatagtaatacttcttgctgtacatgaattaataaaacaggcaaggtagtacaggctatatgctaccttatgaaaaagctacctaaatctctaaggtgatcctcatgccctgtagaaatttttctcacagcctgaattgggcaatttaggttcttggacccaaaacatcttataaggactataaactattcttctttttgtcatagtgctcatgatgctgatctgttgcatgctatctagagtcttagatacttctgtgcagccactctcttatcagatgatagccatgatgataacacaacaaaaaggtcaagatcttgggaaatgatgactatatgtacaactgaacaatccgtaaatggtgaaggtcttaagccttccatgagaatgatgcaaaggtgagactgagactaaacatacaaatacacaaaggccagatttttatatatatatatatagtcacaatatatgaaaatagcactctaatgcacaatctccacagcaatgagcctgggaaaccaaaccacagtctgcaggcttcagacagcttccctacattttgtccctagtctcaactcagggccaaaagaaaaatccaaatatgcatcccaaaccaaacacgtaagatgccccacttccagatggcttacctccagctttcccatgccaagaatgtcctatcagagcatgtatagtatctttgcttttttaaattcaatataaggctttaccaccctcctgcctatctctgaatctctgaaaagtgcaagtgatggtatgtggaactataacaaactctgaataaatagtttgttatcatttaggtagttttaatttattttcacacatccttgtacaatgtccacaggcaacccagaatactaaactctagcaagtgtacccataatgtaggaaagtaaatagaccttaaaatcaccagttctgatattcaatatatatctaaccttggaaaagattgttaatatctctaagtcctagtttcctcttctgaaaaataagagtaatgtaatcacctaaatggatttggtgtaatgattaaatgtcatgatgatgatgatgatgatggtttctggtagtagctatgttcttcagatgggatggtaactgtgtcttgctgtttgctacctaatgtgagatagtatatgattttgtgtgtgtgtgtgtgtgtgtgtgtgtgtgtgtgtgtagtgtagcgtataatttcaagcatatacagaggtacacaaatagtatgacaaatctcaatggattcatcacccagttgcacaaattatcaactcatgggcaatcttttttatccatagtccttctattcacgcttccattatattttgtttgaagaaaatcccaaacatcattatttcatttgtaatatttcattatatatctttaagaaataaagactcttatgaaatataaccacattattatactcctttaaaaatccttaatatctaatatcaatttctcatgctatgaatctaatatgatgaaaagttcaacattgatttatatacacttcaattgtttccacacatttatggctccttttcttcatttctatttttctttaaaatggtgttcataaaaatgtatggttactaactggattacttctatatttttgacaaggggcagaatttggaatacaactgaattttgtctccattaatacctaccttcactacctttggtgaatattccttatatcttataatttcttgctattttaatatctaaacaacctagagtaggctgtgtaatatttactatttagctccttctagtacagtgaaggaattacaataaaatgatactatggagaatatgcatggggcttcacttaatcaatgtcataaatatccatttaaatattttcaaaatatttaccagttcccttagaaataatttacttgaggggtgatgagttcttgcttgtctgattcatttgtaaggttcagtttatttactgaggattatcgatgtacagttaccagtaaatttagaaagtatcctgtaggttgcatatttacgaaaagtccttccctatcatttatcatcctctaaacacatcctaaccacttttgctatcatcagttttgagcaattgattttcagaagcagacatttgaggggagtggctgaaagggaggtcgtttgagcattgctgttttatgagtcaataacccacctcaatgaaaaagaattaatttcactgaggtaagtaaaatgtccttttaaaaggataaaatgaaaatatcatacattcattctgtatagttacatcgttagattttctatttttaaaaatttcctctggacacactttattttcccaaactatagtaaataccacagcaaacaaaaatttttgcaagccttatggaattaaaaaaacaacacttagaatcaaaggacattcaactagtgaattattgcacataagtcttaaacttctttgactctttttgtgaacagcaggaacagtgaaattaaacaaaaaattattaaaggatttgtttccaactggataaaaaggaagatggtaaaggaaaaggaatcttctaagaaaactgtgactctttaatatcttaatagaacatatattagtcaaatgtaatattaacagaaatgtctcatttgtaccagtcaaacaataaaattggcttctagacgagatattttcattccataaatcttaggaaacgtaacttgagatatttagtaaaagcatgccctaaaacccgttaaatctaaatttaattttctgtggtattggctaagggtttgattatcttctttaagtgaataaaatcaactgttctgttaaatattttccaggaaggaaaaccagaagatataattgcaggagacaaggataacctcttcttgcttactgtcattaaattaaggtttagaccctcaatgcaataaaaaaaatcaaatgtcaaatctttcagctataataattttatttttcctggtttattcagtctgcctcagataaaatctgtaaaagcgaaaatgctctgagtcatacatttaaaattttaaaagttgtaaccacatcactcttaccagaattaatcttggcactgtgatgaaccaaggtaagtaatttttctctagcattaagattctcttctatgctaaattccagctatgttcaaacataaggatatcacatctaattattaaaactttgacaaggaaatgatagtagtaaggtgaatgactcattgcctaatactcagctgtcccatgtcagcaaacccattcattcttggcagaactggaggcatacttcagtctacaggtataccttggaatatcaatcaattagggattccttccaaatccaattattaccaacccctgtcacttccaccttctgagagtctctctaatccatcccactgctaataccccagttcaggcccccttcagctctcacctgaactgcaactagggcggccatctgagggatctcccgtttctgtgtctacccagccagcaattgatccttaactgaacaggagatctgtcttcccagagaacaaatctttggatggcaaacaagcaagagagtcacacacaaaatatttcacaatttagtttcaccatagtttatcatattatcgtcccctcactctcccctttctcactcccttcctattcagacagacacacatacacacacacacacacacacacgtgcacgcgcaaactccacattaaccctaatctcacaacttcccagatatagagccactttaataacctttgaaaccacattggactcattttcacattcctacaaatacactcacaaagcattgtaaatatttgttgtgtctattgcctctctgctaaactatgaatttcatgggggaagtaatcgtgtcttagtcttcatcatattaatctctttgataaatattcatcaaagcgaaactaattctaacaaatcaatgtaatataataaatattcaataaataaactatgaatatttaagtattcattaaatgttaaagatgccatttcgacttcatttaattttattggaatttatgttaaaatttgtaaaatatgagtaagaccttagctcgttcaatacaacaaaatacattctagaaatattaacaatgtaaatagattttttaaaaaaactatagaaatactagtaggaaataaaaagtcacatttatatcatgttggggaatggaaaagacctttctaagcatgaatccgaaggcaaccatcaataaaaagaaagcaatatcagctttttcaattaaaaaaaaattccatagcagagttatagcaatataaccttcagcaatgatggaaaaattttataggtacactgtctaatacagtagcttctacccacacataactactggatgcttgaaatttagctagtaagacttcctaactaaatttttaattttatttcattttaggaattttatttcatttaaacaattcaaattacatttaaatttcatagccacttgttaatggctattttttgaacagtgtggttctatcagtttaaataaaatcttctagaaagaaagtaaaaatgcaaaccacaaaactgaaaataaaatatttgaaatacacctattgaataaatacattatatcttcaaaacataaactgttcttacaaattcctcaaaaaattatcttttggaaaaatagttacagatgatatacaaaatgagaaatatagatggctaataaatatatgaaaagcattcaccactcactactaatcaaagaaatccaaattgaaacaatatactgactgctgtcacttcttcagcaccaccctatcttcacctcatttccattggttagatttgagtctatccattctaccttttcttaacaacatctttatcttccttaatcaattatttttctggcacccacctgacaaaaactgaaccttggataaattcaacagtccacgtcatgaactagagatcacataatagaaaaccatatgagacagtaaaaccacggataggtgtggtcttgccacctcattctcagcacagcctggacatcctctacatgttctttaccagttctttctctctctctctgtttctccacactggctgcttaaaccctttctgctctctcaaatttccaaccctgccatcttcctcctatgagctgaaggcctcaccactgcttcacaaagaaattaaagaccatcctagggcacggtggctcatgcctgtaatcatagaactttgagaggccaaggtgggcggatcgcttgaggccaggagtttgagagcagcctgggcaaaatggcgaaagcctgtctctgcaaaaactacaaaaattagccgggcatggtggcacacacctgtagtcccaactacctcaggaggctgaggcagaagaactgcttgaacctgggaggcagaggttacagtgagctgagattgtgccactgcacttcagcctgggcgacggagcaagactctgtctcaatctccaaccagtataaatgacacacagttattacctttctactgatcccttaaacttccccaactattaccacagatgcaatgtcaatatttatttcaccatttgctggatttcaccctttgtttcctatctcctcttttccttgtattttctattctcttcatctaatgcacccatccttcaagcatttaaatataccaaattctctcctgttttgaaaagacacatactgcagtgccttaggaaatcagcctcaaaatccgagctctaccattaccgctgtgtgatcatgtttggcccctgtcatgtttccctttctgtatctacaaaagtggaataacaacaacattccatccatagtatagttacgaacagggaatgaaaaagtttccacaaagcacttagcatggtccctggcatatgataacctcttggaaaacatcagcaatcattttcactttttgaaatgattttgagctctcctcagcttcatattctttccagccatcccccatcactctccttcctttcagagcaattcttttttcttagctaattttagatttaaagaaaagtttccaggtactacaaagagttcccatattccccttatcctggttcccctaaagctaatacattgcataaccatggtacaattatcaaaactaggaaattatcatcagtgcaatactatattaaattacaggccttttccggatctgaccagttttttcataatgtaattttctattccaggatccagtccagaatcccacattgcaactgtgatttctccttagtctcctataatccatagcaattcctttctctttcccagtcatgatctcaacacctttgaaaataactaatcagttatttggtagactcttcttcattgggggtttgtctgatatttattcattattaaattttgaaaacttacattttttagtaagaatgccacagagctgacactgtgtccttctcaaggcatcatatcaagagatcatgatagcagtatgtcacaggaaagtgttttgtaagaattatatcctctcactgactccatttcatttcctcttgcttctcaatctactgttcactggcctcagtctccatcagtccattgaaactgttctggttaaggacaccaagaactctcttgtcatttaaagtttctttaaaagaaacttctcaagcctttactcctagaccacatagtatttttgacactgctgaggactatcttctttacacatgcatttagctgccacaacacatttgcatgatttaccactgattttttattttatgagtgcttacctgcactcaggcccttccttccttcctttccttccttcctcttttatttttctttcttttcctctgtctttctccttctctccttccttcccttcccttccttgtctctctctttctttctttccctccttcattctctcccttactttagagatgggatctcactatgttgcccaggctggagtgcagtgtctattcacaggcatggtcatagcacactacagcctcagactcctgcggctcaagtgatcttcctgcctcagcctcaaagtatctggaattatagactcctatctcttagtgctttcctcagtcccctttcctggctccttttatgataaactacctctgaacgttgagagtgcttatctctgactacacattcttcctagattaatgcatctacatatctggttttacttgctatccagatgcagacaattcccacatcaatgccttcaacacatttctgtctcctagtcttcatcccatatacacaactgtattccaaacatctctaagggatagcctacaggaattacaaatggaacagatcccccaaccaactctactatgattctaaagttgagccttctaaaatatgatttattttatgccaccaaacctactaagccacttatacatataaacacaacaaagtagacagtaggtaaagaatgtcatatggtctttgaaataagattttattaatgcagtctaagcctgcaattagattttgtgatagtcacatcatataactgacacataagctgaccacaaaagaaaagcttctattttaaaaataaacatatagccgtagctgtttttccaatcctgtaattgtatgggtaaaatttaggacatgctacatcactctgtttaatttggtcctcattccagtctgacataatttgggatccaaatgcagtaatccaactagctgttaaattaagatacactgagcaaacactactagagatacagaagtgaggcagagtattagttgtcccttcaatccattcttctctttatccatagtattgcagtttaatctaggtccctggccattatctagatgtgaccctgtctaagataaatataataggggccacatatgtaattttaaaatttatgattgccacattaagtaaataaaggtgaaattaacttcagttacatatctggtttagccaatacatccaaaatattatcatttcaaaatgttatcaatattaaaaatatttagatattatgcattctttttttcattctacgtttctgcaatcaatgtgtatgttaaactcagaacatatgttaatccagagcagccacatttcaagggctcagtaggctcacttgaatagttgagaggtagagagactgcatttatggtacagcagcttaaaccttaactcaatgtacacaagagttgaacaagcaaccacattccaggtcctaaatttgccttctctcctagctgcaaatttggtggctggtggatttccatatttccatatataagataatgtgtttgtgtgtgtgtgtcaaagcagaggttcagggagagagaaggcaatctctcttaaatctgtatttgcataaaaataacacttttgtttagattccatgttaccagtcaataaatataggatatctaaaaattattttattcatttttacataaaactaaagaaactgttattcatattaaaatatggtcatcactgttattattattatttcttaggttgagataagcattgtttatccttcaattagtcatttcatgttctccagtggcagacagcctgggtgaatttatagcaatgggatgttgccaagtttgtttcaattactcccttagcattgtgtcacaaaaaaagtatatatttttatgtatgtatcaaagtgcacatgagaaaggaaagagtcaaagtcaatggcaaataagaaaccaataaataaaatgtactgtgctttaaaactttgttgatccacttcccaggaagtcattagtgtctaataatggcaggtttctccccactgcccattcctgttgactgggggaagggagccttgtgagtggagaagagggtatgctacctacagaactgtgttcacagtgttggtatacttatgtgtcctaccaactgtggctaagcccatggcaggctccaagctgtggatcattttatctttctatttgtcaggtcacagtcatgaccactaatggcacccatcccaaaagtatatgattcttcaggaaatacagcttgagataccaatggaagtatctttttaagcaaaaataggaatataagattttaaaaattattttcttcaccttcttggttagtgactaataaattttttggaatcttttggctttcatgaactgttagcagtcccattatattggctctttcctccctaactcatatgtggtaaaattaaagaaggaaggaaaggaggctgaatgaccattggtcatgaaaacctcaatattccaaaactctctcaaagagcctctcttcctcaggatagtagtttgaaaacagaaaatttgggaaggccacttgggataatgtttggtgtctgttgctgcatcagcgtttacaaagtgagtatccaaacatgtactttttttgttgtttttttcgagacacagtcccattctgttgcccaggctggagtgcagtggggtgacctcggctcactgcaacctccgcctcctgggttcaaatgattctcctgcccagcctcctgagtagctgggactaaaaatgcacaccaccatgcctggctaatttgttgtatttttagtagagacagggtttcaccatgctagccaggatggtctcaatctcctgaccttgtgatctgcccaccttggcctcccaaagtgctgggattacaggcatgagccactatgcccggccccaaacatatacttctttaaaatgcacaaaaactcaatgagtgttattttccttattactattgttatacctaactaacaatgaggaaatctaaggtgtagagacattaaatgacttgctcagggtcaaaagctaataagcggcagattaccaagatttctcaattcaagtccagagtttccaccatgaatagcctcagaatattgcaaaaggctatgctttaggaatggtacttaatagtgttaaaggactgggtaaaataagataacctaccaagaaaaaaagttgtaacttcaattgacaacttacaatatgaaaaacctaaacattggttaaaaaaaggaaactgaaacttttttttattattattatactttaagttttagggtacaggtgcacaatgtgcaggttagttacatatgtatacatgtgccatgctggtgtgctgcacccattaactcgtcatttagcattaggtatatctcctaatgctatccctcccacctccccccaccccacaacagtccccagagtgtgatgttccccttcctgtgtccatgtgttctcattgttcaattcccatctatgaatgagaacatgcagtgtttagttttttgtccttgcgatagtttactgagaatgatgatttccaatttcatccatgtccctacaaaggacatgaactcatcattttttatggctgcatagtgttccattgtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatttacccagtaatgggatggctgggtcaaatggtatttctagttctagatccctgaggaatcgccacactgacttccacaatggttgaactagtttacagtcccaacaacagtgtaaaagtttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatgtccttcgcccaatttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagtagctctttagtttaattagatctcatttgtcaattttggcttttgttgccattgcttttggtgttttggacatgaagtccttgcccatgcctatgtcctgaatggtaatgcctaggttttcttctagggtttttatggttttaggtctaatgtttaatttttgtattaattgaattaatttttgcataaggtgtaaggaagggatccagtttcagctttctccatatggctaaccagttttcccagcaccgtttattaaatagggaatcctttcccccattgcttgtttttctcaggttcatcaaagatcagatagttgtagatatgtggcattatttctgagggctctgttctgttccattgatctatatctctgttttggtagcagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatattttcttcccatccatgaggatggaatgttcttccatttgtctgtatcctcttttatttcactgagcagtggtttgtagttctccttgaagaggtccttcacgtcccttgtaaattggattcctaagtattttattctctttgaagcaattgtgaatgggagttcactcatgatttggctctctattggtctgttattggtgtataagaatgcttgtgatttttgtactttgattttgtatcctgagactttgctgaagttgcttatcagcttaaggagattttgggctgagacaatggggttttctagatatataatcatgtcatctgcaaacagagacaatttgacttcttttcctaattgaataccctttatttccttctcatgcctaattgccctggccagaacttccaacactatgttgaaaaggagtggtgagagagggcatccctgtcttgtgccagttttcaaagggaattcttccagtttttgcccattcagtatgatattggctatgggtttgtcatagatagctcttattattttgagatacatcccatcaatacctaatttattgagaatttttagcatgaagggttgttgaattttgtcaaaggccttttctgcatctattgagataatcatgtggtttttgtttttggttctgtttatatgctggattacatttgttgatttgcgtatattgaaccagccttgcatcccagggatgaatcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattagaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttcggagggtgtatctgtcgaggaatttatccatttcttctagattttctagtttatttatgtagaggtgtttgtagtattctctgatggtagtttgtatttctgagggattggtggtgatatcccctttatcattttttattgcatctatttgattcttctttttttctttattagtcttgctagcagtctatcaattttgttgatcctttcaaaaaaccagctcctggattcattaattttttgaagggttttttgtgtctcttcagttctgctctgatttcagttatttcttgccttctgctagcttttgaatgtgtttgctcttgcttctctagttcttttaattgtgatgttagggtgtcaattttgggcttttagtgctttctcttgtgggcatttagtgctataaatttccctctacacactgctgtgaatgtgtcccagagattctggtatgttgtgtctttgttctcgttggtttcaaagaacatctttatttctgccttcatttcgttatgtacccagtagtcattaaggagcaggttgttcagtttccatgtagttgagaggttttgagtgagtttcttaatcctgagttctagtatgatcgcactgtggtctgagagatagtttgttataatttctgttcttttacatttgctgaggagagctttacttccaactatgcggtcaattttggaataggtgtggtgtgatgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtcactgcacatgagatgggtttcctgaatacagcacactgatgggtcttgactctttatccaatttgccagtctgtgtcttttaattggagcatttagtccagttacatttaaagttaatattgttatatgtgaatttgatcctgtcattatgatgttagctggttattttgctcattagttgatgtagtttcttcctagtctcgatggtctttatattttggcatgattttgcagcggctggtaccggttgtgcctttccatgtttactgcttccttcaggagctcttttagggcaggcctggtggtgacaaaatctctcagcatttgcttgtctgtgaagtattttatttctccttcacttatgaagcttagtttggctgaatatgaaattctgggttgaaaattcttttctttaagaatgttgaatattggcccccactctcttctggcttgtagagtttctgccgagagatcagctgttagtctgatgggcttccctttgagggtaacccgagctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggatgttctcctggataatatcctgcagagtgttttccaacttggttccattctccctgtcactttcaggtccaccaatcagacgcagatttggtcttttcacatagtcccatatttcgtggaggctttgttcatttctttttattattttttctctaaacttcccttctcgcttcatttcattcatttcatcttccatcactaataccctgtcttccagttgatctcatcggctcctgaggcgtctgcattcttcacatagttctcgagccttggctttcagctccatcagctcctttaagcacttctctgtattggttattctagttatgcattcgtcttaatttttttcaaagttttcaacttctttgcctttggtttgaatttcctcctgtagctcggagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagctttccttctaacagacaggaccctcagctgcaggtctattggagtttgctagaggtccactccagaccctgtttgcctgggtatcagcagcggtggctgcagaaccgcggattttcgtgatccacgaatgctgctgtctgatcgttcccctggaagttttgtctcagaggagtacccggccgtgtgaggtgtcagtctgcccctactggggggtgcctcccagttaggctgcttgggggtcaggggtcagggacccacttgagaaggcagtctgccctttctcagatctccagctgagtgctgggagaaccactgctctcaaagctgtcagacagggacatttaagtctgcagaggttacagctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgccaccttgcagtttgacctcagattgctgtgctagcaatgagagagactccgtgggcgtaggacactctgagccatgtgtgggatataatctcctggtatgccatttcctaagcccatcggaaaagtccagtatttgggtgggagtggcccagttttccaggtgccgtctgtcacccctttccttgaccaggaaagggaagtccctgactccttgtgcttcctgagtgaggcaatgccttgccctgcttcagctggtgcacagtgcgctgcacccactgtctggcactccctagtgagatgaacccggtacctcagatggaaatgcagaaatcacctgtcttctgcatggctcacactgggagctgtagaccggagctgttcctattcggccatcttggctcctctgaaactgaaactcttataggcaaataacatgtctataagtaaattagtttcttgaatgttacacatttgagctgttaagcttgttttctgtttcattttaagagtttaaatctctgaaagtttggtagaatatatcctctattttcattttcaagtgtgaaagccatatcaataaataagtgcagacttatataactgcaaaaatgtatcttcaagtatttattgtgtacctactatgtgccaaaagctcagtgtgcctcaagcttggggacagaatcatgactagaactcagatcattgtccaagagttagtacgcaacatagtgccatcttccaaaaaaaaaaaaaagaaaaagaaaagataaagaaagaaaagaaagaagtgccatagtggactagatcccttatctactcaggcctgtgatctagaatgacaatagtacatactggaagaaatgatggttttatgatatcaattttataaagctaggaatgtgcactcaaacatcgtcttacttgtcttaacaactcattgtaaatgccttttctttgaattcatttaagccacacttaaacctatctatatattctgtatctaaactcactctctattcagatgaagccaacaaaaaaacaccccaatatacataataaaacactataaagttgagttaaaatagcaacttttttctatactacaattaatatgtttgcctactttttaaaaattgtttaacctagacttacacattatgtcatcaaacatagtcatagtactaagaagagattcagtataaaactactgttacaaaaagggatgagagagtagctgcaggctttcattttgctaaaccacatgactatccttctcaacagaatgtagaaacctgcacttttggtacttttattttacataaaacattcttctattagtttatttttctaaagcattttgcagttattccctggctaatagtaataaccaagaattaaaagctacagcatatgttgaatagctgtattacaccataaatcacatttactgccatttgttaacatgctgttttaatttcagaaaattcaatgacagttcatgaattttgcggaatctcaaaaataatgacatgattttatgttgaagactaaagggatgttgtcaattttaatgtgtactgggaggtcacatggtattctcaaatttaatggtaaagcaaatttagttaaccctgcagaaacataaggagtcttgaacaatcagtctcttggctagccaagggcaaatgaggaatgaagacacttacaagtttaaatccaacacctgagggtgctttgaaaacttttctgcaccaaatgcagctggtggaaagagatactcaaagggtaaggaagaggcggtacaaagatagctgataaaaggcaacagtcacagcagtagaaaaatttagacaactatttgcgagaacttatcatctgagtaatcattctttgcaccccaggtctttattcccaccctcaagaataaagttaactccagctatgtccagatacaggtagttttgcctaggatactagttatcttagtttgttcagtctgctataccaaaatgccatagatcagatggcttaaataacagacatataattctcacagttctggaggctgggaagtccaaaatcagggtgccagtatggtcaggctctaacctgatctgctctttctagcttgcagatggctgccttcttgctttatcacatgagagacagagaggaagcccgtgtgtctctttctcgtcttataagcacactaatcccatcatggagccccaccttcatgacttcagctaaacctaaacctcccaaagaccttgcctgctaatcctatcacattgaggattatggcttcaacaaacaaatttgggatcagggaggacataaacattcagtacataacaatggtcatcaacctttagggtgcctaagaaccacttggggagatttagtaaaaatgcagattactaatccttcaacatttgtgattctgattcattccatctgggaggcggacagaaaacactttcaaaagcagtccaggaaattctgatgtaagggtccactggccacattgtgagaaattctgtcctggcttagcttcaagcagaagggattgcttgcaaagtgcctgtgctgtgcctcaaagactgaaagaagtgtattcagagatcagactgtcctacggatggtaaaagccagaaccaggaggtgccaacagaggtgctcccacataaatgtcaaccaaatggtgctaggtaatatagatgtactcagtgtccaattcccatcctctcccccattgccatggcctttagaaaactatctttgacagagaggcaaaaggaaaacacctggctagaatcctcatatccaatctaaaaataagattttaagatagattttaaggggaaacaatacatgggaattcaattgtgcatatcctaatggagtcactctggccaatgagagctcaccctgagaaagagggcctctcccttacaatatgataacaaggaaaagtcttttgaaataaacaataatagtaataataacaataacaatcctatgaggattatattgaagtccatgtagtgtttttccatttatcagttccttttgtcttctgtgataaacatgaaggaaaatgtatggttgtaaatggtttcaactaacaaaacaataacattcagaaaaaagtcatcaggagaactgatttttcagttgtcctaaagataatgcagtgtagtcagattaaaaaccctgaattgacaaggctttaatagatttaacttctggggcttactttttaaatactgaaatcacaaacttcaacagcttcaaagtgttttgcaacaaacatataatgattattttaaaaacgattattgtttataagcttaaaaaggaagcagcaaaagaaacagcattataggctgggttggggctcacactgtaatcccagcacgttgggaggccaagctgagaggattgcttgagcttaggagtttgagacccggtctctgaaaaataactaaaaaattagccaggtgtggtggtgtgtgcctgtattcccagctatttgggaggctgaggtgggaggattgcttgagcccaggaggttgaggcttcagtgagccatgcttgcaccactgcactccagcctgggtgacagagtaaaactctatctcaaaaaaaaaataaaaaaaaaaagaaaagaaaagaaaaataaaacagaattataacactgagaattaaaattacttttaccatgtagcgtatttccctacaaaaattcaagttgtcctttaaatacaaatacatgaaactactgatgtttcaagtaaaataaaaatgaatgtcttcatagcactgtttgttattaagctatttccatactggatttatgcaagctatgttttactaaaagaataagcaagtagaaaataatgcataattcctacaggccactcttctttaaagatgaggaccttcttgataccaactgaaattgcctgtgtcaatgattccggtgaaatatgcctcagtaaagatgggactcaggaaatataataaaaatctgtcagccaagttccaagtgcctaggaactggtcatcactggcacattgtagagcagtttgataagcattaaaaaaaagtttgtagtgataaatgattaactattgttgaaattaaattgaatactttcatctttaaaatccatttaatttctttaaagccataaggtttttcaaaggttaagatttattatggattttggtttcaggtgattggtaagtaccagcctcagaatgccatttggcacacaaattgattccctcaggaaaactaaaattatgtggataatcccatctctatgtcctgtctctcaaaaactttagaaaattaattcaaaggacagaagtgtaggttgttttcaagcaaacaacttcaaagtgagtacatttttctcctttaaaatacacacagaaactctaaaagggtcaggccatcttcaagggcagaatacttgttcaacatctagatataggctgctaaggctgatgaatgagaatggaagtaagagaaaaagctgacaatcagtcaagggtatcatcccatatttttaaaaaattccttctttggtcagttcattccattttgatcaaaagcatcatgcaaccacttgtttaacataaggaaaaaaaatctcaaaatataagatgaatttcacattactgaagctcacagagaatgaaatacagtttttctagaaccttatattaatttcttggccaaaattaagtcctctcgaaggttaaaaaaaattgcaagactcatcagttatggcagccaacagatcaaatactcatttactcattgtatataagaaaatggtgtatttaaacattcaacaaataaataaagaaaacaaaaatttcctgggagcaccaccagaagaatgatgatgtatgttggtgatagccactgaacttgcagctgaatacctggttcaaggtggatcatgccattctcctaccttctgtgtcacttaaaagaaattcaaattccataacatagcccacaatattctgctgagctgccccctgcctctcttttcagtctcatcacctattctctcctcctcattcacactggcctcccttcaatctctccagttcagcaagcttcatcctacttatctagcactctctggctcctcccctgcctcgtactcacctgctgtctcctgctcatctttcaggtctcagactgcatgtcactccttaaattcagtcattgcctgccccacattctgaatcaggtgctctattttctttcagagtatgctctattcttcctttgaaacatttatcaacacagatgattatacatttgtgtaattattcatctaattactctttccctcattagaccataagatttctgaagtcttatacatggtaactagcacgtagtacaaactaaacaaataatattaaattaatgaaatcccagttctgacaattatattatcttaggtaagtcatccaatttctctgagctttattttcttatctataaatatgggcattaatctaataattttatatattttaacataataggaatatattcacttttgcaaattggaaagcaccactcagatttaagacattatttttttttcttacatcaagattatgaaccaaagaacttttaaattgatcattatagtcttcatttagtcggcataggcatatccagaaaggcctcacatttagtactaataaagcttggtgtttaaggaatattatagacaatgaataacaatgattccttgtaatttacaactgaagttgatgccacatcaggtatatcaaaatcttcgttaagactatttcctttaataaagtttatgctaccatgttacataaaaaggaatcaactggtattatttagttgttctgtttatatggactattttagcaatttagaaaagatgtagggtacatgccactttatatgcaaatatgccttgacaactgtatgaataaacaagaaaactgtaaatatactttaaaagccaagatgatacaaatggccattcatgagtggacttactgtctaagttatttttccaagagtggaaattcattcatgttgatacacgcaattctcacttcattccctcttccaatgacaaggtgaggagatctatgtctagagcactttttatctaagtgaaaggagccaacaagtgccagatgaacatgactgtggtctcatcttttttcaccttaacccactggcctaacgggcctggacagcagaagatttgtgatgctaaaagaatttacttctgcctggatattttagggatttgactcctgtcaggtattgcaacaaagtcaagtgattcaatttaccaggcaaggacaagaaatggtttcaggaaaaaccaaggtgatgaactattgagcatccagttcattagctgtcatccatcttgacatcttcatctttcaagcagtactgcagaaaatcaaagacgtgtagtgcttcccttaaaaaatctgagaaggaaaacatatcctcttaaagttaaagagactgtgaagcctatttcaaatggattatgaaagataaccattgcctcaagtctgaaaatcttgatagatactccattgtaaatactacctgtgcccttaaacacactaatcttaaaaataatatcattaaaatatgtactgcatgaactgctagagtatttttagcttattctaatttgatgcattgtgcattttaatatgcagtaatagttacatgacaaataactgaccttttagaaatagcatcttgggggaaaaaaaagactcaagaaaaaaagtgtttccctgaaacatcagccaataaaacatgggcagtaagactccagtgacatagccaagtactggtaatatcaccttccttcttttgtttctctgctctgcttattcaacactgaggtactgaaactctggggtttttgcacttatatgcagagtttcctggaattaaagagtaatgtaagcaaccaaagacattaaagaagtgattcataaccttccccacctactattctttatcaaggggaaagtgttttatttcaagttcttgaaggcccctagaggtaaaggtgaggtgaaaattatgcttttcttctatatcccacatactactttattaatgctaagaagcactgtaatgttgccttttaattctctgctttctgaaacactcagtgaatattattccagatctgtagttactaacaaacaaaataaaattaaagactcatacattgttctctcctgaatttgccatttaaaacatctaagtcaggctgtgaaagaaaatgttaactcacggctcacatcatataagcaactagaccacaaaacctaaaagattaccatggactctcagaagcctttgtagtcttaaattattggaggacaactaaggaactattcaggtgtacgctttgcccatcggggaaagccctaggtgcaggtgactgaatggctgcttctgaagaacggcatttggtatctgagtaagttcctatacctacaaattacttgcaagcccttcagcctgaaatttcccaatatattattaaaactcttattatctccacactacttgctgctaccaccactaccaccatacactgcatgatttttggccgggaactataccaggcactttacataaggcacacatgtaacacccgcatcaactgtagaaagtaggggcattattatattcagttgatagaaaacagaggcaggtaagatgttctaggcttctgctaagcaaaacatggtccatggaatagcagctacaacatcacctgagagcttgtctgaaatgcagaatctcaggctcaagtccctgatctaatgaattaggatctggattttaataagatatccaagtgatttatatgcacatgaatattgagaagcagtgctttgggtaaatggaatcactcagactcaaactcaggggtctctagctcaaagatccagatattaaaatagtcagctcttcctgaagatgcaagacatctaaagaatgtaaaacattgaatacattcacatttaggaccaagtttttcatcagctgagaaaatctgatactgagaattacaaatttgagacgagaaaacgatgacctgggaataacagaggaaggagatacctggtaagggaatagaagagagccactgggaaaagaaattgggcttaaaacacactttgtgcattttggtttgtccatttcagtttggttaagggagttcttagccaaactgaacagagttttgactctgttcccaaaactctcggctcacctgaagtggtgcttgatatcagacaaccttactggggagctcaagagtgcttaattgaattattcacaagatcactttctcatgaaccaaccactccatatccagacatccctttgctgaatgtacatacttattcttcaagttcttacatcaatcagcccaatatggagctttctagagatactaactgcttaactaagtctgataaatgaaaacatctgtatgggtgaaatttttttaatgcaattttagttgttttttcaccaccatatataataaatcaaactatattaatccatcaggtatccatctgggatcagttttgatggtattcaagcctgataggtaattaaaatgttatttccatgcaaattgcatctgatcttgaaaacagtttcccttaacctgaaattggctaaacatttctctgcagtcttaaattatccaaatttccaagcaaatatttttgtttccataatagaaagggaaactgcaggtcattcatgaatcaagttatcataattaattaggtttagctctattacctttttatttaaaagctaactggatactactatttatccttccttttgtattacagtatttcataactgactttcatagtatccactctaaaatttgttaacactttgatgatacagtattttcatcttttattggaaaagaatttattgctactttcaagcatagtttttttctcattcattatattgttatcataaccacgtggcttataaagatatgcagacactaatgttatatcaatacttatgtctttggacttttcatttaaaagttaattgttgactatgtatttttttattgtgcaaactttcccaaattccacaccatagcatgacttgctaatgaatatatttacaccaagaaaataaaatgaactttgtataagtttctaatataaataaaagggaatacttactttcgaaagaaagataatttcctatcaatttaataattttctttcattttaacggtagaaattatacaccaatttcatgtcacaaaagaggttagagcttgtttttataaacaatgtttgttagattactcttgcccctatcagaggaagatctgaaaatgtaacaaagaagatatatttcatttttgtgcaaatagacatgtatataaagattaaaggctctgacagagcctaaaaatgaagtcctttatttaatgtactagaataatgcatgcattggcagtatgccagctttaaaattgacatagaatgagccttaacttctcctgcatgattcactatcaggaccagaaagccattcagcaatgcttgtcatgtcttgctatataacaaaataacccccaaattttgtggcttataataacaacaaccatcttatcatctgctataaatgtgtgggtcaagaattcaggaagggcctgcctgagaaattatctgtgccatatggcattaacagaagtcacttggaggtattctgctggtggtttggctcctccagagagctcaagtcagctttacctacatttctgcagtcttggtggtaatggctagaagaatgggctcagcaggacaattgaccatagcacctatgctagcccctctgatatggtggcctcagagagtggggtatcttttcatagagtcttggatagaaggtataagtcttctgacttagcatcacaagtcccagaatgtcacttccactgcatttactgactaaatgtaacatagatcccaagacagaaaatgaacatgcattaggtaaaaataaaagaaatctgaatgaagtctggcctgtattttatttttatttattggattattatttttttttttttgagatggactctcgctctatcacccagactggagtgcagtggtgcaatctccgctcactgcaagctccgcctcccggattcaccccatcctcctgactcagcctcctgagtagctgagactacaggcgcccccaccaagcctggctatttttttttaaatatatttttagtggagatggggtttcaccgtgatagccaggatggtctcgatctcctgacctcgttatctgcccgcctcggcctcctaaaatgctgggattacaggcgtgagccaccgtgaccggccccagcctttattttcaaacaaatgttgttgagaggaataaatatgacagtgtggaataaaacagaagctcacacacctacattggcagaaaaagttagatatgatcaataaattgttaaaccatttaacgtttttgccagagaaagaacacaataatttgaagaaaaaatttaaatatggtttctctgcctacaataaaatggaatagagaagagaatactcactaaagagaacaaaggtcaaatagcaagagaaaaatacaaaggcacagccagctgtagatccaggaggacaacaggatggtcctgagcagaaggataccagaaagggatgtttaagaggcaataggatactgcaaaccagatgagtctttatagtttctttagctgaccctgaaagcaagtgatttctaagttacaaactgctgaagagaagaggaactcccacccaaaactatatagtaagaagaaaaagacttgctaaataccatttaacttctgaaacaggaaagaatcactacatatttgtgataggcagactaatgcctgccaccaaagatgttcatgtctttctcccttgaacgtgtgaatgtattatgttgcataggagaattaaggttggagatgggattaagatggctgatcagctggatttaaaataagaagattaccctggattatctcagaaggcccaatatgatcacaaagctcctttaatgaggaagagggaggcagaagagccagaccagagagcaggcataatcagaaagactccattggtcattgctggctttgaagatagaaggtgtccataagccaatgaatgcaagcagcttctagaagctgaaaaggacaagaaaacagattctccctagagccttcagaaaagaatgcagtcctgctgacaccttgattttcatccagagagacccatttcaaacctctaaactccggaactgtaagacaatacgcctgtgttcttttaagacactaaatttgtggtaattttttacagcagcaatagggaactaatacaattgtgaaaaatgaggggaattggaaggaaaaaaattaaagcatttaatttgcaaacaattgttcaaacatgataaaaatgataatgagacttacaaaatatcttacaaatgaaagaagataactttcctgaaagaagataactatccataacacataatgattgacataatcctgtgagggtcatgacaaatatgctctatgaagtgttgggatttcagcttcctgtttcatttcatgtcagttttggcagatctggacttcagtaactagcagtgtgcctagtacatggtagaagctcaataaggactaaatccattatataaactaaaggggactataaagtagaaaaaaaaactcattatcacatatggcttgtgagattaggcacatagcaaaggaaggaagagagaagagagctaaaattatttggaataaaaaaagaaatccaattgagatccaagtgaaatgcaaatacatttctagtgagacatttttaaccattgacgaagcttcttagtttcagttgggtcttcatagcatcctgcaaaaatgcatggcaaagatacagctgaacacccaccagctgaagctgggctgtgattgttctggcaaacacataacccagagtaaatattgtcttgcacgaagaagtgaggaggtggattaggcattgtaattaccatttgctgggtatttggcattctttttaaagatttaatcatttagatgagacttagtatcactaaaaaaggagtcaatatttctgtgagccagggaggaacagcgctgctgttttccttctgctcagctgttacatgtgcctacagaaagacaacttcacctgctacttttttattcaagacagcacagataaagaatcatgagcagtaacttctttcagttcttttttcttcctgaacacactgtgttctcatctattattgatcagaaagtgatatttaaatagggtggcaatttataaaattgcacagggatgttattacattatcttaattaattttacaaccagcactcactcactgtcctttatagtacatctaaagaattaatgtgctgattaacaatagccaagcagactcagatagtagctttcagataagaacttctgttaatcttctgcttgtcaattggaatctactgacataaattgctttaatctgagttcctggcattaagcatttatagaacaacattttgagacactgattattgtaccattcctttggggcagtgcccctaaattttagtgtacaaaagagcatctggaatttgttaaaatccaaattatttagccctttcagagagatcctaattctttaggtctaatgtgggtccaagaatctgtatttttaacaagcattctgaaagtgtctgagccatggggtgaggggtatgtaaccaaacttgttttgcaatcgtatataaatatggacaatatttttgctgaaacttttcttcttttctttaaatgtccaagtccttatgtacatgatctcttttagtcctcacaatgatcttgtgaagtaggtattattatttctattgtaacaaagagacaaagggtttagtcacttgctgtctgtttgctcaggctgccataataaaacactatagattgagtggctaaagaacagcagtgtattctctaacagttttggaggcttgaagtccaacatcaggatgccaccatggtcaggttctggggagagctctctttctggtttgcaaatggctgccttcttgctgtgtgctcacatggcatttcctctgcacatgcatggagagatagagaaaatgatctctcttactcttcttcttataaagccaccaataccattggattaggacttcactcttatactgtcatttaaccttaataagctcctaaaagctctatctccaaatagtcacattggaggttagggctccaacatatgaacttatttgtgagagagggcggaatttagtccttagcccttgcctatcacaaatagtaagtgggatccaggatttgcaccctaattgccctgactccaagcccacaccatctctaccttaccttgcccctcttgccctctgggccattagcaagaagtagtgatgggctactcagcaacagaggcatggaggttggttagatgaatattcagtcttccattaactgagaattgactttaatgtaatcagatcacttcattaaactttaagggctgccttatatctggtgactatgactattttattcctgcaactttattactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaataatctatcctctcctcactgatttttaatgccatcccattaatttgatgttttatatggtcagtttctgagatctctattctgttttgtaataaaggtacaaaaataataactagatatcttataggcatgttatggctattattgctactttgatttttttgaatgtaatatttttctttgcttctgtattacaaaaatattcttaaatgattcttatatacaacaaaattattacttctaaaatctgtcagtaagtgctcttggattttctatgtacatactcatgcaaccattttgttctttattttccattccctacatacttttcttaactttattgcataggctaggacctagctacaataaatattaactgactgcatgcatccttgtggaagaaagcagcatttttactactaatttaatgctttaaattataatattagtatatttagatgttctcttcctatgttgatattgaaaatttatatttagaaaatcgttcagttagtctaagatttcaggttatttagcataacatgttcaaattcttctctcagaatttaaaaatcttcactagatctgaaatgatatctttttttatttctcatattgcctgtatgtgttaatgtgtgctttttaaattgatcgattttgccatgggcttgtctattttaacatccttttcaaaaatccatcctttgtattttgttagtaatttctccattctttctgtttgctattgtattactttgtgcttcttcttgtatgcttttccccttcccactttcattagaggttctctgctattcctcctctaactgcttgggttgaaccttcttttatttagttccaaatgatctatttcctgatatgtacattcatttttggaaacttcaattgaagtgatcgctgtatgccacaagtttttatatatactatgttcactgatttagttacaaatattgtttgatagctatttaacttgcttcattaactcatgaattatttagaagtccatttttaaatttccagctatatggggaagttggggctattttttatagttggtgccacattttattaaacttatttcatggaattttgtgcttcttcttttgcagtcatctagagtaataataccaactaacatttttcaagtatttaccatgtgttaggcactattctaaacagttaatatgttttaacttgttaaagctcacaaacgcacaaggtactatgatgatcagtaatttacgaatgaagcatctgagccatagcaagataaagtaacttaaccaagtaacacagctggcaagcggcagtgctaagacaagcttagtcaaacccatagtctgctcctataaccaccacaaaaaaacctacctctgaatttagtgtgctcgagaaaatggatatttgcgttttcagagcatgcagtcatacacgcatctgtcatatcagcttcagtgagttattgaagtcttctatattttttctaaatattttcatctaatttattaatttctgaggtaaggtgttaacatctcctatttggatagattcatcttattttgttaatgttttgctttgtacattcattttagttcataatgcatatttgatatctttattaatatttctctttatctttactaatggttaactataaattctattttgtctgatattaatttactataccactgttttttctttttgttctaatttacctggtatatcatttttcatttttaattattatatatataaacatatacaaatatatacttggttaacttactttatcttgctatgtgtggctttttttttttttttttgtagagacaaagtcttgttatgttttccaggctgttcttgaacacctggcctcaagcaatcctcctgcctcagcctcccaaagtgttgggattacaggtatgatccactatgcccaggacatcagtacctttaaagattaccttcccatttcattcctatccatttcacagtttcactgtgatgtttctaagtgggcctggttgttccttcagtctgggaattcacttctctactacatacagttacctacttggctattgcctctccttcattatttctatactcttattctggaattcctgctttagattttttttattctatcctcgacagctctatttccatatttctaggtctacgtattccatcatgggtgatttctttataattaacttcaaactcactaattacttaattagctgtctggtccattgtttgtccaatctattgataattttatttctagaaatttcattttagttcttcataactgcctacgaacctttaagtctatacttatatacatatatacctatgtatacatacctatatatatatgcctatatagctttaagtctataccttttaagatatcaaatttattttttaatgtctcagattattctatatttctagacttgattatttgctgattctacttcagactgattcattttctgatattgcaattttttttactatgagctgttgtgtttttattttgttttggcagttgttttgcatgaaaccatccctacaagaaatcatttctatagtacaatcagtggtctcttctgctgggaccccatatatggtagcagttacaggccaagttttgcattattttctctgtttgggattcctacacactattgtgagcatagtgtaaattcagagcctactctggtacagggcacagatgtggtcttgccaacccatagccctggacaaataaccagttttctttcagcttcctaaggctgtggagactttttagtactgtgtttgtgagctaagcagaatcctagctctgagatttgttcaaggagcttggctccaattccaaacccagcttcagcatccagtattgatttcccatgtcaacttttgatacttcctgagctctcttcactgagtttcttctttgtttataaaacttggtgatttatcttagttttagcctttcttggtattggaatttttaatatcatgctttttccagtgtttacataattttggcatggaacaaagaacctttgatgtcacatcagttcttcatatcacttttggtgtttccaaagatcatccttaggctttattcttctaatcaagaaagaacttttattttggtaacagctttatagagatatacttcacatgtcacacaattcacgcatttaaaatgaacaattcaatggcttttaatatatacatagcacagctcatctatcaacataaccaattttagaacgtttttattacccaaaaagaagccctattccccttacataccactcttcaatcatcctgttcccgtcccttcaccatccaaccctaggcgatcactaatttacttttcctctttatagatgcacccattctggatattccatataaatggactcataacaggtggtcctttgtgacttgtttgctttcacttagcatcatgctttcaaggtttatcaatggtgtaacatctatgagtaatttatttttattgccaaataatattccattgtatgggtatgccacattttatttgcctgttcattaattgatggatattcgacttgtttccactttttggctaatataaatgatgctgtcatgaatattcatatacaaatttttgtgtgtatgtgtggtttcaattctcttaggtacacagctaagagtagaaccggtggaatatatggtaactttacttaactgtttgagaaattgccagactgtttttcaaagtggctatagcatcttccattcctgccagcaacgtaggacatttccaatttttccacatccttgccaaaactcgttatctgtcttttttataacagccatcctggtgggtgtgaagtggtatctaattatggttttgattttcagttccctggtgactaatggtgttgagcatcttttcaggtccttattggccatttctatacttttctttggagaaatgtctgttcaaatcctttatccatttttaattgggttgtcttttattgagttgtaatagttctttatattttagctacaactgccttatcagatatgtaatttgcaaatatcttctcttattctgtgagttgttctttcactttcttggtggtttcctttgaagtatgaaagtttttaatttcaatgtcccatttatctattttttccttttatttcttatgctttttggtggcatgtctaagaaaccattgcttaatccaacatcacaaagatttatactttttttcctaagagctttatggctccagatcttacattcaagtcttgaatatactttgactcaatttttttttttttttttttttttttttttgagacggagtcttgctctgtcacccaggttggagtgctgtggtgcaatctcggctcacagcaacctccgcctccccgattcaagcaattctcctgcctcagcctcctgagtagctgggattacaggtgcatgccaccatgcctggctaatttttgtatttttagtagagatggggtttcaccatgttggtcaggctggtctcaaactactgacctcatgatccacccacctcggcctcccaaagtgctgggattacaggtgtgagctaccgcgccctgccttgactcaatttttatatggtttgaacacagtggtaatttttaaagtggttatcacctgtaacagtcttctctaaactaaagatctgacaagaaaatgacatgatttggggcgtattatgcataattggtatcacagcaatattaggggatatgagacatcagccttcctgatacttcgatctctttaaaaagcatggaattataaaatcttagttcaaagtcattggtctcttacatatttccaggtgtgtgttttcctatggttaacagaactaaaaggagacattattgtggcaattttgatataaggaggtagtgctgtcccactaagaactaaacaggtcagcgagttctcaccaatctgagtcactagtatgaagggctctgaggaaataaaaaactcatttacataggctaatttcttacactgccccgatgcagccttgttccaaacattcgctgttgtgatttacaagaaaagaaaaaaagtagtaaattgggcactttcttacccaaaccactgtaggtttatttgacatttagttgtattgactggagacttttataaatttctggaaattgatgtcaatattttcaagtaatgaatcaccagcaaagaagaaaaagcagaggtgctttataacatggtaaatcccagtaagtaattcttgtctgcatttctttctatattgcagtatcaaaaaaatgagacattaaaggaggaagagagaaaacgatcctatcaaaacggtcagttggaacaaaaaataacaataatgccaacagagaaatgagaggagtgaaaaaagcagaggaaagccagagaagaacagaaatgagaggacagaggtgaaaggaggagacaagacaagaaacccaggaaaagatgttgtcatctacctgctttaaaaagtgtgcagtgtttgaaccagggccaaggtcttaagtgggattcaagcaaagtaataaatccataatgaatctaaaagtatttataaagtacctcaatattagtaacagcttacagcagaaaaaaatatatgatcaggacctaaggatactttctatcataaaatgttaatcagagaaaaaatgaagtgtgaaaataaaggtgtgaactctagcagagagcatggtaagacatagagcttggctggtaccctctgggcccccagctctcaggctggtgggtgagctgagtgctctcaggcacagggccaggcttagaccctgatggcagcaatccccatcctgcctgtgacctctccaagccagacccactgggccacagctgggcccccaccatgcccagagtaaacaacactactgtgtgaagggcatggaaggctgggaagaacacggcaaccccaacccaacaggggcatcaggagttgaaagagtgggccagtgtggactcgagctctagctgctcagcctcaggctaaggagctgtgcagatcacagatctgaggtgaccactgtgtccctagtgaacaagatgccactctgtactgtcccttaaggggcctagaaaatgagctgagactacaaaagttggttaatcaacaccagaccttgatgttggaagagagaaatggtagaacactgtgccacacttggccaacaggatgtgtctgccatcctttgggaagattaagtagacattaatagaagaccagtgtatatacacataactcagagatagtgcacgttttgttctagactaccacaataaagtgagacacatgaaatttttggtttcccagtatgcatacaagttacgtttacactgtattatattagtctgtgatagcattatatcagaaaaacaatgtgcatacctgaatttaaaaatactttattgctaaaaatgctttcagcatgagcttcagcaagtcactttctgctggtggaggttcttgcctccatgttgatggaagctgaatcatctgggtggtagttgctgaaggttggggtggctatggcaatttattaaaataagacaacaaagtttgctgcattgattgactcttcctttcacataagatttctctgtagtatgcaatgctatttgatagcattttacctacagaaaaacttttcaaaattggaattcaatcctctcaaatcttgccactgctttatcaactaagtttgtaggaaattataagtctttgttgacatctcaacaatgttcatagcatcttcatgggaaatagattccatgtcaataaaccattttctttgctcatccataagaagcagctcctcatctgttcaagtttgataattatattgcaacaatccagtcacatcttcagactccacttctaattctagttctcttgctatttctaccacatctgcagttacttcttcccctgaaatcttgaacccctcaaagacatttataagagatgaaatcaatttcttttaagactattttgccctcctcccatgatatattgacttatttccatgaatcatgattgttcttaatggcatctagaattatgaattttttctagaatgttttcaatgtacttttcccagatccatcagagaagtcactatgtatgggagctatagccttatgaaatatacttttgtaataatcagatttgaaagtcaaaatcactccttgatccatgggttgcagaatggatactgtgttagcagatacaaaaacagcattaatcactttgtacacttccatcagagctcttgagtgaccaggtacattgtcaatgagcagtcatactttgaaagaaacctttttttctgggcagtaggtttcaatagtgggcttaaagtgtttagtaaacaacactgtaagcagatgtgctgtcatctggctttgttattccatttatagagcacaggcagaggagatttagcataattcttaagggccctatgattttcagaatggtcaatgagcatacgctttcacttaaagtcacaagccgcattagcccctaacaagaagatcagcttgtcctttgaagctctgaagccaggtattgacttttcctcatagattaaaaaaaaaaaaaaaaaaaaaaaaaaaagtcctagatggaatcttcttctacattgaaaatctaatgtttagtgtatccaccttgatcaatgctcctggctaggtcttctggaaaacttgctgaagtttgtacatcagcacttgctgcttcaccttgtgcttttctgttatgtagatgacttctttacttaaacctcacgaagtaacttctgctagttattttcttcggcagcttcctcacctcgatcagccctcaagaaactggagggaattagggtctttctctttattaggctttggcttaagggaacattgtggctcgtttgatcttctatgcagaccactcagacttcctccatatcagcagtaagcatggttcgcttgcttatcatttgcctgttccttggagtagcacttttaattttcaagaattttccctttgcatctacagcttggctctctgtttggcgcaagaggcctacctttcagcctacatcagctttccatgtgccttcctcattaagcttcatcttttctggttttttatttaaagtgagagatatatgattcttcctttcacttgaacatttagaggtcattgtagggttattaattggccaaattccaatattattgtggctcagggactaggaaagcctgaaaaaagggaaagcaatgggggaacagcaggttgctgaagcagtcagaacacacacaaaatttctcaaccagagatagggttcgtagtgcccccaaacaattacaacagtaacatcaaagactcctgaaaacagatcactgtaacagattttacagtaaagaagtttgaagtattgtgagaattaacaaaatgtgaaatcaaaacactgagtgagcacatgccattagaaaattggcactgatagacttgcttgatgtagggttgccacagctcttcaatttgtaaaaaatgcaaaaactgcaaagtacaataaaacaaggcatgcctgtagcatatgaaagagctgcactcaagtttccccccattttttgagaggaaaacttattttgctatatcttggccttctgtatgtaaagaagttctaaggtatgttagaaaatcccacatcttgtaaatgtcttatttaaaaagaggaagaaagaagaaatcataggaaagaaatgtcttctgaaaatgacttttggatatggaattgtgagaccatctctagaagtgacaccaagagacacacaagtccatgttcactcactgggttttagaggagatggaaaagtccacaaaaatgaatagaatcgttctctataagcctatgccaagctggtcacattttgaagatattttcttattatactcattgttctgtgtatgcattttattcctaataagtgtacaaatagttaacaatgttaagtacttttctgaaatactgagtctttatagacgttccggagtgccttatacatgtttaaggtagtaataaaagagcacattttatgaataaccttgataaaattcatacgacatttgtcttttggaaatgaaataatcaaatcacctttctgagcagtatacattgtatgtgtgcactggttcagggaacaaggcagaagaaagaagaggaaaaggctccatgccagtcattttatagtaagccaagattagccatcttatcctgaatgttctgtgcattttattttactttgttctctatgtggtatacataatgaacaaatgagtcaattttacaacatcttgtctttctagttgttaaagagcctgccaatatatgaccaaagtagagtttgtaaactattttgtacattttgcgttatatggtaaagactgtcttctgaaaacaacttgagaatatgaaattaaatccatctctaagaattatagatacttgtacacatagtaaatactagaactgttaaattaaaagcaaagtgttcagtaaaagagacaactttgtggttgatcataaactaaaatacttttaatatatatgattcataagatgtcttacgtttgccggttctaaacatcctttatattttatcatttgcatgaagaatgtgcagatattgccagcccacacccagggaccctcacagagtaaacttgtgtatgtctataagtgatctgggtgtttggcttgtgtcttggcatgaaagctactcctgctcttgatctttgcatgtgcataggatggaaggaagggaagggactctgctgttctcaggagaacttcaactctatgtctttatttttgaggatgagcaaactcttcaaagggctgttctgccctatctcttattttctgctttcctaacctttccccatttcctcttcattctgaagtgctaagaacgtttgagaagctggaggacacatgcttagaaccatagggaaaaagccattcacattccattgtgtcatcagcccagacctctttgtcttacccagaggccacttcccaccaccaaaaggaatattaggagtattaattctttccgctactaagacgttgtttagggtaccctaaatagcagtcatcgaaataaatgaagcctctattttaaagttaaagggacactagcactttaagctgtttggtacagtgtttttaaagtatggaaaataacactcaccttcttttgagaccatgttaacatttttgaaactgtgcattattcttttcagtagataatacatttaaggtcagaactatgctagaatatccagattccctgcagttggtgttctgccactgaaacctcaaaaccagatactctcagcagtgtactgcatatattacacaggtgcatcaaagatttatcactcctcttggtccacctccgggcagcatttcatcatcgaagaaaataaactcatttgagccgctctttaatttttaaaatgaaaatctatatccatcaggcatatgtcatagtttcagagtaagaaaaagaagataacttttgtgaaatgtctttttttcctataaacacaattacaaagcactcaacttataaataacatttattttatattaataaaaagaatttagcaaattcccagtattatgctaggtgttcatactctctactccagtttaaaacacacacctgcgcatacatacacacacatacagttttaaagatgcatttttcctcttctggaatgtgttactattgcttcacctttgataactttcattggggagcacttttcaacttaacttgtgtctgcacagtacattcaatgtggctttctgatgaaattgacaggtcaattcaaaaacaaccatattcattgcaatttttttctattccgaacatgaccaaatccaccaagcatattagtttcccttaaaactaaagaactttttaaaatttaggcttgagagaagcgaaacttattttaataactgaaggaaaaaacggttgatgcttataaactgtgtatcagattttggcctacgtgttccatatctatattatctaatttaactctcacacacccttaagatagtaggtactaatattaattcctgcctgtgtaacctaccattcagagagtaaaataacttccctaaagttacctgaacccaggaaatctagctccaaaatcaaatgaccaatccctatcctatacaacctctcaagaatgagcacatgtagaggagaataagcagaaaatatcattagttcaaattaactggatgtaattgagggtgaataagccaaaaatgtgaatctctaagtacctggctttaccttttctagagttttctttgtcttgagccatattctatgttcaggctctcaacatggcaacctattgggctgagacagatagaaaatgcatccatgatctcaaaaagtaattggcctcacctatcccgaatgcataaaaagtctgctaattatgacagaattatgtggacattcaattgttttttaaattttatattctaagtcaatattttgtaaatattttagaattagtaagtagtgttattcttaatgggttacccctgccatgaatattaggaaaaatatatataaatgtaaaatttgcctgcatacatttttgtttctgaagaagtgttagtcactttcattctttaaatatcatttgtgttgtcaaattcccatgttttttagctttgccctctttcctgagtttcttctctaactgcctgatggaattcttcacctggatacccatcatgctttcagaatcaacattcctgcagcctctaaatcattttggattaaatgcattctcaatgattataaaggaggtgcatgactggggtaaaataaaactttttaaataataaattttctgacacaagttcagatgtgacttatataagtcattgaatcctaatttcagtcatcaaatatggaattcatccagtctactagcttcattttacaaacgaagaggctcagatcctgacagaaactgtgacttgttccagatcatcatgaatttgtacctggactgcaactagaatctttaatcctgatttttttaaataataatgatggctgttatttttccactgggcataccatgactcagatgccatactgacattttactttcattatctcatttaatcctcaacacgaccctgtaagtaagcatttttattcccatattacaattgaggaaagggaagctatgggaggtgaacctattcattaaggttcacaaagctagaagagtcagaatcccaaaccatgtctgtctcactccaaattcccttgcttcagtaagcttctctaggccaatgttccttctgcattgcccattttcttcctatgaatgcaaattacataaacatggaagtacatttgaccattttaattgtttaacagtccatgttgcaggaccttccacaatagaatcaatgtattaaaatgtgtaaatgaccacactttttacacaaatgctatgaatccttaaggttttccaatttataaaatatgtctgcaaagcatactttatgatgctttgtattctgtcagtaattggatgtcatatatttaaattctattaaactgcttattaaaatgtccagtgcctcttttcttgcatggccacaaatattgtcactataaatcagcacctttcaaagttagtttcatgacaactcaagatacttcaaactaatttagaaagtctcaaaataattcaaaaataattcatttagttaacatattttgtaaatatacatattctatatattaacttgaatgtggaataagtcaaggaagagatatcaaatgtctttaaaaggtattacaactgtaagtaatcaaagaaggaaaaaaaaaaacaaacagaataaactgttaaagggccagaatactaggaagaacttaaataggtagtaagcaatacatacttcctcacctatataatatcaaagagtttgggatacccacagaagggactgtgaaaacctcttagaccatcctccgcattggtgtctccttaaatcaatgggataaatactgaaaatcttgtccaatagcaatccaatttaagaagtcaccataggtatgaatagcaaacaattatatgttccccatcatggctaaatgtatcttgtgagccatctacaaaatcaattattcagcaattcagttcatttcattgagacaatattaataaaaggatcaaaagaactatcgtctaattatgtcatacacaataaatcaccaactatttatcaaaaactgttctttccattctacctctgtggttattgccttaggtcagacaccatcacttctcacctgaattaatgtattaagtttttaatgggtctccctatctccaatctcaccaatcccagattaccctttaatgatttcacattaccttgaaaataactaggcacttatttttgtgctctggtacaaaaatgcctttgtctgttgccacacaggccattatctcatggaaaacctgttttccagctgtgtcgaattcagtagtattcatagacccaacacaatctcttcttgtctttaatgtgacgtttatcctgaaaagagtgcttttctctcacactccctgtatatctggttggcttatccttgaatatcctactcaaactttaccttccccaagcacagctttccatgatctcctcaatgctgagctgcccttctctgtgctccttttgcaacagctgccaagccatttcttacatggcatttactgtctcctctcccagaacaatttcttgaggctagaaaccatgtcttaattatcttgtggcctagtatctgaatgtctgcaatatggaaaaaacgctccattggtgtttgttgaaaggatgaataaataaacatttcctaaaattgcctgatactaagaatcgctcaggtgctaattaaaaattcagatccccaagctaagatttatattgaccagtatgaattgaggcagaagattctgtacatttatcaagtatcccaaatgattttcataatgaggaaactgagagaatttaatcataacggataggaaaatctgtctttgcatgaaatttctctgtcctctgtctacgggttacttgtttttgaggtatccatgaggatactcctccccctttatctgatacctaactgtgctgtgcaagaaaaacaaaacagtttttcgtcatataagggcatgaggctaatctatccttagctcagaatataaactcagcaagggacttagatatgatttcaacattgtttgtattctttcagctagcgttttcaatgtggcctaaaaatgtcatgactcagagtacttattcgtagaattgcttcaaaattttatctaaaccactaaaatttcacacctggcattgaaactacctagtttgcctgcaagaactccacttacttgggaaatatacagtacttgctgagactaacttactgtgtaatgctttatcctataactctaggaatacaaactctttaaaaaaaaaaaaggctgttccatgttgcctctattcagcataccttactcctaatttcctgcaatattcttttcacctctactactcagggcaaactttttttctcaaagtcacaaagaagctctgaattaccaaatctaacaaatttttttcccatacccattggcttctaactaacagtatgagacaagcctttcttcaatgcccattccttgttggattcctggccttcctctttctctctctgcaactttttggtctccttcataaacgtattcttttgttttgcctgcttctaaatatgtttgttctattttggaatctaaacttgttggcctagcagtaaagttcttcaaagtttgccaatctgtttggatcttatcacactaaacacctctccatgtatcctacggtttgagctggcactcgtcagatgtggttttaaaatgtatactaattaaaattaaatagaataaaaaattcaactcctcagtcacactatccacatgtcaagtgttcaacagccactagtggctaccatattggacagaacgttcatacaacattgccttcatggacataagttctattggacagtgctagtctagacaactggactactcaaatttctcatctctacactttagctcattctattctctgtctacctgaaatgcggtccaccaaccatatctcttcctattcagatatgacttgttcttcaagatttattcttaatatttacctgtctccaaagtctttacttatcactctagctgaaagtatggcagcccacctatgaactctcaaagttgtttatactactgctcttccccatgttgttttgttctgtcattattggtgcaaatgcctgctttccttgatcagagatataatctttgaagagttgattgatagttgccaactgtcattgagcactttgaacatgagaagttaagtgcttgatcatacttctcacatcctcataactcccctgtgaaatatatgatgttttttcatattcacgttaaagaaactgggatttacaatgatgaaacattggacaaattaaggtctcaggacaggaggtcacggagtgatgagccctgaattactctaggtgggtttaactccaaagcccatgcccttacccaggggaacacactgcttcttgagatctcattcaccatgttaatgaccaccccacagccccaccacctaacgctaggcatgctccatttgtgaatgagtgaatagatgactaatactttatatgcttatggtcatttacaattcacaaaacttgttgacagccatacttgatttccatatgatttccccaacatctctgaggcagctccataggaaatgttatctccatttcacagaggctgagagagttcagagtcctccagaagctcacattgctatttagtaacaggcatagacaggacttcagcctgtgtgttctgccttcaagttctgccagcctttcttcaaaaccttctgtgagtttaaaactcatcaacaatcagcaaaggcttaaagagttgttgtatcttaatatatcgtcgtcttcttcttttttttttttttttttgagacagagtcttgctctgtcgcacaggctggagtgcagtggcaccgtctcagctcactgcaacctccacttcccgggttcaagcgattctccagcctcagcctcccaaatagctgggattatgggcacccgccatcatgcctggctaatttatttgtgcttttagcagagatgggatagggtttcaccatgttggtcaggctgttcccgaactcctgacctcaaattatccacccattttggcctcccaaagtgctgggattacaggcatgagccactgcacccagccttgagatactgtcttctaaaacttgccctttttattgtttaaaaaacatgatgaggccgggcacggtggctcacgcctgtaatcccagcactttgggaggtggaggcaggtcgatcacctgaggtcaggagttcgagaccagcctgcccaatatggggaaaccccgtctctactaaaaatacaaaaattagccaggcacagtggcgggcccctgtaatctcagctactcgggaggctgaggcaggagaattgcttgaactcagaaggtggaggttgcagtgagccaagacggcgccattgcactccagcctgggccacagagtagtgagactctgtcttggggtggggtcgggggagggggcagggaggaagaaaaaaaaaaaacatgatgaggcttaatggtttatgtctaagggaggggaagaggcaatttattcaagttttcagtgcttttaaatagccacatatttcaatctttatcatattgtttttgccctaaccctattaggataacttgcttacattaagcaaaattctgagaatgttaattagcaatttagctatgaatatgcatgattatttttaagtccactaatattatgcataggtcttatctgtaattatatctaaatgttctcttttttctctccctctctctttctccttcaggaaagccatttaaaacacatttgggaaatgtttgaaaaaattaattctattacccttatttccagaattttcttaaatattttatggctatattttttccttctcaaggcaaagccgtacatcaccacatacattatcatatttgtttacaaaatatgagagtcaaggaattaattttacaccagttaaataacagaagaaaaagttatactgtattttcttctttattatactaattttttcacatccttaaatggttttatattttgtggctatctgaaattatatttaagggcgagtattatactaccatttgtttcacatccaacttggagcattgcatatttgtgtagacatataaggttagtcaggggtgagagataggaggattaaactcatctagtttgcgtgccctttctcagtcacaatgcagtctttacaaacaattttttcctttaacagaaaaactgaaaaggtgtctaaaaaaataatttgccttaagacaacctttctaggaaatggtgaagatctgtttcaaacccaggcctgcctcatgccaaagcctatgaccttttcactattaatgaccaaatggttgaatgactgttaaataagtctcttgggtaaaacataaacgtgcctgatacccattcattaaaatgtttattagatgaataaataaattggtggatggagctcaatataatcagctcatgtgcctccacaccaaaagagaacattttcaaatgaacatgcaggaggaatacatgattacaaaaatgcttcagcaatgatttcgcttttataggattacttgtcccaagttcaacagtcttaatgcacatgcaatttgcttgaagtctataatgcccttggatttcaagctgaggagtctgatcatctggaaactaaaaattaaggatctgaaatattgttaactaaatagattgaactaaaattagcctcttaggacttaaagtgcttccacataaagtccaagagctagaaatgagaatgatgttctctacaatcaaatattgccttaattccaaatttagcttctgccacttgatctaatgttacatcaaggcatatgggccctctgcatgtgaagagcttacaccaatttaaagcaaatgcatcacatgggcaagaatgcaaattccaatagtaataatgtttctttcactatttatttcattccttatttttcatacttgttgccactttgtgaacttgcctccaatcactttacactggcttattttaaaagccttttaactgttctccttactgtcacccttttttcctaattccactgttcctacaaatggttgctagaaaaatcttccccaaacacagcttttatcacaggctcaaaaacctatcacaattctctaatgcctggtctataagactcttaaagtctttcccccttctcaccagcctagtctttccctgaggcagattccctattaagaagaaacaatattttgctatgccctgtattttcttatctgtgccttttggcatgctagtgctagtgatcctaatgtagagctttcaaacatgctttgaaaattatctttgatatattttcatatggcctctgtattagtcagggtcccagaaaaaaaaatagaattcatcccagagtgttcaaataaagagattttaataaaggagttatttgcataaattgtagacagacttaaggagcaaacaagatggcagggcacccaaaggatagcaatggtgagaatataatactacccttagggataaacagtcaaggaaaaggagcagtgtttccttaggagccctgcatcagaagaggtacagaggagaacagggtgaagggagttatatcctgaaaggacatgatcacggccagcgcacaggaccgaagtaggacatgaagaagaaatatcctgacctctttctcttcctgccctccaatatcctgctagagccttccataggccccacccaagataaacacagagagcagagagtcccagtcatgcaaatgacaagggtcagcttcgcagagcacagggaagacatggaatagtgttgagtgcatgggggcatggcaaatggagaacaatttgcacagtctgagctactctgtagccttctggaggatggcaatttctgagatatcccacatttggagtaagagaacagccacagacctcactctatgtgtcactttgagcaactttgcttagttagaagctatttccttacctttaatataagagtaatactcagtttgtataatagtcctggacatccaatgaaaaactgtgtataaaatatcttgtcccataagtgctaaatgaattgtaactactgctgtgactgactaaataaaaattatatatgtataagtataaaacctcttacaaaacatgtaataataaaagaatgagtcataaaagacaagaatcaatgagtgttaatggtcacctttgttgctgacctctaaactccatcccctggccttaacaaatatggcaggacatcttcaggatttggcaggcagacaattttatcttacactagtgacttggatgccattcctcttccttccactcagtaacagacggtgccctggacagcagtgacatctgcagccccaagggagaagggtcagcacaaattttaattttgcttttggtttggggctttaagtacacaaacaggttttttttttccctgtcagtttgcatctagcttcgcatctgacattttttaatgttttatgtatttggattgacctagaaatttatagcttcaggtttttgcttattttgctctgtctctaattcaacctccttgatttaaaaataaaagccaaaatataacatgaacaaatactctatttgtctgtatcactaagggggtaaggaagaggtcattctgctctttttgagctacttcttattacaatatattaacatttgaatatcttcaataacaagaaacaagaatactagggataacctataaaaacctgagtataatttgactcatcgctaaaaaaaacttaaaagctaagaggagaacatttacaaaaattgttatgttcactgacaaggcattagatttcagactaattgctgctatgagaaaaatagatagatacacacatacataaagctttatttttagaaggtcaagtatctacaccaaatgtttcatcctccagagttcagtttcagggaaatctctacaataggagagcctcctgatgtttgttgtggccacatttggagccatcaaaatttcctactcaggcatcccacagagaaaaagcatctacccctaagaatgtgaaatagtatcctcattactgagttgattactcatcaaccttaatagtatttgtaattcgcctttaccctggggcagttttcaaaggtcacagggaaggctgaaggctgtgtctataagacagtttgatcaaaatagaactaaaggctggcctcaggtagctatttctgagttggtcagaggacaatgaaaactacagttcatgcccaaatgttctccttggtcaaggggagactggctagacagagtcagatcttaagggtcatttctgattggcctccatccagagtatgacaacaaaactcgagaagcttcgcagataaataatgatgtaactaatttaggtgtttagataaatcat

SEQ ID NO: 600 - DNA, 40001 bp, Homo sapiens
taattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaac

SEQ ID NO: 601 - DNA, 59621 bp, Homo sapiens
gcccatccatgtcctccagcccccaccacacacagtgcgtggttcactgttcctcacgcaccctacaccctgcctcacctcggggtctctgcacggctggtccctgtgcctggaaagtcctcccgcctgacacccaaatgcctccctcctcccttcctttcaggtgtttgcccaaatgtcgccctctcagtgaggcctttcttgaccaaccgtttaaaaatctaatctccttcactgctttatttttattttattttattttttgcttgttttttttgagatggggtcttgctctctcacccaggctggagtgcagtggtgcgacctcagctagctgcaacctccacctcccaggttcaagagattctcctgcctcagcctcccaagtagctgagaccacaggcaccggccaccaaacccagctaatttttgtatgtttagtagagatggggtttcaccatcttggccaggctggtctcgaacttctgacctcaagtgatccatctgccttggccacccaaagtgctgggattataggcgtgagccaccatgtttggctctttctcttttatttttggattcatcatcatgaatccaaaaatgtatttattttcttaatccccttattagaatttaagctccctaatggaaggaacgggtctcttctgtgcacttcattccagcacttagaagagttcttagcacaaaccagccttccccacattctccttcacacatatgtggtttaatgaagaattcacatatgtccatgaaagaagacaggagtgtgtcaagacttctgcatgcacgtaaaggaccagggttaagagcacagactgtggggccagaacacccggcccatttcccgtctccaccaattaccccactgtgtaactttggacacgttactgaagctttcagaccctcaaattcctcatctgtagaatggcgattatcacagtatccctactaggagttgtgggaattaaatgagattatgcatttaaaagagggcttagcactgtgcttggcgcacacaggcactcaaaacatgttagtgactaatactatttttatgaaaagagatcctgatacacactttaaggaaactaatttaattacataaaaatatagaaacatctattagcgacacattaaaattaaattttattcacatttcagagacagggtcttgccctgtcacctagcctgaagtgcagtggtacaattatagctcactgaaccctcaaccacttgggttcagtgatcctcccacctcagcctcctgagtagcaaggaccacaagtgtgtgccacttgcccagctaattttttaatgttttgtaaagacagggtctcactctgttgcccaggtgggtctcaatctcttgggctcaagtaatcctcccacttcatcctccctaattcctgggatcacagatgtgagccaccatgtccggcctcaacttggcttttagaataacttattgggtaataacctctgatttttagtaattactttattcaagtatgtgaaaaatctctcataattttgcttactgtctccctcaaattctcacctagaaaagtttaaaaggatataaaagtaatttgaagaagatttgaaattaccttaacacgaaatgaatgaaaaaataatcagtttacataaaccacgaaggaaataacttagcaagaaagaagagaaacctgcgatgacaggcaagtcactgcaagtttcggacggactactgtcttgaaaggaatttactttattaacccacaataaactcaactgaaataaagagttgcccttttgaaatgtggtttctctttctctagaagaaaaccaaaaaccatctctttcaggaggcctttcttcaccgacccacccctggacattcttctcatggggccttttccccacccatcaccattctttgtgccgctttgtgtttgctgcataaacacgcactctccctcctcagctcacaggagtcacggggcagggagagcattctgcgctacttctgtaatcctacctggctcaggctggcctctgaaatggcaactcatgtgtgtagagaagaacacagatatttatcatctaaaacctgggaaaagctggtattgcctccaaaagagagtgaaggcgggtctctctaaagatgtctgaattgatcatgaaggatttactcagcagttatttattcagcagcattaattttattattactgtattttttattgttttaagttccggggtacatgtgcaggctgtgcaggtttgttacataggtaaacatgggccatggtggttgacttcacctaccaaaccatcacctaggtattaagcccggcatgcattagctatttttcctgaagcagcattaattttcaatagccacataaaatcattcacatcagagttaacatcaagctttaaaccaaggcctgaaaagaaaagtgccacagtttctaaaccattcagctgggcaacaagaattttaatttttaaaaaaattaaacgttagcctggtgtggtggttcatgcctgtcatctcggtactgtgggaggcctaggtgggaggatcacttaagcccaggagttcaagaccagcctgggcaacaaagtgagacccccccatctctacaaaaatatataaaaatcagctgggcatgctgacacacatctgtgataccaggtacatgggacgctgagacaggaggatttcttgagtccaggaattcaaggctgcagtgatctatggtggagtcagtgcactccggcctggacgacagagtgaaaatgtctcaaaaaaacaaacaaacagaaaacaaacaaacaaaaaaacaaattagactttattattaaaaataaaactcaggccaggcgcggtggctcactcctgtaatcccagcactttgggaggccgaggcgggtggatcacctgaggtcgggagttggagaccagcctgaccaacatggagaaaccctatctctattaaaaatgcaaaattagccaggtgtggtggttcatgcctgtaatcccagctactcgggaggctgaggcaggagaattgcttgaaccagggaaggggaggttgtggtgagccacgattgcgtcaattgcactccagcctgggcaacaagagtgaaactccatctcataaataaataaataaataaattaataaatcaaacaaacaaaactcatggccatactaatagtattgagattaataatgtgttggttaacagcatcactggctggtctgaatcccacctctgccactttccagctgtttaacattggacaaattatttaacttttctgtggaagattccttgtctataaaatagggataagcctcaaagttactgtgaggattaaatgaatttatagatgaaattactaaaactgagcctggaacccgacatatacttaacagtgtgagctgctatcattgacattataataattactactacaaataattttcatcactatctcatcttatttcagtatatttccaaagaagcaaaggtagtttagatttggtttgttataatctcttataatctggtctcatataatatatttccacattttgacaagtaaaatggaacagctctttgggaggccaaggtgggtggatcacctgaggtcagaagttcgagaccggcctggccaacatggtgaaaccctgtctctactaaaaatacaaaaaattagttgggcgtggtggtgggtgcctgtaaatcccagctactcaggaggctgaggcagcagaatcgcttgaacccaggaggcggaggttgcagtgatccgagattgcaccattgcactccagcctgatcaacagagcgagactccgtctcaaaaaaaaaaaaggaaaagaaaaaggaaaaagaacagctgtgttgggtttaattacaattccttctcacattcattttaaagcttcaagaaaatggctgtttcaatactgggtctggttttctacttaagtgttctgaaaggatttattgaaaacgccaaattggctggaacatttctgccgcttacctttcagcagagtaactgtgagtcagtatggtggatatccatttggtttcaatttgctaatacacacagacacttcattgtacaatcaatggcaacaggatcacggggatctaaaagcacattgtttctgctccttgatttttctgttctacttttaactctgtggcgattaagaaacacctctcaatttactgagagcatccaaaaaaattagttgctattaatttttctgtaaaacataatacagtagaatcaaattagtcttcttagtcggctcaggctgccataatagtaataataccagatggggtggcttaaacaacagaaatttgttttctcacagttctgaaggctggaatgtccaagatagaggtgccagctgatctgcttcccagcaagggccctcttcctggcatccagatggccacattctcattctacctcacatactgaggacagttccagtgtctcttcctcttttcttttttgaaagagagtttcgctcttgctacccaggctggggtgcaatggtgctatctcggctcactgcaacctccgcctcctgggatcaaggaattctcctgcctcaccctccccaatagctgggattacagtcacctgccaccacccttggctaattttttttttgtatttttagtagagaaggggtttccccacattcccacattggccaggctggtctcaaactcctgacctcaggtgatccacctgcctcagcctcccaaagtgctgggattacaagcgtgagccaccatgccaagcccatctcttcatctttttctaagggcaccacccctactggattaggatcccactcttatgaccccgtttaaccttcatcacctcctcaccagccctgtctccaaacacaatcacattgcaggttggggcttcaacatattaatgtagagggacccaagtattcagaccataaaagtcttctaaccagtcaaatacaaaactcaaattcaaatccagaatgtttccagttacattaactttgtttccattcagatacagaaaaccacccagtaaaacgtaattagtttttaactcagactgaaaaatctggatgcataactcagttatcaagctcatcgacacaggatgataaaagctcaaaagcatgccctgtcttttcactaagactaaacagatccacttttctctaagacacattatgcaacacagagtaaaaggacttaacaactacttccccgctgggtgggactgatcgcctacataaaaggattctatctttttcaatgtatcctgggtactggcctcatttcttaaaagtatgtgcgcttagattttctgggattcaagccccacgaaattcagagaatcataccagtaacagcagttactcagaaaattaggtgagctccaaattgtccctagaaaggtaagggctgtaaaagctgacagggtcttagattctcagacacttacactttcaagatgtgaagatgaagcccagggagagtaaaagacttgctcaggcagcgtattggggccagagtggaactaaaacacagggctcctaactgcaggccaggggccacactccagtgccaccaagctacaggtgttcctcacagaggaggaagggagcttcccattctctgcaagcaccatgagccttattggacaactacagtaaggaccagagctttttcttcaccaccaagggacagggttttgctctgctgcccaggttggagtacagtggcatgatcatagctcactgcagctttgaacttctgggctcaagtgatcttcctgcctcagcctcctgaatagctgaggagcccctacaagggcacaccatcatgctctcatgcccagctgttttttttttttgttgttgttgttttttttttttttttttttagagatagtgtcttgctatgttgcccaggctggtcctgaactcctggcccactttggcttcctaaagcactgggatttcaggcataaaccaccacacccagccaggactagagctttcatctcactcatgccttgactccccaggtgtggcaatatcccaaataagaatcactctttctcccaatggcttttggcctctgtttttctcccagatgatgaacactccaagctaatgaattcctgtttccacccagatcctctggggatggagccatgtgctgcaaacccctcttcctccactcacgcctctgtggtcatgtctccttgaccttgacactaggcctgaatctaaataaacagcccgtaaaacatttctaagcattacaggctttcacacttgaggcttcatggtagggttgaaaaatgaaacctacaaatactaaattgtagagaggtacagagatcttctgggatttgctcgctttcattagtttccataaaacattctcacgtgtgtggacacataactatttgtataagggaacttactactaaattgatttgacatgactttaatttgcccaaggctgtaccggcagaagtaaggtgggttctttgcaagatgttctcagtcaattggaatggctagcaggcttttcatccccgtgacacagggatgacttttccatttctttgtaacacagatctgtacgtccgccaaatttagtatgatacttaatagctattcttgaggcgctcacatttcattggcctaacatgactttaaaattacaaattgtaagatacaagccaacataaataaaagttcacattagaaaaatttaactttttagtcaccctcatatccctcctaaatctatcatacatctttcagtaaaattaaaaaaaaaattaatctcttcacatgtattgagggcacactagggacctaccgtacaacacttcagcattgttaagcacttaaccatttgaaaaaacttaatgaaatgattcaaatttacatcagccacccaattgtatatttatgtacacatccttctgaatagcttataagatggtttatacacctatacctctctcctcaactagcctttgccttgctcaaagataagggatatatgttgtcatcttctttttctacctcctgtgctcaggatgctgatccacaaaaggctaactgctttagtgacagaaggcattagacctataatcatgactgtccaattttacattcaattaactcataaactattgaactattttattcttaccagaactggacacacgcctgatcctctgaggagatacggctcgatcagcactgggatttctattgtcactgttccgcctcaaacaggaaacagggggccccactttggcttttggagcagctatttgcctcaaaccgcaggagtcaggcttggatatattcctacctgaggtggtcgttgtttttgaagcagagccctgtgaaaataacagttaagactgtaaaccaaaactaaaattctaagccccccaactgactgaatgggcccctcctctaggccaaggcaattccaaagaaacctaaaaaacaagttcaggccatgatggcaaagaggtcagacatgcctcattatactctcctccctttagaattcaggcacaactgaccagaattaacattaaaacagaaaccttaagtcagacaaaacagactctttatagcaaaaagacactaaattccaacctgactctagtttagcatcacatgacagacagcaagccctgaaggaaattgaagtattttaccccaaaatatttttctttaacacattttgaaatggccctgcaaagctgtctcttgtaggggcaaatttacattctgtagagaatcttcttcccttcccagatctttggtcccaaagaaattagctgagagtctagcaccttttaaaagtctaaataggtaatatttgccatctattacctctaaaggcggccacgtatgagatttcatctacataataagaaccttggtctccacagccccttatcttatcttaaccgagacactcctttctattgatttcaggtctttagataataacttctttagttttttgacacggagtctcctctatcgcccaggctggagtgtagtggcatgatcccagctcagtgcaacctctgcctcccgggttcaagtgattctcctgcctcagcctcctgagtagctgggattacgggtgcacaccaccatcaatctttttacttttagtagagatggctaatttttatatttttgtagctaagttttgtattttttttttggcattttatttttagtggagatggggtttcaccatgttttcttttttttttttttttttttgattttttgtatttttagtagagatgaggtttcgccatgttggtcaggctggtctcaaactccacacttcgtgatctgccgcctcggcctcccaaagggctgggattacaggcgtgagccaataacttaattctttcaacgaactgccaagcagtaaatctttgaatccacctatgatctgtaagtccctacttcaagatgtctcatcttcccagaccaaactaacgtgtatctcaaatgtattgactgatgtcctctgtctccctaaaatggatgaaatcaagctgtaacccaaacacctaggcacatgttctgaggacctcttgaggatgtgtcatcagccatggtcctcatatttgggtcagaataagtctcttcaaatgatttagagtttggcttttttcattaacaaaattttaatccagatcataccttccccataccacttccttgtggtattagctacgtgaaaggaacaatttctaagtgaacgtgtacagttgtccctcggtatcaaaaatgattagttccaggaccctggcagatatcaaaatccatggacactcaaatctcttatatgaaatggtgtagggtttgcatataacctatgtacatcctcccatatactgtaaatcatctccacgatcattacttacaacatctacctattacttgtttcaggtggattcaacatagtattcagcatgtagtaagttcaagttttgctttttgaaacactgcagattttttttctgaatattttcagtccaagtttggctcaatccacagatgtggagcccatagatacagagggctgactgtattcaattttcatttttactatgaaacaattaaaactcttcacagcttactctttaattcaccatattctgcctttgtacccattagtgagagtgtactcaagatcaccagtgtcacaagttaaattcaagctagttttcaatccttcccctgggggctctctctacacatcgaacgttaataactccattctctggtttcctgacaaagctctttcctggttttccttctacctgtccggttattccttttctgggtcctattcttctgtacctttggaagctagtgatataatttggatctgtgtccccacccaaatctcacatcgaattgtaatccccagtgctggaggagggacctggtgggaggtaactggatcatagaagcagacttcccccttgctgttcttatgacagtgagttcttacaagatctggttgtttaaaagggtgtgtcacctgccccctcactctcttcctcctcctccagtcatacaagacattgcagccttgcttcctgtacagcctgtggaactgtgagtcaattaaacctcttttctttataaattacccagtctcaggtagttctttatatagcaatgtgagaacagactgatacagctagtcttcatgaagacctagccttggccctgttctctttcctcaccatgtactcttcctacatgatcttggctgctgtttcaattgccacgtgtacactggtacatccaaatccacatgttcaaccagtactctctcctgagtttcccatatacctaacttctttctatacatcccaactcagcatccttcaagcacctctacgtattagtccattttcacaacgctgataaagtcacacctgagactgggtaatttataaagaaaaagcagtttaatgggctcagagttccacgtggctagggaggcttcacaatcatggcagaaggtgaaaggttcatcttacaaggcagcagacaagagagaataaaagccaagggaaagcagtttccccttataaaaccatcagatctcatgagacttactcactaccacaagaacagtatgggggaaaccacccccatgatgcaattatctcccaccaggtccctcccacaatatgtgggaattacaggagctacaattcaagatgagatttgggtggggacacagccaaaccatatgactctacttaacttactaacatatagcccgtatagaatactattctaaattctaagtatatgtatcaattcacttaaccctcataataatcctgtgaagttggtaggtttattgtaccccattttaaagaacaagaacatgaagcattttctaaaattaatcttactttcctatctatctcaaaacttatctcttcctgtattcaccacaacatacccaggcacccaacttcaacaatgaaagctgtttctcttttccatctgctgtcatttctcagcaagattactgaaacgatgtccacaggatctttctggtctctccagctttcaattcatcttttatctgcctgctagggcaatctctctcaaactcgaatagggttagacaccttctgtctgtcttccagataacatcttcttcacaaggcccagcaatccttttgcatatggaagcccctgccatcctcttcaccttattccctactgctcagggttccattctcccagctcccaccacacctacctagagtcccctaaattagaaaatcttctcatatttcttcagctttgtactctacccagaatacctgcccttcaaattccagctagtgacaacatgtgatgtcccctataagccttccttgacaactctgcccaccaccacatcttgttccccctcctgcagcacagcagtctactcacactcccaacttagcaatcaacatacccttgcctgtttactgtattgatagaggcaggaggcagagaaattctaggcagacgggggcaggtccccagcaaaaccccaccttcaaggcaaaaaccctgaaacccacagcctaaagtgagaacttctaaacctgtttgcccactctctcctaattagttctttctgaataatgtctttttaccaattgaaagttgccttttccaaaactacctatggcctgccttgccccccacatcccattcatgtaaagaccccagactcacttggtaggggagacaagcggcttgactgatgtattagtccatttttacgctgcttataaagacgtacatgagactgggcaacttacaaaagaaagaggtttaattggacttaagagttccacgtggctggggaagcctcacaatcatggcagagggcaaggaggagcaagacatgtcttacatggatggcagcaggcaaagagagctcatgcaagaaaactctcccttataataaccatcagatcttgtgagacttaatcactattatgagaacagcatggcaaagacctgcccccccattattcaattccctcccactgggtccttcccacaacatgtgggaactcaatacaagatttgggtggggacacagccaaatcatatcaactggagacttcagaggacagctgagtctactgtcatatcaccctgaacacacccaatctcgcctgatctttgaagctaagcagggtcaggcctggttagtacttggatggcagacagacagctggactttggaggagagatggcttagctttggagaagagccaagtgtagatggccagactttagggaagattatctgcccgtcctgtcccgtcttcagctaccctctctgctgagagccactttcattgctaaataaaattatctgcctccaccatccttcaggtgtccatgtgacccaattcttcttggacagtggacaagagcttgggacccaccaactttgggtacccaaaaaaggttatcacactgaccctttgccctcgctactggagggcagctgccccacacagtgaggcaaagggcccactgagctgatgacacaccggtgtccatggatggtggagccaagagagcactgtagcatgccctctggggctttagggtcacagacaccaccacctgggcaccactgtggggcctgcacacagcatgctcctgccggtgctcaaagtggctggctggatcctgtactcacttgcccacacactcctgcccgcaagaggttgagcatggcgggctgaatggggcacccccatcgcaagttttacaaatgggttgagaaaaactcctgcaacagtattacccactgcactaggcactcagacagggtctcttttttccctacatcctaacaatcatcaccatatgtataatacatagtatgcacccaataaatgtttctattctacatagaggaaatgggagtctgagccttactcacagtgtgaattccaacaccaaactacaatttgcaattctccctttacattaatgtaaagcaaaaataaaattctaagccccccaaccatctgaagggaccacttctctcggccaagggcattccaaggttaacctgaaaaactagttcaggatatgaaaggaagggggagtcagacataattatactctccgaagggttggaattcaggcacagctgaccagcattaacatcaacaaagaccttaagactgatagaacagactcttttaagtctgataagcaacatttacaatcaactccccctgaagccggctacctgaaggtttcatctgtatgataaaaccttggtttccacagctccttatcttaacccagacattcctttttgttgattccaggtctttaactctttgaaccaactgccaattagaaaatctttaggctgggggtggtggctcaaacctgtaatcccagcactttgagaagccgaggtgggcagatcacatgaggccaggagttcgagaccggcctggccaacatgaggaaagccagtctctactaaaaatacaaaaaaattagctgggtgtggtggtcctcacctgtaatcccagctactcaaaaggctgaggcaagagaatcacttgaacccgggaggcagaggctgcagtgagccgagagatcacaccactgcacccccagcctgggcaacagagaatctgtctcaaaaaaaaaaaaaaaaaaagaaagaaaaagaaagaaaatctttaaatctgcctgtgacctggaagctgcctccacttccagttgtctctcctttctagacagaaccactgtataccttacatgtactgattgacgtcttatgtctccctaaaatgtgtaaaagcaagctgtacctcgatcaccttaggcccatcttctcaggatctcctaagggctgtgtcatgggccactggtcactcatgtttggctcagaataaatctcttcaaatatattacagagtttgaccctttttttgacacaaagaacaactgagctcaatagagacttagtaacctgccagaggtcactttgcccagtaaatggtggagctacaatttgaaactactctaaaatccgtgcttgtaaagcagcatgttccctgtcatcactcttctttctttaataaatctcaagtgttaatttccgatagatacacataaagcccaatgccgatggcagtcgaattcatacattaggtgaattcaacaataacttagcaggccaatcacccatgagaacagctggaggtcatgttttggcactggagaacaatacagaattggccaagaaaagcaagtgactgtacacaaactaacaaagatcttctgtctctggctaggttaaattaaagctggctaaattcatctcccagagaaaaatcttcttttaaaaagcaacccaaaagttaacctcccagagaaaaccttcttttaaaaagtaaggcaaactgctcatcaatttacaaaagtgaatcttcagcaaatcacttgttttgcctttcagagccaacattccaaaaattttgaaaccgtatggtgtatggagcagaaaaggccaggattcaagtgagggctctgagtgtgaatcccaattttactatttaccagctgtgtgagttttaagtgacctcgctgaagtattaaaatgtcgacaacaattgccctgttgttattgggaagagtaaataacaatgtatggaaagcacctgagcgttacagggcccattaaatggcataatataactaaggcacctgagcaaagtgcctgacccagagcaagcactgaataaatatcaattcctttccttttaggttaagtctccactccctttatctcacacactatcatgaacacataacctctgttgtgaggagctacatctagccccgtttcaaataaaaatcaagttccttcttccaaataagaacttttctaaagattcagatacaccctgaccaccaatgagctgtgaggttgcaggcagtctagggattcagtaaactcaaggcctaaggcaggccaaggccaacaaagcaacagtaaaaattaacatccgaccgggcgcgatggctcacgcctgtaatcccagcactttgggaggccaatgtgggcggatcacttgaggtcaggagttcgagaccagcctggccaacgtggtgaaaccccatctctaataaaaatacaaaaaattagccaggcatgtgcacctgtagtcccagctacttgggagaaatgcgtgaacctgggaggcagaggttgcagtgagccgagatcgcgccactgcactccatcctgggtgagagaggagactccatctcaaagaaaaagaaaattaacatccctccagcatggtctcttcgtcaatccagggcagtaagagcctttgagtgctgctgaagtgaccaaccgacattcatgtttcaggaaaacacgcagcaaattcattcagctctctacagtaagtgcaaagccagtggcctatgagggtctgcccagacactttccagtcctccttcccagagacatggaaatgtgcaagaggtaaactagcaaaattagagagcactgtgcttcagacatgatcgtgaaaaaagagtaggccgggggcagtggctcacgcctgtattcccagcactttgggaggccgaggcaggtggatcatgaggtcaagagatcaagaccatcctggacaatatggtgaaacctcgtctctactaaaaatacaaaaattagctggatgtggtggtgcacgcctgtagtcccagctacctgggaggctgaggcaggagaattgcttgaacctgggaggcggaggttgcagtgagccgagatcttgccactgcactccagcctggcgaaagagcaagaacaagactctgccttaaaaaaaaaaaaaaaaaaaaaaaagaaagcaaaaaagaaaaaagagtcccttatgccagttgataagcatatgcgaatatgggacaatctttcaagacttacaaagtatttcatatctaattatgaatcctaacagccagattcctgaggcgaaaagtgctgtttctccaagacatactaggatccatttcaacctgatgattctatccttacctcagtaccacatcgggagcctgaaaaacaggttttcaagctgcacaggggcaacataaccctaagactcaatgcacaaatcaggaaaacttttagtttcaaaattacacaaccaatttaaattcaagacaaatgtcattaaagaaaaagaaactttatgatagagtttttggtagctggggactgacacaccaaaaaaagtctcccataaatcaagagaataaacatcgtgtttctatgtatatctgtaaatgccaaactaagaatgttgattagaattaagagtatgttgtaatttaattttgcaaaaaaattaaaattataaatgatatcggttttctaagtttgacttcaagataacttaaaaactaaatctgagttttgaaacaacggatgaactcattagtttagaaatcactgtggtgtacccttcttccaaatagagaagactggttgttaaagcccaaacatgtctaaactgatgttttagagaatctagaatatcttcggtctttcctaaccttgtcttctaaacggacctgacaattccctcccttgtggtccccatgcaccctgaagacacacctaagtcagcccttctgcacttgctattctatgtgcttcattcctcttgccacgagccctccaagggacaggctgtctgtgtcacacctgcctttctccgctggcacttagctcccttcctggcccagaggacaggcacccaaggacagcctgtctggggctgaaaatacacctaagtccccactgccaaaaatagggctgaggacacatgcccaacgaccaacagtggcctgtcaaatgtttttaaaacccagaaaaccaatttctacacactattctcaaaaacacatgcatgtttaaaggaaaatcacctttacactgcatgtgaattctttattctttaaacagcactctctaggtcccccccaaatattttagacaggcgctatggaaaacatactggtttttcactatacataagtaaaagattttattttatataccaggaattaatatattaaggctgcaagaggcttcacacatccactaggtccaatcctttcatctttgggtctcgaaaaattacttgccaaaaatcattattggccggtcagaggaaaaatcaagaacactcttgctcatacaagagggctctacttcccagagctgcctcctccgcaagagtccaggagttatttttatgttgacatgtttaccagcactcccaagccctttcttaaatgctgtccaatacattttaaagttgacaacccaactttttcagaaaaataaaatataacctgattgtatcaggcacttaaactactaattatactaaaatattaaagtaacttcatttttcagcacactattaaaaggaacggtgatacttgatacaaaatactgaaattgaggatttttttttccatatgcagttttgttgtattgaaacctattaacaccccagtactgacaagacaatgaattaacaactaaatgtaaatctgcccacctggttctgcaatattattgactaatagataactaaatgctaacacatctcagttttctccacagttctctgaagcatgcaaaaaatatatatatattacttaccaaaaacagagaaccatattcaaaagtctcattcataatctcttgtttcagctcttgtttttccatagatgtcccattttctttttcacccttcttttcagggctaatcctatcaatgttgggaacataggtcatttccaaacattctgcactttccattttaacagggagtatgcctttgatcttctgaaacaacgcagaaacggacccggtctcgcatgctgagttagaagaactggctttgtcaacatcttcctgattcgatttcacggcagatgttgttcttggaaccctgtgtgaagcatttttagaatgagttgtaacatgcacagcctggctagtaatgagtttattaaactgctgcttatgtgtcttgttaattagaatttctgcttttttgtctgcattcaagtcagatctcggtgttctgctcaagactgtttgttgtcttgaattcactgatgagggtgatgaggcactggtctgctgaggtctgggcgtgacctttgataaagcagcatctttgggctgcaacactgctctagacataacttttgctttgacattcttgaagtttggtcttgggtaacttataatttcagtttttctaactttgcagcctattggggtattcgttttgattgttgattttcctaaactgggtttacacaggttcacaggtgcctccttcgagtctggtatgtttttaagccctcgattacccttctccactttcttacatttctccgtcgcttcaatcggtgaaacagaaaaggttacttttgtgggttctaggactggtgttgacatgcacatcgttttgtctgtgctaatgaccatatcatttgcatcccaagtcagtccaaatgacgagcccaccttttgtcctggcgggctacttagaatcaattctgaggtatgattttgggttcccaaatcctttcctttggagaccatttgtgtgtcttcagtctcagtgactttatgctctgggttcagcacttgagcttcgctcttatcaaaagctggcaccattaaagggcattcatcatcaataagacaataggacactgtctctctcagattttggcccatttccttgtgcctgtatgagctctgtgaatgtggttcgctattggattcatcatgggataaacaaaagaactcttgtaatgcagaatcattggggacttccatgccatcagaaactggtgttagtgcttgtgtctccttttctccaactagtctttgttgtgatccatctgtgtactcactggtgacctttcctgaagaacatgcacactgatttccaatatctgaaacaaaaacctcactttgcatcaccacatcagaaaatgctgtgtaagtcatgtcttgggcttctgatggtgtgacttgagggttttcaaagctttctctatcataagtagtttctcttgcatgcgtcttatcagaatgggaagatgtccaagtggaataggataaagaagatgtacttccacttctcctaccagttggtggcaggcttccagcagtatggaaggactgactctttccgatggcatgatgtgatataaaggtgcagttaactttatccactgtcatgtcaaatgtttggtttagctccaaggcatcacagtagcctgcacagttcaaattgtcattaggcttccacacaaaaggcaaagatggctcaacactctggccctcaactgcttctagggaatgacaactgtgttgcagatatttgggcttctcagtacctacaagtgcaggacactgacaaatagaatctttatgcatatctaacacctgcttactaatgaaatcactagaagacttttcatgaccaaatacttcaacaccctgaaggcttaaagaaatattttcaccagtaactacagcagggtcagtttcataatcaaccaccatgtcatctgggttggcagaattccagttcacactgctggctgaagagttttgtgtaggtggtgatttcgggttgtatgcatgtgtatttccatctttatcactggtaaagaaggtttgcaattcatcttctattttatcatctgaattatcatcagtcatcctgaatagtaaccttaaacctctgccattttatttcttcttcaattccttttaaatgagagggtgggcaaaatggtctgtcttctaggtttttcagcacagttgaaaggttttcagtctaagatgctctgaagattaaatgatttgttgttccctggaagaaataaaatgtttaactcaagtaactataagaaaaattaacaggccaccccttggtttcaatcactaagtgattagtttcaatcactttatgttcacatttagaccccacaactactgatgtgggtaactgagatataatcaggcaatctatcaccgcttttcaagatacttttttaatttgagggaatagcaaatggggcaaaatggaagatggggtcattgctcgttaaccctgtccctgactttataactgatatgcctctcccccactcccagggacttgtcaaagagaggaggaggtaaatctggcaatagtattttcttcttgttggctgacagagtgacaattcacccaaatttgcttatgacagtcccaaagtatgtctgttgtcccaggatgattagtaaacatgtccctttcattctcagaagggcccccctattatttccatgcagagtgattattagacaggccatgaaagcccagcaaatcagctgaagatcaatcaagaactcacgtttctcctttgtttttattcctatcttaaacatatgctatttccaaattgaaggggaaaaaaaaattgtcgattcttaaaggctccagtggtaccctgttggaagtcccttgaaatgtgagttaccttatgttatacactaaactgttccccacccctctccaattcatatgtcaagcccaaacccccaccccttatgtaactatgttggagacagagcctttaaggaggtgattaaggttaaaagcagtcataagcgtggagtgctgatccaacagagctggtgcccttagaagaagggaaagtgacaccagaatgctctcccactcttggttcatcccctctctctaccaaattagggtacactgagaagagtaggagagctctcaccaaaaaccaaaccctgaaaagaaccttaatcttcaactttccagcctccaaaactgtgagaaagtaagtttttgttgtttaagccatccagtgtatgataatttgttatggtggccgaagaagacttaagtaccacatgccccagcaattctactcctaagaatctactgaagaaaatgaaaacatatgtcaacatgggaacttgcacacaaatgtacatgattctaaatagaagcactattcataatagtcataaagtagaaacccacatgcccatcaactgaagagcagaaagcaaaatgtactcttatgcatttgacaaaatattcctcagcaatagaaaggaatgcaatattgacacatggtacaacacggatataatattacacttgaaatattatatcaaatgaaagaagccagtcatgaaagtctacatactatatgacactatttacatgaaatgtccagaataagaaaacctaaagtggctgctaattgggatgacgtttcttttgcgagtatgttctaaaactatgtactgatgatggctgcacaatgttatatactgaaaactactgaattgtacacttaaaaatgaaaccattaaaacacccacgaaagcatttaaatctaaaactttttgcaaataaattattattgcttttttgagatggagtcttgctctgccacccaggctggagtgcagtgatgcaatctcggctcactgcaacctccacctcccggtttcaggcaatcttcctgcctcagcctcctgagtagcagggactacaggtgtacaccttcatgcgtggctgatttttgtatttttagtagagacagggtttcaccacactggccaggctggtctcgaactcctgacctcaggtaatctgcccacctcggcctcccaaagcactgggattacaggcatgagccaccacgcccggccacttttgggaaataacttaaattttattatgcttttggtcaaactgcagtgccaaagaaaggtccaaatgttcaagctaggactgcaaacaggtcattgtgaatcctaaaatgagggctgtgtgatttatattctgatggaaagtgtaaatttgttaactctttttactactgcaaacagatacgcacacacttgaactaattttctaatcctagtattcaatgtcaatccgatgtcacagtactgttgtaaagaaaaaaaaatatccatgagggagggaaaaaatgccatttcgtgtgttaattcaacttgccgaatgaagagtaggtctcatttttctatcttgcagcgttttctctgcattcaaacttcagtggcctgaataaaaccagaataggaactatgttaaaactgaaacgatcagttttcttcgctaacagtgctctgtgtctttctggccaagcatcctgataccagcctttaatggaataaagaaaggctgcaatgttgatttcaacagcatgtgcacacatacacatccaaaaagcgattttgaatccaaaaatgaaggctgcgtgatttatatactgatggaaagtgtaaatttgtgaaccctttttaccatataactccttagtgaaatcactgaatagtttattggcaagagccttaataaaagcttttatgaaacataaattaacatttttaatcctccagtataaaatacatccaagctaaatgtttaaatcaagaaatatatttattcatttttaggcttacatgcaggggatataatttccaaaagcactaaatatgctacagctttctgcttccctaacagctaatactcagttaacagactgtggcataagcaaatatatgcaaagtgcactgcaaacacgcacttagcatagatcgtgggaactgtctttgtaaataattgttagcttcaattaatggcatttttattactcaagtttcctcttctgaagtgcataaaagatgatttttaaacctcatataaattgaattaagggctcatatgtcaaagttattttttatttatttattttgagacggagtctggcactgtcgcccgggctggagtgcagtggcgcgatctcggctcactgcaacgtccgcctcccgggttcaagcgattaccctgcctcagcctcccgagtagctgggattacaggcgcccgccaccatgcccggctcattttctgtatttttagtagagatggtgttccactgtgttagccagcatggtcttgatctcctgacctcgtgatccgcccgcctcggcctcccaaagtgctgggattacaggcatgagccaccatgcccggccccaaggttattttttaaataagtatgtaagaggataaataattttatcactagtcctatgtttgtttttaccagttgtctttttttatttttcttttttttgagacaaggtctcactttgtcacccaagctgcagtgcagtgatgtgattacagcttactgcagcctcaacctcctaggctcaagcgatcttcccacctcagcctcccgagtagctgtgactacaggtatgtgccagcatgcccagctaatttttttaaaaaactttttgtagaaaaggggtccagcttttctcatttataaataatactaaactgaaatcttcacaatctttgacatctgatcatttgccaaattgctatatttaaaaagggggcaggattctttataatgtgcatgttactatatatgtatattttatatatatatataaaagttctctttctttttatatatttatatataaaaatacgtaatataaaatatatatattatatactgagttttgcttttaagactcatatactgtggtcagcattgtctctgaagcattttcccatgtcattatactataaaaacatttttaacggttgtgaaacgccactaaagttaaggttaaatgttttagatttacaagctagtggtttacaagagtaacagaaaaataaagaagccatcaaccatttaactttcacttaacattttagtacacttgggtttatgatttttttttaattcacaaaaagagattgggtgtggtcgctcatgcctgtaatctcagcactttgggaggctgaggcaggagcatcatttgagcccaggagttcaagactagcctgggcaacatagcaggaccctacctctacgatttcttttctttttttttttttttttagcacggtggtgcatgcctgtagtcccagctgctcagaaggctagggagaaaggatcacctgggcccagtagttcacagctgcagtaagctatgatcatgccaccacacttcagcctgggtgacagggaccctatcactattaaaagaaaacaaaacaaaataaaacaaatttcaaattggtgagcaaagagactaaaaaacccacaaacatgtgttcataaatacttaaggattgtttttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattc

SEQ ID NO: 602 - DNA, 40001 bp, Homo sapiens
gaaatgtcaacaaatgtcaatgaattgaaattatgtgtactattttctctaaccacagtggaattaagctagaaattaatttttaaaacataagactacagatgtcttcccctcctatgaagaaataagcaatatccttctatataactcatgagttcaaatcggtatataaatcataatgaaaagaaaaaatgcattcaaccaagtgctaatgaaaatgaaacatcaaaatttgagaacccatctctctaaggtagttaatagccaaaaatgcatagattagataaagaaaaagcatgaaaatcaaatatttaagcatccatttcaatgcatttgtgtaagaggagctacttcaatgtaaagaaagtggaaggaaagaaacagtaaacagtaaaaattagcaaaatagaaaatgagttcacacttattttttcacatattaaagacttttgaaaagcgttttgatgtcttttcaaatgcttcatacattgaatatgaagtttaatttcatatattgaaagtctttccaaactgtcatcattctgtcaagactacacccctgctccatccctgccacaaaaaagagagaaaagagagaaagaaagaaggtacacattgttgatatctggaatgagaaaagcaacatagctaaagatcttaaatatattaaaactttaaaaagaacacactgtattcttacatatacctaaaatgctagaacaggaaaaattagtatatggaaaagaagaaaatcaaaacaagaattggctctagggaaactgtaaaggtgatttactgagaagaggtatgataagacattctgggatgatgacaatgttgtgtatcttgataatggtttggtttgcaaagttggaaactcaccagatggaacacctaagatatgtgcattttattgtacgtaaattttatcccaaaaggaaaaaagtaaaaacaaatattgaacacaagttaacatatgcattctgaagtatttgtcggaaattgcactgacttttgcaacctactttaaaaagcattaaaaaagatgaattgaagaatgaaaaaatgagtagatggataaataaataacaaattatagtaaatacaccttgtagaatttaggtagtgtgtatctgggtgttcactgtaaaattttttgacttttgtatgtttctgaaatataaattgtagaatctaggtagtgtgtatccgggtgttcactgtaaattttttttaacttctgtatgtttctgaatttttttgcatgcagaaaagaatagaacataatgaacaagtttatctcaataatttgaaattttaataaaataactacatttctagcaaaaacacaacttaccaaatcaaacacaagaggaaataaaaaacctgtttaactttctatccaaaaaaattgattttatatttacagatcttcctgcagagaaaattccaagttggagtccagaaacagactcatatttaacaacacttgatttttttcaaaagtgacactacagagcagtagtgaaaaagggaaaaaatctttttttcaacaaatagtttaatggaaacagccatagtaaaattgatatatataacgtaagaaactaagctaacccatacctcactccagacaaaaaattcaattccagggggactgcagaactaaatgtgaacggtaaaacaataaagtttctaaattatgacatggaaaaagttttcataaccttgtggtagagaagaactttttacacagtacattaaagcattcttcataattgaaaaaagtatcagataggagcaaattaacataagaaacttctgtttatcaaaatgtatccttcagaagatacaaatccatgccacagagagggtcatgctggttggctgactttcagaccaagacaataaagcaaagttactgaatccttcagtgtttggggattgactaattaatgctggttgtaaattagttcaaccattgtggaagacaacgtggtgattcctcaatgatctagaaccagaaataccatttgacccagcaatcccattcctgggtatatacccaaagtattacaagtcattctactttaaagacatatgcacatgtatgtttattgcagcactatttacaatagcaaagacttagaaccaacctaaattatagaaaggataaagaaaatgtgacacatatacaccatggaatactatgcaaccattaaaaaaatgagatcatgtcctttgcagggacatggatgaagctggaaatcatcattctcagcaaactaacacaggaacagaaaatcaaacaccacatgctctcattcataagtgggagttgaacaatgagaacacatgaacacagggaagagaacatcacacaccggggcctgttgtgggtagaaagggacattgggtcaaataactaatgcatgcacggattaaaacctagattatgggtttataggtgcagcaaaccaccatggcacaagtattcctacataacagacctgcacattctgcacatatatcctggaacttaaagtaaaatacatgtgtgtgtgtgtatatatatatatatatatatattcagatataagcatggaatactacacagccataaaaaagaatgaaatcatgcccttttcagcaacatggatgcagctggaaaacattatcctaagtaaattaacacaaaagcagaaaaccaaatactacatgttatcacttacaagtgggagctaaacattgagggcacatggtcataaatgggaacaataggtatgggggaatataagagagggtaatggttgaaaaaactaccaactgaggactatgttcactacctaggtgatgaattcattcatactccaaacctcagcatcacacaatataccctaattacaaacctacacatgcatcccctaattctaaaataaaagttgaaaaaagaaaaaaaaacagctctaagattgcttgtttagagttcggaaccaggactaaggaatagtccatcttttcctcttttgaacatgataagttatcaaggaaatgtaaatttaagtcaatttccaccaaatgaaaaaagttaaagactgacataactagtgttggcaagggtatatggcagccccatctctgagatacttccagtgagagtataagttggtacggcaacttgggaagacttttgacagtcaaaggtgaacatatgcacatctatggttcaacaattgttttaccttactgcctgcagggagtttccagactaaggtgcagggaagggaaacccaggacgattctgaccattgagacaaagctggaagtataacacaaaatcctgaagtaatcataaacaaattattagtgttaaagatatcaaatatgtcattttataaaagctttgtggagcaaaaatctcttaagtgaatctaaaagacaaccgacaaaaggggaaaatatatttgaaacatggaacacacacagagaatgaatcactgtaatgtgtaaagattccttaacaatttttggctgttgggccagcaaaatatcacatatttgaacacaacagaatgggtgaagctatggggaaatttgtttccctacatttgaatgggagtgtttatgatataagatctatgaagagaaaattgacgttgtctctcaagttacaaaagtatataccttcaattttacaattcctcttcccagaatgcattcaacacatagaaatagtggtaagacaaggttattcttggtggtgttgtttgtaaaagaaaaagattgaaaaggactcaactgttaatctacaggtgaatgattagataaataaaagtacagtcataagatacgatgctagtcagattaaaaaataaaaagaacaagggatctcattgtggattggtagcaaagaatctccagtatatattgttcagttaaaaacttaattgcagaatagtacacatagtgtgatgtcgtttgtgtaaagcatgagaggggaagaaatattaatgttgacttttatatgcacaaaatttatcagaaaagatggagaaaaatgaataaaatggaagagaaaaaacaaaacagataggggtgggaaggagaaacatcattgtgttccttttcatctttttttgatattcaaactatgtgactccattatctatacatcttgtatatgtatatatacattatctatacctatataaaaaataaaaccatttcaaaagacattacaaggagagcaatgaatgtctgtatacaaaaaagagagaaaatatttttaggtaatcagatgcactctcccaataagactgtctggaaaggataataaatgaatatttctacctcattatcatattagatttctgtacaatctagtgtatgaaacaacaaaagtgcattaagaagcactcaaagaacaaactcattattgtcagatgtaaaatgctagtggttggcaaaaacaaaggcagagaaacacggatgtaagagaacattgaatttttgggtatttctgggacatatgaagagtggcaacacagatctggaagagcggttgaagccaggtcacagaggactttaactgtaaaacttggtgtgaactgcattgttttccatggaactatagtcagttcatgtgacatattccagaacaaatttaaatgagtccacctcaatctgtcattagttttacataaatgcagtttacatccttctgataaatgcccgaagatattataaaatagctgcttagaaaatactgtgctttgaatacactttctgctatttttcaagaaaacagctcaaaagtaaacccccaggaagcgttgtctgactgaactattttgcagctatcttggtgaaaagtccaggacatgagcaagcttgagaaactgatataagcaatagtcaatgttcttccccggtactgtatttccagatgttgaatgataatgattggataaataaataagccttttcatgtgcagaaggtcaacatagagcattcatctttgttgttgttttttgtttcattactgtagagaagagtgttgaaatgtcttctttcttttacagatgaagaagtgaagctggtgagaaaatcagcagtgccttctcaggcttgcctatatatcactgtaagtgtcccgttgtttatgtcatttggatactgccagccataaggaatggctaactaacgtagtggctaaccagtgtgagaagtgcctcgggaaagcagtgtaattgtggagaaaaggccacgcaatcaaaggcagggatgatgtcctgccacgtaggaggttaatgagtaaaggggaggagacagagggcccccaaaaggaatcagtccttccagctcctgcccatgggccagccacagctgggatgctcaccacctctacacctgggagggcagggaggcaggaacatggcaattggtaatatttcaagacgctaaatctgaagcaaaattcacatgctgacttgatactgcacatacatgtgaggtttctcaagaaagtaagggtcaggcatggtggtggctcttgcctctaatcccagtgcttcagggggccaagattgggagaatcactagaggtcaagagttagagaccagcctaggtaacatagcaaaaccccattttcacatttttttttaattagtcaggcatagtggcaagcacctgcagtcccagctattcaggagactgagatggaaggattgccagagctcaggagtttgaggctgcagtgagctatgatccaccactgcactccagcctgggcaacagaatgaaaccttgtgtctaaaacaaaatgtaaaaaatatatttgacagatgttggtgaccttctaggtgctaggttctatgttgagggatctcaaaggctgagaccacattttcttaatgtcatatacttgctcaccattctcagacctccctgatatggtttggctctgtgtccacacccaaatctcacctcacattgtaattcccataatccccacgtgtcaaggatggaccaggtagaggaaattggatcatggggcagttctccatgctgttcttgtgatagtgagtaagttctcacaagatctgatggttttatatgctcctggctttttccctgcttgcaatcactctgtcctgctgccctgtgaagaaagtgcctgcttttcttttgccttctgccgtgattgtaagtttcctgaggcctccgagcaatgcagaactgtgagtcaattaaagatctttcctttacaaattacccagtctcagactaatacaacaaattggtacctcagagagtggggtgctgctataaggatacccgaaattgtggaagcatctttggaactgggtaacaggcagaggttggaatagtttggagggctcagaagaacacaggaagatgtgggaaagtttggaacatcctagagacttgttgaatagttttgaccaaaatgctaatagtgatatggacaatgaagtccaggctgaggtggtctcagatagagatgaggaactttttagtaactagaataaaagtgactcatgctatgctttagcaaagagactggcagcattttgccccaaccctggagatctgtggaactttgaacttgagagagatgatttagggtatctggtggaagaaatttctaaacagcaaagtgttcaagaggtggcagagcataagagtttggaaaatttgcagcatgatgatgcagtagtaaagaaaaacccattttggggggaagaaattcaagccagctgcagaaatttgcataagtaacaaggaatcaagacaatggggaaaatgtctccagggatgtcagagacattcgtggcagcccctcccatcacaggactggtatcctagaaggaaaaaatggttccatgggctgggcccagggccttgctgctttgtgaaaccttaggacttggtgccctgcatcccagccatggtaaaaggggataacacacagatcaagccattgctccagagggtgcaagccccaagccttggcagcttacacatggtgttgggcctatgggtgcacagaaattaagaattgaggtttgagaacctccacctagacttcagaggatgtatagaaacacctggatgtccaggcagaagtttgctgcatgggtggagcccacatgggtaacctctgttagggtggtatggaagggaaatgatgggtcagagcccccacacagagtttccactgcgtcactgcctagtggagctgtgagaagaggggcaccatcctccaggccccagaattgtagatccactgaccatttgcacctgcacctggaaaagccacaggcactaaatgccagcctatgaaagcatctgggaggggggctgtaccttgcaaagccacagaggcagagctgcccaaggccatgagagcccacctcttgcatcagcataaccgggatgtgagacatggagtcaaaggagagcattttggaactttaaggtttaatgactgccctaatagattttgagtttgcatggggcctatagcccttttgttttggccaatttctcccatttggaatgggagcatttatccaatgcctgtacccccattgtatctaggaagtaacaaacttgtttttgattttacaggcttataggtggaaaggacttgccttgtctcagatgagactttggactgtggactttgagttaatgctgaaatgagttaagactttggggcactgttgggaaggcataatcggttttgaaatgtgaagaaatgagatttgggaggggccagaagtggaatgatatggtttggctttgtgtccccacccaaatctcatcttgaattatagtaatccccatgtgtcataggagggacctgttgggaggtaattggatcttggagtggtttctcccatcctgttctcatgacagtgagttagttctcatgagatctgatggttttataagcatctggcatttcccctgcttgtactcactctatcctgccaccttgtgaagaaggcacctgcttctcctttgccttccaccatgattgcaagtttcctgaggcctccccagagatgtggaactgtgagtaaattaaacctctttcctttataaattacccagtcttaggtatttcttcacatcagtgtgagaatggactaatacactccccaaaacacatgcacatgcacaaatcctgtgctgaccacctcgaagtatctggagcccctgctctcttttcactagaccctctgcacattaaaaaattcaaatcgacatactgtgactaaagtacatataaacgtagaacaaagaaattaataaaaatcattttaataaacaacatattaacagttatacaacttaacaaacatatttcttctcttatttctaaattctgtagggaacccagtaaccgcatcagtgatagagtgggaagctcctttcagaggccttggacttgctgagtcactgtgttatactccaagcagcacactcaactctttgctgatggaggggtttattctcaagaagcatgtacctcatgctgtctcctgttgcccccacctctcagttatgactttttgtcccaaattgaaaccaggagagatctcccttctttattatctgaaagggcaaaatttgtatctctcaggaagaagccaacttagcaagctctaatagcctggtgagagagaggacgcagggaaaggctgaatgtatttgaatggtgctgattcatgtaggtccttggaaaatatgaaaaatttccatttcctaggatatgtttgccctcactactcactattatatattcactattgggaatatccagacaccttaaaaggtgtcaagacctgacagagatcaggtggctttgttgtgggattttatgatatctttatttatttatttatgcctctttgtagtagatgtattagatgattattacatttattatgagatattagtaatcagacactatgcaaaatgcttcacatacattacttcatctaggattctgtccactctgtgagctgcaactatcattatcctcatttttcagatggaaaaagtcaagtatcttgcctaatgccacacagcgagtaagcatgaaacctgggattcaaatccaggtaatcaggcaccagaatccaccatataaccacacataggctgcatttgaacatcttggggtcaatgagctgtccattcttgggcaataggctcacagatctgtgaagagccagcatcacaccattggcaaattcgggcttgtggaattccttgaggagatgcaggcagcatcactgagctgagttttctttccaagatgtttaactagtcagggcaccagcacatggaggaaaatcacagtgccacaagaacgcttgcttcaaaatacagatcaaagattttggctgctctctaggtgctgaaagcagaaataaccttggaacagattcctaacaggcatctgaaaccaactcctgggactccttgcctggtgaatgggtccttgtagtggtgccatgggcctctgaaagacacaacccctcgctgctccccgactacaactcagcggaggtcttctggcctcatcagtgcccagacgggtgttcatgcatggaaatggatctggcatttgttcacctataatagttgtttgaggagttaatcctagcaaaaataggtcagcatcttttctccttttcttgggattaactccacagcaactcaaccaggcaaagctgaagcgttttatagaaccagatgcataatttctgtcacacagacttctttgttaaagagtaccctggccccaggatgtgtttggagaaaacttttcatatgggtttattcttcacaatgaatgaaatcttttcctgacctgcagataggctgcttttcttggtcttcacttctcatctcaaacacttaatggtaaaaacaaatgaggtgacaatgcagtcagtcgagggagcttgtgaggcctcaaatagactaaccagagatgaccggagagctgtgcttgccatgccaccagcaaaggccaagggccacactgtggcttccgtggcaaaacctcatttcagcagctcctaacttcaaagggctccaccaataagaccctatcggaggtcctagaatctcatcagcaatatattcagcaattatctccaaaagcatttcttttacttgtctaaatcctttgaattatagatgtactgctccttagcttctttcccttacatttcctttctctctaccaacaaaaagccatcagccctgagaaagactcttccattttctggaagtgtgagtgggcacagcaggtcaagacaagggccagtgaggacatggaagcactgtccacccacatgcccaatgaggaagcacaggattggctgcagatcttggaatatgggtgctttttcaagactggggaaaaattgtcaactattcataaacataagcaaaggtcaaaatgagtgtcacagtaaatatttgattggacttgagaaatcaacctaatattgtaagttctaagaagaataacttcaaagcagaagagtcttgtatttgcacttttcagataaaatctctctgttggctgggcttagtgatttacacctgtaatcccaacactttgggaggcctcggtgggagaatcacttgaggccagagatttgagaccagcctgaggaacatagtgagaccttgtctttatttataaaaaataaataaaaataaaaataaataaataaataaaaatttcaaaatcttttccttgcagtgctaaggcataaagttttacagaatttagaaacacatcaagaacatttctgtctatcaccagtgggtctttcaggataagctgttcccttctttatggactcttgaccttctctggacctgctgtaaataataaacattttctccatggtaaaaatggccatttcattgcactttaatcaagatacccattaacaaactgtcactttgtacttatccaggactaggtcatctaaatgcataagagttatataaaagcatgagacttgggggcagcaaaggtgataataggggcttatggatttctatgaattcttcctttttcaatagtagatctgtctcaagatatgattttcccatagcgctaaataagtttcaaatgtttgcttatatcaagaccaaacaaacaaggggcattgaactttttataaaattcaagttacattgcagtaagaacaccagtcaagtttaagaaatatgacaatcggggaacttggatgctgttctaattaatgctatgtttaacagtaatggcacaaattgcaacagggtgcaaaattaatgagaaaatacccaattctattaactttctaagaatttaggtggtcttaaatcccttaggttggctaactagtgattagaaaccatctcaagttatttctgtgtttgcactccattatcacttttcctgaatacttaataatggccaatcattaggcagttcccacacactgttttataggctgtaggcaaaagtctttgttcccattgctgcctgccaaatatgctgtgctgtgctgtgcctgccgttcttgttcctggctgtatctcaggtagggtctatagactttcccatcactttcagacactaacagtatcaagtagttctattctatctttaaaaaaaaaattacaactgcaatctctttcatcttcagacttctcccttcccctagctcaggcgtcccttaaaggcctggagtagggaagggaagacgtgtcaatatcttcactgtttgtcactttggctgtccctcctgccttctgcactcagacacccttgtccttgccaactgtcctgcaagcaggatgactccaggagctgctcacctggagacttcttcaggcaaaaggcactctccattccctgtgtctctaaagctctgaggactcatgggtattctcatacctttcttcctggcttttggcagcagcccaggacacattctttggagacagagttccagtactcattctggagcacaggacaaagagccattcagcaactctttacaaggaaatcttgtctctccttcaccttccaagtaatctccttgcctccttttctatacctaagatcaatgatggctaagggccccagaccattgtgtattttgagagatggtcacccaaagcatgttctgcatagggggtctgacccttctctttataatatgtggtcacttgatattctttgctgtcaatttttcaaaagagcaaaaatcccacttgacctcccactacataaggattgcatatccaactaaacaaggtacgcatggcaagggatcttgtcacatagctctttacgttagccacagtttcttcctcagtgcactctgaacagtatacagtgtgaccatcagccacgtcacagatgtgatttatgtaggatagatgagaaggaaccccagtgtcttatctataataatttggatatctatgttaaaatgtggttggttctataatgatgctctgcttttgacaaactctttcaaaataattaacgaactgctatgcctaattgtatttaagaagagagcttctactagaatttgtataaatgttcacagaaacacaaatatttcctctctccctctccctctgtctcttatgtggagatgagagtcttgctgtgttgcccaggctggtcttgaactcctggccacaagcaatctccttaccttgacctcccaaaacactgggatgacaggcatgaatcactactcctggccctaaaccttttctcctaaacgctttggtaaacactttctaaatcaacctgcatttcatcctttcccttcttggatgaactcagtagttggtaatatactgaaaccctactcgctgtatcatcattagtcctcacaataatagctgctgaaactaccgtgttcaaggatgacttattacgacataaatctccagcaattagcacagaacccaaaataaacaggaatccagatattattttttgttcaagataagagcaataatggtgattggtgttgataatgaaatcccactgagtctagacatcttccaacttgagtaaaaccaattttatgagcctgttttctcaaatattatctctaagttgtccttcaaacatagaatatacattatacccttctattcgtaacctctgtcctctaccctttgaattctcttttcaagtcagctctaagagttagggatagtctatacatttagttcttttcccttctgctgccaaatgtctgtacctaataaacaataatacatgagaagagaatacatcagctccaaaagtaggaatgagtattatctgcatgccacagacttcaagaatgttacataaaaataatgctgaagagactagactgaaaaagcaatagaagaatgacagacaaaaatcattgttgagaatataatcctactcagaagtcgacgggagaccttgttacatgcccaacatgatccacgagaactaagagtgacagtcgcccaagggcccatcagaaggacacaattcgaactctgtcttgtcccaagaactagcaacaaaaagtcctaactgtgtattcaaaatgcccattggcatttcctagtaatgtgattacagtaattagaggagcaccagggtatatctgggcagagcccacaacaaatagaaaaataatttttggaggtgtagaaagagaggcttctctaaccccattcccaaattgtatcaacttgtagctccagctttttcaactttcttctaggaattgtaaatagaacacccaacttataagagaaaccagctcagaaactaggctaaatattaatattgagccattttacatttttctttgtaattatgaattcaaaaattatatgatgtcccacataaaactcctaagtttaaagggaggaattggctttgtagactcatattagctaactctttctgaaatatcaatttgtgttctcaacaaaatttaaaagaacattccgcttatgacactagaaataagcagcagtgaaaaagagaagatgtgggccagctgactcatttctgtgaaatttggaatgccatcagggacagtactgcatctgcagtggcattgtaagttgccatgcccacttcctcctttatcactcaacccacacccaaccgtagctccataggtgggtcctgacaggtctaatcagcacagtgccctcaatggaaagaaccagggggtagagaaaggcactgatagcttctgcacatgaaagtatacagatacacacacacacacacacacacacacagacacacacgcatgcatgcatgcacgcttattttgcaccaaaatcttaatggtgattttttttcttcaatttttattttaagttccagggtacatgttcaggatgttcaggtttgttacataggtaaagatgtaccatggtggtttgctgcacagaccaacccattacctaggcattaagcccagcatccattagctattctttgtaatgttctccctactcccatcttcccacaggccccaatatgtgttgttccccagatgtgtccatttgttctcatggttcatctcccacttataattgaaaacatgcagtgtttggttttttgttcctgagttagtttgctgaggataatggcttcaagctccatccatgtccctgcaaaggacatgatcttcttactttttatagctgtgtggtattccatggtgtatatctaatggtaattatttaaattagcgataatttaaaaaattgtttctgcttctatattttatatttttctaaatgagtttcctagatgaatatatacatcatcctgacccattcagtctgaaacaacaaaacaagttgtcaaattgaatgggtcaggatggcgtatatattcttgttttgagtcagagatattgagaaactactgggtgactagaaagcagattaatttgtgtggcctggattctagcactggagatatcagtcttcagccgaaagcaagtctggtggaaatagacctgtccaatagtaagaaaaggtatgatgtgcaatagtgaaaaaaggtgtgatgtgcactaatagaaagaatctgggaaaatttatttttattttttaaagcttatttattttattttgtttttcaaccaacttcctgaaaagtaacctagaaaattatatcaatcattaacattaaaaagcaacaagcacacacacgaacacacacacaaagttctcttttgcaaaggagacagaaaccttagcattctaacagaatcctgtatgcccagggctgagtaaccccagtgagcatctaactgaagacttctcaaccagaaggcacccctgcaacccctccacatttgtgtatcttgtaatgaagctgccaatgcttccaaatacgtatgttgaaaaacagtcacggaaaagtgaataacatttccattgcctgtattgagccatttttaccgcatatgttctctgatatcataagcttctcaaaattgtgataatatattcaactcttttagtctttgaaatgcttagaacacttttcttcttttttcccttttctttccttttttattttcttctttctttcatttttggagcactcatttaagccttgtacatatatcatctgcatcatctcaatataaataaattctcgtattgtaagattgcaaaaacatagaatacatcatctgaggatgtagttctagcccagcttaaacaccaaaatgcttaggtcaaaagttcatgcttttatacattcatctcactcaccctctggtttttctgtgactcacttcttgcttttacttttggtgaatgtcccttaaaaacagaaaaagaatctgtggccattttccaatatgatgaatgttcatagctcaaaaattgacaagtatcatatatttctacaatccaatcttacttttctatacttcctaactatcaatgaaaagggaagatatgcagtgcaacctgtggaccaaggttactttcttgctgttacgtatgttttatattgtctttgttatactgggggaagcaggaaagttaggaaatcagttcagcacctaatcaatccaaagcaaagcaatctacatacacatcagtgtgatttttctgaaatttccaggtgtagttaatttcatatctacttttaccaaatatcaagataatattgcagaaagatttccatagttccaatttccagctcctggacaaccatgagatttgcaatgccagatataaataatttaccacctcactactcacccctataaattttattttcaataattttaccaaacattttggctataatcaagtacctatcttcctaagtctttagttttacatcatagaaatatttcaatcaatgaataagccatttctcagaatgcatttttctgtaatttatataaatgtgtagttttttcttcaatttgtaattgtaaacgtctataaaaagagtgatatggtttgactgtgtccccaccaaatctcaacttgaattttatctcccagaattcccacgtgttgtgggagggaccctgcgggaggtaactgaatcatagggactggtctttcccgtgctattctcgtgattgtgaataagtctcataagatccgatgggtttatcaggggtttctgcttttgtttcttcctcattttcccttgccaccaccaggttaagaagtgcttttctcctcctgccatgattctgaggcctccccagccatgtggaactctaagtccaattaagcctctttttcttcccagtctctggtaggtctttatcagcagcgtgaaaacggactaatacaaaggattaatatcataggtctcttcacatatgcccttcagtgataagcaacaaatcatttgaataatgattaatgcttatcaaatgtttgaataatttgataagcaataaattgaaaaatgtgtgaatttttattacattagatggtttgattcttagaaaagggctagagaagtcagaagtttgacgtcattagaaaagaattgttagcatcaaatataataataccattttaagtatataaattgcatttataaatatgcactattaagtataaattagcatgaattttttttgttgctggcattccaacaaaattctaaaaagaagtgtatcactgtgtatataatttaccgccctttaagatagaaatacaataataatgaattaaatattaattaggctaggtgcagtggctcacacctgtaatctcaacactttgggagactgaggtgggacgatcacttgaatccaggagttcaagaacagcctgggcaacatagtgacaccttgtctttacaaaaaaaaaaagaaattaattaagaaaaagaaataataagaagtaaaataatgagaaagagagcaataacactgttatatttgaaactactatctaaaacatacataaaatattgtttattttataaaccaaataaataattcatggcattaggatacaaaattttcagcctaagaccaaataaatgcacacatagaatcaaagaggttacatgggaagtccaaagccttaaatctgaattgaaaatgccatgtgaaaatgatttatttttctcttaaaaatatatctatttttgcttcacatactcaatagcttagcagtgaccaattctctaacaatgacaattatagcccaaatttttgactctaagaatcattttccatgaaaagaatctagtgctaattagagaaatggcttattctatttttgcagcaaaaagtgtggcaaaggatgttggaacatcttgtgatatcaaaatgcaagaaagctttcaacaattactgggtcgaggtcaacataacaacagaagcaaaattgataggctcctactggccaaagataagacaatatgggcatccaaaataattcctggaaatatacaactgaccaaaattaaatcaggaagaaatagaaaacctgaacagatcaatagaaagcagtaattaaaaataagtctcccaacagagaaaagcccaggaccagatggactcacagccaaattctacaaagtagacaaagaagaactaataccaatcctcctgaaactattcttaaaaatcaatgaggagggatttcatagaatgagttacattctatgaggcaagcatcaccctgattccaaaaccagacaaagacacacaagaaaggaaaactactggtcaatatttctgataaaaatagatataaacatcctcagcaaaatactagtgaactgaatttaacagcacatcaaaaagataatacaccatgatcaagtgggatttacaggaaggatgcaagaaatgttcaacatatgcaaataaataaatataatacatcacatcaacagaatgaaggacaaaaaccatatcatcatctcaacagatggagaaaaagcatttgataaaattcaacattcctttatgataaaaactctcaacaaactaggcatagaagaaacatacttcaaaataataaaggccatgtacaaaaacccacaactaacatcatactgaacggggaaaagctgaaagtctttcctctaataactggaagaagagaaggatgcccactttcaacattctaattcaacctagtactggaagtcttatccacagcaattaggcaacagaaagaaatgaaaggcatccaaattggaaaagagaaattcaaattgttcctttttgtttatgatatgatctcatacctagaagaacttaaagactccaccaaaacactcttagatttgataagtgaatatggtaaagttacgggaaacaaaatcaatgtttgaaaatcagtagtatttctatataccaacaatgatgtagctaagaaataaattaagaaagctatcccatttacaatagctacaaaacagaataccaaggaaaaaatttaaccaaggagctgaaagatctttccaagaaaaagtacaaagcattgatgaaagaaattgaagaggacacaagtaaatggaaagacatcccatgctcacgtatcagaagaatcaatataattcaaattaatttcttaatggttacaatgtacattgtctgtgtgatggttatactaaaagcccagatttcaccactattcaatataatcatgtaacaaaacctcagttgcacaccataaatttatacgaaaaaaagcatgctgtccaaagcaatctacagatgcaatgcaattcctataaaaacaccaatgtcatttttgacagaattaagaaaaacaattctaaaatgcatgtggaacaacatagcatttgttgtttaggatagccaaagcaatcctaaacaaaaggaacaaagatggaggcatctgacctgacttcaaaatatactaccaggttatggtaaccaaaaccatatggtattggcataaaaatagacacataggccaatggaacagaatagataacccagaaataaatccacttacttacagacaactgatttttgacaaatacagcaaaaaattatattggggaaagatcaccatttatagtaaatgatgctgggaatactgaatatccacatgcagaagaataaaactggatccctctctctcactatatacaaaaatgaactcaagatggattaaagacataaacataacacccaagatgataaagctactagaagaaaacatatgagaaatacttcaggattttggtctgggcaaaaaacctatgagtaagactttaaaagcacaggcaacaaaaacaaacaagacaattcaactaaaaagctttgcacagcaaaataatcatcaaagtgaagagacaacctgttgaatgggagaaaatatttgtaaactattcatccaacagggcactgatatccagaatattcacgaaattcaaacaactccacagtaaatatgcaaataatcccattaaaaagtaggtaaaggacatgaacaaacatttctgaaaaaacatacaaagagccaacagatttatgaagaaatgctcaacatcactaaccatcaggaagtgcaaatcaaagccacagtgaaatatcatcttactccagtcagaatggctgctattaagaagacaaaaaaataggccaggtgtggtggctcatgcctatcatcccagcactttgggaggccaaggagggcagatcacaaggtcaggagatcaagaccaccctggctaacacaatgaaactccctctctactaaaattacaaagaattagccaggcgtggtggcatgcatctgtagtcccagctactcaagaggctgaggcaagagaattgcttgaacccgggaggcggaggttgcagtgagccaagatcatgccactgcactccagcctgggcaacagagtgagactccatctcaaaaaaaataaataaataaatacaaaaaatgaaaataacatattttggcaaaaatgcagagaaaagggaactgttatgcactattggtagaaatgtaaattagtacagtcactatgaaaaacagtctggagattcataaaatactaaaaatagaattaccattcaattcagcaatcccactgctgggatacctgcactcacaagtttatctcaacatgattcacaatagcaattttatggaatcaaccctagtgtctattgacggaaaaatggataaagaaaatgaggtatacttatatacaatggaggactatttggccataaaaaagaatgaaacactgtcatttgtagcaacacggatggaactgaaggtcattgtgttaagtgaaaataagccaggcacaaaaaaggcaaatatcacatgtcctcccttagatgtgggacctaaagaatttgattacacagaggtagagagtggaaatacagataacagagacttggaagggtgtgtgatggggagggagaaagatgaagagaagtgggttatagggtacaaacatacgataagatagaagaaataaatacaatgtttgatagtagagcagggtgactacacttaacaaaagtgtattgtgctggacaatagttaatggacaccctaaatattcttatttgattacttggcactatagacatttaacaaaatttcacaaagatcccattaatttttaaatttataaaataataaaataaaggacaataaatcaataataaataatgtaatacatttaaaacattaagttaaatatatttttaaaatatggattttcaatgatggggcaaaacttattggttagctttggagactgctaggctaagtctttattctaaaactggtaagtaaaggaaaacaatcaataatacatcctacctttcttatgcaaactatatttcaggataatcaaacagatgatgagaaaaaaaattatagaaaaataacagctaataaaagcaataaggttaatctaattagtctactacaattttaacaaaataataaaataatgggctgggacaataataatcaatggctgctaacaccattggttgaaaagataatgggaaacttcatagatggatggctaagccaacaatatctaaacttactaatgaatattctcatgacaaaaagaaataacccagcattgtgttcctcctgatgtactgcaattaaatacacagcatcacctaataagtattattgccaaaaaattaagcctgattcagcctctgaatccaacaatatgcaaaatgcaaaggacaaaggaacatgttaatgacgttgggaggatgcaatcaaccaaagacaaatagtgagcaatttcatatggcaaaatacctttaatcgtcagcagaaacagcagcggacaaagagagggagggactggtatagacctaaaaaactggttaaccaaatgcattgttgcatggatcttcagaatttgacttgaacaaagtaactataaaaagactttttttttttttttttttttttgagacggagtctcactctgtcacccaggctggaatgcagtggcatgatcttggctcactgcaagcttcgcctcctgggttcacgccattctcctgcctcagcctcccaagtaactgggactacaggcgcccgccaccatgcccggctaattttttgtgtttttagtagagacagggtttcctcgtgttagccaggatggtcttgatctcctgacctcgtgatccacccgccttggactcccaaagtgctgggattacaggcgtaagccaccgctcccagcctatagaaagactttttatgagataactgagtaaatttgaaaactgaccatataataaattatatttaacaatgactgtcatttttaggtatgataatggtattgccatggtttaaaaaatcttatctcttagcaatatatatgtgtgtatatgtacatacacgcacacacacacacacatatatacatatatatatataaaaaatagtatttgtggatgaaactatgtaatttctggaaattgccttaaattattaaattttttaagtatggtaatggttttctggtaatgttaaaaaaatccttttctcttagaggtacatgcttaaatatttactaaacaaactatacgataatagaatttgctttaaaacaatgtttcaagaatgtggagggaaagtgttggcagcagagaatatagatgaaagaatagttacatgttgattattgttgaagctgatgttcgattgattatactattaactctacttatgtatatgcttaaattcttataagaaaaaatgtaaaatattaaataatgtaaaatagaatgaagacaaaatctccaagtcatatttaattttcctttaagaatgcaaattaattaaaattcttatttgaatgaaaacatgatttgaagtctagagcctgttctaaatttatattcttcccttttttagacaactaaatatatttttattctttggattcagtaccattcatatatatcctccttttgctgtatttataaaagatttcaaattttcctgtgcctggctcatcactgatttttctttctccaaatagacactcataatttgacctagaacataaattattcttggatatccatctcctagcacagtttttgacatattttaggtaataaaaaatatctgaggaatggatgaggaatgaaaaaaagctaacaaatgcttgtacctatttcaagagaaagagaagaaaacatttaaaggagaaaaaatcaaattcagcttctattttaaaatatgggccaggcacggtggctcacacctgtaatctcagcactttggaaggccgaggcaggcagatcacttgaggtcaggagttcgagaccagcctggccaacatggtaaaaccccatctctacaaaatacaaaaaaaaatattagccaggcgcgatggctcatgcctgtaatcccagctacttgggaggctgaggcaggaaaattgcttgaacccaggaggcagaggctgcagtgaaccgagatcgagccactgcactccagcctgggtgacagagtgagactccctctcaaaagaaaagaaaatgactaaggaatatatatggatcataggaaaccataacaaattttaaaatttcttcaaattctgtccatatataatggcaaaagaacactgagtattaggaataaaatcagatgcaatattaatgagaactgtttattttaccatcttgcataacagtaaatggaaatgccttcatgtctaaatgataacatacagagagaaaataaggcaatatccagggtctctttaaagataaaacccttttgaaattccaattttatagaaccagtgcattcccaaggcaaagtaaaattgctctttagctgaagcagggattaaagctgaacactctattggaatggtttagttctgcccagtgaatgggatgtactgtccctgaggcaatataattcagtctgttctctcttcaatgtgaacgccagctagccaggagcttattccctgaagcacattttagaatactgtgccatacaacttaatatataaagctacttgtcaggcatttccaaaaatcagggttgcccggaaaggagtctcagagccggaacagccttgggaaagggtcacatctgcctttagctcccccgtttccaccctgctaagtaccccatggtcatcctacccagcctggctttgtccttcccaggccccagcctctcagaccatagatactccatccccatcctcatcaaaaatgaacttgcttaaatccctagggctttatgctctgattgggtggctatatgtgtttgtgattgtgtgtgtgtgtgtgtgtgtgtgtgtgtgtgtgtgtgtgtgtgtgtttctgtgtgtgtatagatatgagtatgctcctcttatatagagacagatttgcattttatcaaaatctttctaaaaataatgcattaaactatgggcattctaaatttttttctttaatcagcatcattttttctaaataaagaacccccaatatataaaacgaaagcagaatttctatgattaaagtaagatggggtgtttggaacccatgacttgaacttctcacctcccctaggcaacccgtgagtctggcacagtaccgtgaagcttcaagtcatgcaattttaatgcatccccttaattcaaacaagcaatgctggctagccaaactaacaagagcagtgtttcatagcagaaaatctttgtgtccttccagctagatcccatggttatctgcctttttttttttttttttttttttttggaagagctggccatgaatcaaagatcactttttgttgtggctcatttactactataaaagattccttcgaatgcctcattcctcacttgctgaattttatgagtgccaagctgtctgcaagaaagcatttccttcctcttaacaacagcaaatctgttttgtttgattctcccttaaaattgattaatattttaattttcttacttcttcattcccagatacaattgctatacaagaaataagtgtgaatactgaacaactgaaaaaatggggtggtataggcagaagtaaatgggtctttggatgcgttgctgtaatagagaagtaggacagtctagagggggtaaatgtcatgatcaaagacagattcagatttgaaggatcaaatgccaaagaaacagagaatgagaaaagaagcctgcttccaaaagaataaagggtgacgggttaaattacaggcagacgctcatcttaatgatgtgcttcagtttattgcacttttcaaatactccagtttttttgtgtgtggtttttgttttttgttgtttatttgtttctacgaattggagttttgtggcaactctgcattgagcaagtctatcagagccatttttccaacagcacgtgttgactttgtttctctgtgttgcactttggtagttctcacaatatttcaaattttattattattatatatgttatgatgatctatgaccagtgatctttgatgttactattgtaattgctttggggcaccagaaactgtgccaatataagatggtgaacttaacaaatgttacgtgtgttttgactactccataaactggccattcacccatctccctccgtcttctaaggcctccctattccttgagacacaacaatattgacattaggccaattaataactctacattggtctctaagtgttcaaatgaatggaagttacacatctctcactttaaatcaaaagctggaaatgattttgcttagtgagaaaggcatgtcaaaagccaagatagaccaaaagctaggcctcttgggctaaacagttaaccaagttgtgaatgctgaggtaaagttcttgaaggaagtttaaagtgctacttcagtgaacactcaaaggataagaaagcaaaacagccttattgctgatatgtaggaggtgttagtggtctgtatagaagattaaaccagccacaacattcccttcaatcaaagcctaatctagaataaggccttaatgctcttcaaccctgcgaagcctgagagagatgagaaagctgcaaaagaaaaattgaaatctagcagagatttgttcatgaggcttaaggaaagaagccatctccataacatagaagtgcaaagtgaagcagcaagtcctgctggagaagctgcagcaagttatccagaagatatagctaagatcactgataaaggtggctacactaaacaacagatttttaatgtagatgaaacagccacatattgaaagaagatgccatgtaggactttcataactagagaagagaagtcaaagcctggcttcaaagctccaaaggataggctgactctcgtagtaggggctaatgctgctggtgactttaggttgaagccaatgcttatttatttaccatttcaaaaaattccagggcccttaagaattaaactaaatctattctgcatgtgctgtagaaataaaacaacaaagcctgcatgacagtacatctgtttacagcaaggtttactgaatatgttaagcccactgttgagacacactgctacggaaacaaagaagattcaaagtattatcattcattgacaatgtacctagtcatcccaaagctctaaagaagatgtagaaagaaataaacgttttcttgcctgctaatacaatattcattctgcagctcatggatcaaggagtaattttgactttcaagtcttattatttaagaaatacattttgtacagctctagctgccacagatagtgattcttccaatggatttgggaaaagtaaattgaaaaccttcttgaaaggatttgtcatttagatgcccttaagaacatctgtgattcacagtaggtccaaatatcattaacaggagcttggaagttgattacaagcctcctcatagaagactttgaggagttcaagacctcagtggaggaggtaagtgtagatgtggtagaaatagccagagaactagaattagaagattagaagtggagcctgaagatgtgactgaatttgctgcaatctcactataaaacaaatgaatgaagacttgcttcttatggatgaacagagaatggtttattgagacggaatctactcctggtgaagatgctgtaaacattattgaaatgacaacaaaggatctgtcaaaagaaatgatttagaatattctataaacttaattgataaagcagtggcagggtttgagcagattgacttcaattttgaaacaagtctatgatgggtaaaatgctatcaaacagcattacatgctacagagaaatatttagtaaaaggaaaagtcaattgatgaggcaaagtgtattgttgtcttattttaagaggttccacagccactccaatcttcagcaaccaccaccctactcagtcatcagccatcaacattgagatgagaacttccaggagcaaaaagattaccatttgctgaaggctcagatgatcattagcatttttagtaacaaactattcttaaaaaaaggcatgcacatttttttagacataatgctattgcacagttaataggctatagtacagtgtaaagacaacttttatatgtgctgagaagccaaaaagtttggacttactttattgcaatattcactttgttgtagggatctggaatctggaaccatacctacaacgtctccaaggtatgtctatatgagggactcatgtggataggtaagtgtgtgtggttacctgtatcaagtacagaagacaaataagcatgtgtttccctccagagttcctggtacttgcaagttgatggttaccctggagggctgaacagggttggacagcaggcaggcactagggatggaagcagctacctgcaatatgttcttttggagtataatgaggccctttcctatttgctgtgctatgttcccagagcataaagtaagctgccagaatagcccaatctcaaggtggaatatggcagtcaccaacaagagcagcctggtcttcatcatagcatttgcccagctacgttaattagataatttgttttcaccgtaatgaagtgaggccagtgaccataactaacttgtgtgcattgaactgaagaagcctctttcaataatttacttgggaaataacaatgagcaaggagcacaaagcattcacaaaaagatagaataagaatagcagactttgcgatctccagcgtggctgttcctctgcttcttactcttcaggaatatacaatatccccctaagttgaagatgcaaggtcaggatgtggctgttccttcctggctttaagagctaaggatctatggtgtttcatgcaccttgttgaaaggtgaatttgcagtgggatgaaaaatgaatttcatcttatgtgccatccttggtacctgcctggaacactgctgagaaggggtcctaggctggttccaggctcagcaggaaagagtgcctggtcaatggattaacagcacccaccccaagcccagggcatctgtgcctgtttgcctgttcacagggcctcagcagaaggtgctcaaggtcactattactatactaaaactcgcctttacattgaagatgatgctaccaagaatgtttcacaaagacagtgagtgtttgtcacatgtacaattagtcaatgaattattatttgcagtgagttatatctaaatctagttccttcacattggtaggaaattctttattttctctgtaaatagccaaatcctgggaaacaaatgatactatactaagacaatctaagtcaaaataaatattaggcatttccaaaggcatattccttggcatacttcctagaatggttctcatgaatgataatgttagtttcatgattaagaaaattctttgaaacccagttgcccccatttcaagagtttccattgttaatttatattggaaaccacagtacctagcacacatcttttataatgatctttaaaatgagttctttaggtgtatggctgatttctagatgaatatattttcattttttcttctcttgctccttgatacttgagcctggacatctaactcacactaatgtgaatgtaatcctaaggtgaactcattcaatgttaaaatgaggtgatactgacatgctttcaatgaggcatcagatctttgatcatcactgtaaggtccctaaaggaaagttccttaatcacattggcccattatctttattaagaggctctgggcaccactaccttcaaacaagctctgagaaataggatctgacttctggggatcagtaatgtcagtaaatgtcaaactgttccctttctcctaatctcacctacatgatgatgatttaattatgaaacacaccttgggcttttcagtctagatttttatatatttattttgcatggagagtagtgtttccttatgataccaaaaaaatatgcaaatagaaggacataaaatatataggagaagtaaagccattaaaaatatctgttagccaataaactgataaaaaagatctcaatacaacttctgtttcagccttctgatgtgttgagataagaaaggaaaaaagaaagagctaaggaaggcataaaggcaagtagggaaccaggaaaggagtaagggaacagacaggaaggaacaaatgacaaaggaaaaaaggtcaaacgtgatttacttatttatttaacagacacgtagaaacttactccgtgcaccttaaaaaaattaactcattgaatcctcctaagaaattaacaggtagggctgattatcatccccgtgttacagacaaactgaggcacacagggaacaagcgttttgagtattttgcccaaggtcatacagctagtaaatggtagaacttgagttttaatacaggcagttcattgaaaataaatcacttcctttataaataaaaagcattaaatcaacacatttttgaagcgtataatctagagcaaaactataatgaacataataatagtcttctagtaaaaataaattttgtaaatgtaagtgatttttttatgatctgacatgagaaaaaccattataagttttaccaataccactttttcagctactttcgttcctaatcagcatgatgcttgtaagtgttatcaatagtgatctttaaatgcttcaaatttgaaattttaaatgtttcaaattttaacttggaagactaacactctgttatacataaaaagatgggaattataagaaaaaatgcacaaagcactttcagacaaacatgggtttatgctacggcatttaaaaacccctttttaaagttttcattttttaacttttactttttgataatcttaagtaaaacaataagttcattgcccttcgattttgcacttcctgtgcatttgttctaatgctattttcatcccttggaattagtcagattggattacaaaaggctagcactttaccaactgtgcttagcccttgaaatcttgaatctttctggctagtctgtcaattacatgattaaacctgataaactacatgcaattccacacaaaactgaagatcagagaactctccgattggctctaaatatattggcaaagtggagcaaatgaaaaaaaaattaattttgtctgatcaaataaaaaatattggtcaaaatagttccttgatgtaagaaacacgatttgaaaatcaattttggtggattataaattaataagtgattctaacaaagattttctcaggcattctgctaagaaagcagaccaaaatcaaacatctatcaactgttagagctgacaggagcttcggaatgaatcatttggctaaaaagctggccaagatcactggaagtcccaataaagtagcaaattaatcacagaatcctttgtacactgtaacaatccacatgttctctagtctacttcaatagagccattggccacaaatgtgtgaaaagtgtgatttaactacatggaaaagtctaatttgcacagagcagatttgacaagagcaatgatccaccatacttcgcctgagctatggttatatctaccttgatcttggagttgaccactaaccagggcttatgcagggagggcatctatatactaaggacaaagtaattttctctatataaatatgttagaatatttaagaaatttcatgtcattgtcctcacggttcagtgtccttttaaaatatgtgcaccggtatcatattgttaagaaaatagagactaaattaaattacgcaattttaaattaaaataaaaactgaattttgatcttaaccggcaagtgtgtccatttattaatgatgtcagctggtctttaaatgtgtctatcagcctattcattggtcattctacccacatgcaatcttgttcatttactaatgatttcagctgctctgtaaatgtgtctgcctattcaatccttatgaacaatacctttgatcacttaattcacataggtctttggagagaacaagccctgctactgacagtgcttctgcctaaatcaccccaagccttcgttaaattgacccttttatgtttaaagttgaatcttctccctatacccaaattgcgaaacatgatttccctggtgctttgcacttcacaatctacatttatagtaatgcctcagagacagtctggcattctgcagcttcctcacaataatgaaagcaaaactgagactgcacaccccaaactccggagcagcattatcaacaaaccttgctaggatcgtaacttccagaggtgaggggaggctggagacaaaccatagtcacacgagacagacaagtatcttcctcacaaggctgcatcacaagaagaaaacttcccattaaatgcatgatgtaagcaagtttggagacacaatgagtggtatatgctatcgatctatttcctgcacgctgaacacttgttggatcaagtagaaaaaataactgttaagttattcactatttttcatgtggctatgatacattcttatatgtttatgcagaagcaataaaatcacttgttgaggaagacaaacattcagtgttttccacaccaggaattatttctatcaaaagtttccttggaagcgtatttctcattaaattggcacattcctaaagcacaaccttctctttaccaagatactgttcctcttgtttaaagtactgatctcaaaacttctcagtaataccatttaaaccactgccactaatcaaagtccagctgcaaatgtgaagcatttacattggctgagaaaatacgttttgtgaaattttgtaacaaagcactgacattaaataaacatgacatgttttcaagcaagcatgcctttttatttataatttttcatatttttaatgtgtcctggtgttaactttgtctaaaaatctgctagagttcatgaacactgaagccttggggtatataagaggttcattagcttcttataatttttatcctttaaaaaacctgaataaatcatttatttattttaaatcactactaaattatcaatatagctatttcattttcaataaatcccttgccaaaagacaaaatcccatgtactagtaaataactgaataaacaaaagcagagcatgctgtaatttttactgctactataatcaacacaaaggcaacaagaaattattctacagtatcactctagccaaaacattttagaatcatgtgacatgtgacatttcttgggatgaactgatactaggaaatagccttttgtatctgtcttttttctttgagacggagcctccctctgtcgcccagtttggagtgcaatggcacagtctcggctcactgcagcctccgcctcccaggttcaagcgattctcctgcctcagcctcccgagtagctgggattataggcgggtgccaccgcgcccggctaattttttgtatttttagcagagaccgggtttcactgtgttagccggaatggtctcaatctcctgaccttgtaacctgcctgcctcagcctcccaaagtgcttggattacagacgtgagccatagcgcccagccttgtatctgcctttatgtctatctataggtactgggaaattgacagtgtttctcagcacctttccaaatatttctgtcctcctaacaaagagtaaaagtcctggtatagatcaatgatgagtatcatagaaataaacagaacactcagaaattgcttttaaaaatgagtgtttcaggttaacatcaatcacattgctttgttttgtttttgttttgtcatcattcatatattctcagcacaagcttgccctgagcatgaaattcttttagaaaaaagccctggggtaggtgttgacccactgacattaatgagaactccgtattctgagaaaatgcactgccgagggaaaggagatgagaacttggccacagatcacatcaaaagagtttagccaaagatttatgcaaagaaattttattctagagttggccgtgctctatagcgaaagccaagcttttagtgtgctgtattgggagtctggcttctttcaaactacaaaatgagcaaaatcaactctctttacatttcgaaaggaaatagcactcacactgacaacataggcattatttgagtccaaagttcattttaaataaatatatatggttaaacaaaatgatctgccttaagtcaacagaattatgacttgcgccaggagaaaataaaggaaagcagctgaggctgaaaagcccaggctggcgtttgggtgggaggtatgcctgtgaatgccgagccttgacagttcgctccgaccagttatgtaatccagaatacagcccgcgtggaaaaaaaaaagagagagagagagagactggtaataaataatggcttagcaggtctgcagttaacagaaaggaacatttaattaaatagtaaatacttgggaatacagatttggcttaacattaaacacagatcaggtagcaagtaattggaacaaatgtgtgggattttgcatatttggctttttaaagcttattcttaccttataaatatttttctcacttgacgtaaaatatattaaataaatctggtaattggaaagatcccattttgccattcaactgtaaacccagtagtctgaaataggctttccctcaaaaaaaaaaaaaaaatccaaggagaaggatacaagtgcccaacatactccacagatgtccctccattccgaagctaccaagacctaaaatgtcaacatttcataattaaaaggaaatagtccctctgcatcctcattaactatagcaacttttgaaaaatgacatttcctaccaaatcagctccaatttattttttgtcttttgtgggatactgcaaactcatttagcaagtcagttttgttactatagtgacagactcaacctatttaaactcacacggaggttttcccatggtttgctgtatttgggagcagcctcaatgtttgcacgaggcaaaaccttccttagaaactgaatctgtacggccgggcgtggtggctcatggctgtaatcccagcactttgggaggccgaggcgggcagatcacttgaggtcaggagttcaagaccagcctggccaacatggtgaaacctcatctctactaaaatacaaaaatgagctgggcatggtggcgtgtgcctgtaatcccagctactcgggaggctgaggcaggagaatcgcttaaacccaagaggcggtggttgcagtgagcagagatcgcaccactgcgctccagcctgtgtgacagagcaagactctgtctcaaaaaaataaaaaaaaagaaagaaagaagctgaatctgtacatatggcacactctagaaactatctgtgagagagagtacatttaaaaagagatttcagattcactcttcccactagatagttcacgttgtttttgaattcaacctgattctcaccacccaccccgccccagggcagtggttctcaggaggaagatggtggacactggttttgtatcagaaaaaactgactgacggtgggggcacaggagatgggggacacatgttcaaataacattgctttccagaaatcttattttgcatgttcactcacccctgttgcttttgaagcaacttttcctgaaggaagtgtaccaggtctcaggtgtcttggtgtgagccaagaagatgggaacagaattcgattccagggatggacagggaactatgcttgcaggaatccaagaactcagcattccaggtgtgaaagagtggattatgtgctatcttggctgtgcaactgggaaaatggcttggaggtggcggactgggaactgatttaagaaagtgaaaacctagtccgtagtggacaatgaagctataaattgtatggataagacttgggttttaagtcactggtttcgtttttcatgctgccctgctttatgtaaatgcttagcacgaataacaaactgtccattcattttaaatgttattatttctaaatgaaagatgttgtggaaaacttggagaagtgaaggtaaaaggggaagagagaagggtgaagggaaaaatgagtttccatggtttttattctgctttctcatcacatgtccatgtctggagtctagatactttttcttattttctttctggaaagggcagttagcttctgacacagttagtaccttcccttcttccgtatccctctgaaactcttcttttgccatgaaagctttttacacgtatgctcctttaatggtttttataataaaagaatagttgtttttgaaagccacagcaagcatcccatgttttcatctacaggatttgggattatggccgtccatgggcactgtcttaattatttcttaagacattgaggcaagaaagtgtcagtgattccacagcacagctatgttcttgatattatctaaaaataaaaactacagtatctttacatgtgtatgattttgcttttaggttcttatgttacagaattctggatctgaaattggctttcaataccttgaggttaagaatttccagaaaacattcatcatatttttttgagattctaatttgtttaaaaattatttaagagctaacgcttcactagcaatgcattgagaaatgaagaacatgctcagggaatctttagataccatctgaaatcttggatttgaaaaagtcccttcaagtcagattttcctgaaaatcactgtaccaaccttaaaaaacggggagcaccagtatttcaagaaccctctagagaaagggaatctgaattacaaaatcctcagataacacaattatttataagctgaatgaggagaaggcgcaaaatgatagctattcaatgtcaaaagaaatattttattaaaagaaaaacagaaagaaaagaaacagaatatgaaaaatagacagtctggattgttgaaatgagagggacaaagaaaacgtagacacaaacaggagtagcccaaacaatgaaaagcagccttgagacagaggctcaagattgacattacttggtgttttgtagttgctgtattgcaatagcatcatacaagggggtatgtgtgactcatgaacatatttctcattttacaagtgacaatcttgtattggtctaccattcagaggtcctgtattttttttatccaataaaatctctttttcttatgagtttgcaaaacaaaaataaagaagatttcattgaataaatacttaaattctacttatttatttcaaatcacaatttgatattttcatgctttctatgagaagtggctgaggaataaatggtttaatcccaaaggggtaaagactgctaattctgtcgagaaaaatgtaagctcagtgtcttagtctgggctccccacaaatagagaaaagtgcttggatgcaggtagtttacaagaaaggcatggaaacaacctaagtgtctgcccataggtgaatggataaagaaaatgtggaattggaattttacaatggcattttcaatggaacactatttaaccttaaaaaagaaggaaatcttgccattgtgacaacgtgggtgaacctgcaggacagaatgctaagtaaaacaagctagacacacaaagacaaataatgcatgacctcacttatatgtggaatctaaatagttgaatagagagtagtgttggttaccagagcttgggtgtggggaaaatgaagagctgttggtcaaagggtacaaacttgcagttataagaggaataagttgtggagatctaatgcaaaatttggtaactgtagttaaatagtaacaatgtgttatatacctgaaatttgccaagacaatacatcttaactattcttacatgcgcgcacacacacacacacacacacacacacacacactatgtgaggtgatggatgtgttaattagcttgattgtggtaatttcataatgtacagatatattaaaacatcacagtacacaccttgaatgtatataatttttatttgttaactatatctcaacaaagttggaaaaaatgaaagagaagtgaaggagcaggaagagcaagatggagagggagaaaatccaataaagagtccacaatgtaggttgcagctgtgaggatgcctctcagagctgaagggaaaaaaaagcacacacacaccagctgccatccgccactgcctgagagctgtccctaggagtattaactcccttgtgtttcttctcagctgtgcctgcctgtatctggggctgaaaagggcttctgtttcttaccaaaaaaaaaaaaaaaaaaaagaagaagaagaagaagaagaagaaagaaagaaaaaatcctaaggcagaaaaacagagagaggaacagagggtgattgaggtggggtgcaggtggcatgcacacagattcttcaccacagccatagttaaagtcagaagtgggcccaggagaagaatggaggacacggaaagcatttgcgttggttcatcttcacatggcttggatctacagaggccacctgataaactttgtcacctattcaaagaggtggccagcataatccctaacaaacacacagtaaatagtaggacaagcaaacatcccactgcacagctagtaccaaggtcaacactagactttgtcctctcccccttcactccctgctttcttccctcagccagacctttagctgctctgggagcttgccagattagatgacactgcctttcacctcttagggtctgagtacctttggtggctctggttagttgctgcagttgcatgttgactattgtcactgacgatgggagcaccaagaggtgatcccactgaacacaagttctagattatgcctccctgtcgctgctccctgtaacaccatctctagctactcatgatgattgtggttatttctcctggctgctcactcctttctttgagggttgccctaccaggatgaggatcccaaagtgaccagagttgtaattgtagcttcaggttggttgattgcttaccctgtccttggaatctgagacgtctgatccagcaaaacctaaaatagtggagctgggactcgtaaattctgcaagtgggctactaagagttttaataaaggacaccaattgtatttccactctttgttcccagacccatgttgttggctattagagaccagctataggagaccacataatgttattgaatatttactgtatatagtctattttggagaacagagctacctttataagtgtatcatcctgaactggttttttagctgagcctttaataagtcacttaatatggattatggtagaaaaaatgagtcccacagtcacatgccctctgtcacacttctactgctgaataaaatgagtccctgagtccaagatgatgttattcaggatcccatatcagtaaatcaggcattctcaaagcactctgataatggtactattcaacagagcatccagaggtggttcctgcaatcagtattgtgacagaaagcaagagaaccaacagctctggagtaagagtgagggtgtacttctgtatttcccatacaaaaactgcctttggtaatttctattcttagtattagaaagaatataatcatcagatctgtggcctcataccaggcactagaggttatctttatttcagtaaagaagccatttgcataacaaatcttggcttaagtttctgtagtccaccatcatccaataaaattcaaatggttttcacagggaagtgaattgaatgggaataggattaggattactacctttgcaacctttagttctctgagagaggcctaatttctcttattaaacccaggaggtagtattgcacctgatttactatatttgctgataaagcaggttcagaaatctccacttggctttttctactataatcttttactccacaggatatgggaaaaacctgaggggtctgccagttgctaagtgtatttatctcaattatacacacagggaagtaactgagaaaattaccacagagtgaatcaatgtaccaactgagccctctgtgaaatggacttagaccagcagtccatttatcacatggtctttacaaggctctccctaactttgagccacattgatatttcatgtcccctagtattagtgtcagctcaagacctgcattcaacagctctcaaatgtctgggtgactttctttgcctagtatactcttactctagtaaatgcccagaggtctctttggaggagtatagatgtgtttaatgttggtggtggcattgcaggtttttcctcaaagaaagtcagtcttccctttaatctatgggacctgcacctgagaacagctaagatctagaaactgagtaagagatggctattttctgatgtaatcactaggcacagtgtacacatacccttctctt

SEQ ID NO: 603 - DNA, 40001 bp, Homo sapiens
ttttaccatgttgcccagactggtctcaaatccctggccacaagtgatccacccaccttggcctcctacagtgctggaattacaggcatgagccacctaccttgtcccgccatgtttttgtttgtttgttcgcttgtttttgagaggagtctccctctgtcctccagactggagtgcggtggcacaatctcaactcactgcaacctctgcctcctgggttcaagcaattctcctgtctcagcctccccctcctgagtagctgggactacaggcacccaccaccacacctggctaatttttgtgtttttagtagagacagggtttcaccatattggctaggctggtctcgaactcctgacctcaggtgatctacctgcctcagcctcccaaattgctaggattacaggagtaagccagtacactcagcccccaccatgtttttaattctatagaatagatgataaccaaggttcaccaaagcagagaggttaggtattgtacaaatttaagagtaagctagatcattcagaataaaaagaacctttactttctcccttggactcaaccccattatttcttatgcttttcctgcaggccaatacaatacttggccactgaatttagtatttttggcaaagcacataataataacctattgttagaatcttctagcacccaggtaacacctaattactttgaaattattatagttattattaaatacgcttaaaatcaaggatggaaaatgtcaaaattaaaaactttttccagcattcaacctctggtgagaaaagaaaaaaaacttttccaagcagccaactttgctttagttgttatacggggtgactagacagaaagcctatacaaaactctttcctgcaaatccatacggtatagcaactgaaaagcaatttacttagcaaacattattactgaatgaaatatgttgaagagtccagacgcagtggctcacacctgtaatcccagcactttgggaagccaaggtgggcagatcacttaaggtcaggagttcaaaaccagcctggccaaaatggtgaaaccccatctctaccaaaaatacaaaagttagtcgggcatggtggcaggcatctgtaatcctagctactcaggaggctgaggcaagagaattacttgaacctgggaggtggaggttgcagtgagctgagatcgcaccactgcactccagcctgggcaacagagtgagacgccttctcaaaaagaaataaaattcaaagaaacaggctgggctcagtggctcacacccgtaatcctagcactttgggaggccaaggcaggtggatcacgaggtcaggagttagagaccagtctggccaatatggtgaaaccctgtctctaataaaaattcagaaattagccaggcgtggtggtgcatgcctgtagtcccagctacttgggaggctgaggcaagagaattacttgaagccaggaggcggaggttgcagtgagctgagattgcagtgagctgagattgcaccactgcactccagcctgggcaacacagcaagactctgtctcaaaaaaaaaaagaaagaaagaaatatgttgaagaatgagatgctctatcaaatagcctcgttaatggttatgttcattataattggattatcaattgtcaaataattgaaatatgacaataatctccaaataccaaaattatggtgactctaatatattctttctgggtgtgcttctgggtcatgattaaaagtggtgttttttttttcttttttgagatggagtctcgctctgtcgcccaggctggagtgcagtggcgtgatctcggctcactgcaagctctgcctcccgggttcacaccattctcctgcctcagcctcctgagtagctgggactacaggtgcccgccaccacacccggctaattttttgtattttcagtagagacgaggtttcaccacgttagccaggatggtctcgatctcctgaccacgtgatccacccacctcggcctcccaaagtgctgggattacaggtgagagccaccaagcccggcccattaaaagtattaatcattgttgtataacagaaataaacagatgcagtggttcaacaaagacaaacaagtgcaattttatttatttatttatttatttttgagatggagtttcactcttgtcactaattttgtttttggttttgtttttgttttaagagagaatctcacttttttttttttttttttttttgagacggagcttctctccttctctcttgttgcccaggctggagtgcaatggcacaatctcgactcactgcaacctccgcctcctgggttcaagcaattctcctgcctcagcctcccaagtagctgggattacaggcatgcgccaccatgcctggctagttttgtatttttagtagagacagagtttctccatgttggttaggcgggtctcaaactgacctcaggtgatccacccacctcgacctcccaaagtgcggggattacagtcatgagccaccgtgcccggcccagagtctcactattttgcccaggctgaagtgcaatggcgcggtgttgtctctctgcaacttccgcctcccaggttcaagcaattctcctgcctcagtctcccaagtagctggtactacaggtgcatgccaccacacctggctaatttttgtatttttagtagagatggggtttcaccatgttggccaggctggtcttgaactcctgaccttgtgatctgcctgcctcagccccccaaagtgctgggattacaggtgtaagccaccataatcggcctaatttttgtattttttagtagagacagggtttcaccatactggccaagctggtcctgaactcctgacctcaggtaatccacccatcttggcctaccaaagtgctgggattacaggcgtgatgcaccacacccggcagaaagtgcaatttttaaaatgggcaaaggacttaaatatttctccaaagaagataatagtttctcatcatcagtcattaggtatatactagtcaaaaccacgatatagcacttcgtgcgcactaggagggctataattttttttttttttgagacagaatctcactctattacccaggctggaatgcaatggcgccatcttggctcactgcaacctctgcctccagggtccaagtgatcctcctgcctcagcctcccgagtagctgggattacaggctcccaccagcacacccggctaatttttgtatttttaggagagacggggtttcatcatgttggccgggctggtttcaaactcttgacctcaggtgatccgcctgccttggcctcccaaagtgttgggattacaggcgtgagccaccacacccggcatggctataattttttaagtgggaaataacaaatgttggcaaatttattatttgacccctccctcttacattgctggtgtgactgtgaaatactgcagccactatggaaaatagtttatctgttccttaaaaagcaattatagaatcatcataggacccaccatttctacttgaaacccaaaataattgaaagcagggattcaaacaaatgtttatacacaaatattcatagcagcactattcacaagagctaaaagatgaaaataacccaaatgtccaacagtggatgaacagttacacaaaacatggtatacacacattgagatattacttagccataaaaaagcatgaagtaggctgggcacggtagctcacaccttaatcccagcacttgggaggctgaggtgggtggatcacctgagctcaggagttcgagaccagactgaccaacaatggcgaaaccctgtctctgctaaaaatttaatttagcagggcatggtggcacatgcctgtaatcccagctactcgggaggctgaggcagaagaatcacttgaatcctggaggcagaggttgcagtgagccaagatcacgccattatactccagcctgagcaacaagagcaaaactccatctccaaaaaagaaagaaagaaagaaagaaaaaagcatgaagtactaatacatgaatgtggatgaaccacaaaacatacttgagcccaggatctcaagaccagcctgggcaacatggtaagccccccatcttagtaaaaactcttttttattttattcacttatttttttaaacaagaagtttatttaaacaacaagacttgaagggaaaactatctaggattcttttttgttttagagtaatttatccctacttaaagacagattgccctacatgtaacagctacgtagaaaaaagttataaaattgtccttggttttacaatgataaatgaaaaacagtaaaattctccaattgaacaaagtatgcaaggatttttattttttatttatttatttttttgttaaaacagtgagagtaaaataaattactggaatataaagagctgaatgagcatgctactaatggagaaagggggtattttcacagaatcagtatttttccccattccatctccacttgatgtcaatcaaaacataccattggctgtttagttaaaaaaaaatgcaatatgcttgtgcacatataccaattactttacatacaataaaggaatgggaaaaggggaaatgaaagaatagagaaaactatactgtagtagtcaggatgtggtggaaccaaattgcagttttctaattgagaatgtaatctcctcggtcttgaaagaacagagttctggagtaaagaagcaggttcctttttcagtagacacctcccgtctgctgttggaacacatcaattgtatcttcatcctccatttccaactgtgcaggtgtgtctgtttcattgattggttacctgtggaattgtaatctaatctgcctcattgacaatccctgtctttcacaataggctttcattagtttactaagtggtgtatgcctcttaatcttaaactgcatcacagaaccatctttccctgccaccgttaaattagtatgatcgtggttctcagccttgactccttccttgggcttttcgtcagctatggtgagcatcagagtctcctcagctgtagcttcacaagagaggtaccaggttcgcatggaacgagcaaaatcttttttttaaaaaaattaataataggccaggcacggtggctcatgcctgtaatcccagcactttgggaggccgaggcgggtgggtcacgaggtcaggagttcgagaccagcctggccaacacggtgaaaccccgtctctactaaaaatacaaaaattagccgggcatggtggcgcatgcctgtaatcccagctactcaggaggctgagtcaggagaactgcttgaacccaggaggcggaggttgcagcgagccgagattgtgccactgcactccagcctgggtgacagagtaagactctgtctcaaaaaataataataataataattatatatatatatatatatatatatatattttttttttttttttttttttttttgagatagggtctcgctctgtcgcacaggctggagtgcagtggtgtgatctcagctcactgcaacctccgctccccaggttcaagtgattctcctgcttcagcctcccaagtagctgggattacaggctcccaccaccatatctgaccaatttttgtagttttagtaaagatggggtttcaccatgctggccaggctagtctcgagtcctgatctcaggtgatctgctcacctcagcttcctaaagtgctgggattacaggcatgagtcaccgtgcccagccataaaaatgatttttaaaaagaaaggaatgaaggaaggaagggagagaagggaaggatctctctatgttgaccagactggtctccaattcctgggctcagacaatctacacacctcgacctcccaaagtgctggaattataggcctgagccaccacgccggtcaaaaagctgtctacttagggaatgttttgaaataaatggagcccttcaattctaccctgatagtcaacattttatctattagccagaccttcagagaatgacaaatgtagaccatataattttgtgtccgttcattgctgttatgccatcagcctatgttgagagatgttccaaggagctccaccatacaccatggtgcctgtagttaataacaatataatgtattcttgaaaaatgccaacagagtggatgttatgcattcttgccacaaaaatgatagctatgtgaggtaatgcatatgttaattagctagatcttgtcattccacaatgtatatatacagaatatcatgctacacatgataaatacaattttatctgtcaatttaaacaatgaaataaaaattttaaaggagctcaaaaaatctattttatttatctacagtgaccttgggatttcctgaaggaaaagcattggagtagaagtaagagctgactgtgaaagcctgaggaggagctgccttattgttaaggggtagcaagaagcccaggcgtggcagtccacgcctgtaagcctagcactttgggaggccaagatgggaggatcgcttgagctcaggagcttgagaccaccccgggtaacatagcgagacctcgtctctacaaaaaatggtttgttttttgtctgtttctttgtttgttcgtttgtttgaggcagagtctcactctgtcgcccaggctggagtgcagtggcgtgatctcggctcactgcaagctccaccttctgagttcacgccattctactgcctcagcctcccgagtagctgggactacaggcgcccaccaccacacccggcttattttttgtatttttagtagagacggggtttcaccgcgttagccaagatggtctcgatctcctgacctcatgattcacccgcctcagcctcccaaagtgctgggattacaggcgtgagccactgcgcccggcctggttttgttttttcaagacagagtctcgctcttttgcccaggctggagtgtagtggcacgatctctgctctctgcaacctccgcctcccaggttcaagcgattctggtgcctcagactcctgagtagctgggactacaggtgtgtgccaccatgcccagctaatttttttatatttttagtagagacaggatttcactgtgttggccaggctgttctcaaactcctgacctcaggtgatccacccgccttggcctcccgaagtgctgggattacaggcatgagccactgtgcccagctacaaaaaatgtttaaaactagttgggtgtgttagtgcacacctgtagtcccagttacttgggaggctaaggaaggaggattgtttgagcccaggagtttgaggctgcagtgagctatgattgtgccacactgcactccagcctgggtgacggagcaaaaccttgttcaaaaacagataaatatataaattaataataatacaaataaaaagagtactctgagcagtgcttggtgccacagctgggactacccagctactcaggaggctgagacaggaagatcacttgaacccaggagttgagttcagcactttgggcaacattgagagacctcatctctaataaataaataaactagaactctgaccgacaacctgcagccacctgcccagaaaatcaatcccttatctacaattaacagcacagggatccagcatgcttaactcagacttgcagaagccacactctatctctaaaacagttcgggatgctaaataacaccagctataacgactggcccaaaatggctaggaagaacttgattagtaactgacagcttccctggtttttatgctcacttccaacttaggaccaagcagaaaagtcaaatacacacccctaaccaatcacatcaggtgctttccttcagttagccacctacagttttcccaagccagcagcctccattcaggaccgacctgaagccttccctttttctgctataaagcttttctgtttcccctacctgcctttgagactctgcaaacacaagtgatggtggctgactgccttgctatagcaagcgctgaataaatagcctttgcttttctcagttggtcttcatttatgtctacagaagattttgaacagaagagtgacatgacctgtcttaggttttaaaaagatcagtgtgtggctgggcatggtggcccatgcctgtaatcccagcgctttctgagtgtccgaggcaggcggatcacttgagcccaggagtttgagaccagtctggccaaccctgtctctaccaaaaatacaaaaaaattagacaagtatggtggtacatgccggtagccccagcttctcaagaggctgaggtgggaggattacctgagcctagggagactgaggctgcagtgagctgtgatcacgccagagagatgatgttaggagccctgcaacagctacagagatggtgagggctggtcccattcaaggattcaatgtagggtaagagacaagagaaggatgactctaaggccttttttttttcctgcttacctgcttgttcacttacatttgactgagcagctgaagattagaatggcattaactgagagaagtcatggatgaagcaaggtagggaggaatgccatgatttgtttttgcagaaattaagtgggtttttgttgttgttgttgttgtgtgtgtgtgttttttgagatggagtctcgctctgtcgcccaggctggagtgcagtggcgcgatctcggctcactgcaagctccacctcccaggttcactccattctcccgcctcagcctccccagtagctgggactacaggcgcccgccaccacacccggcgaattttttgtatttttagtagagacggggtttcaccatgttagccaggttggtctcggtctcctaacctcgtgagctgcctgtcttgacctcccaaagtgctgggattacagacgtgagccaccgcgcccagccacacaaattaagtttgagatgcctgttggacttcatagtggagatgttgggcagaatctgggctcagggaagagatccaagctgaagatataaatataatatttgtccacataaagataattattaaagctatgagacaaaagagaaaaaatgcaaggactaaatacccattgttctgaaatatgttttttctgtttttctactcaataaacgcagatctgcctcattcttcgtaactgccgcatttgggagagaaatatcaatctgtttgtgcatccttttagtgttggggccgggcgcggtggctcacgcctgtaatcccagcacttcgggtggccgaggcgggtggatcacgagttcaggagattgagaccacggtgaaaccccgtctgtactaaaaatacaaaaaaaattagccgggcacggtggtggacccctgtagtcccagctactcaggaggctgaggcaggagaatggcgtgaacccggggggcggagcttgcagtgagccgagatcgcgccactgcactccaggctgggcgagagagcaagactccgtctcaaaaaaaaaaaaaaaaaaaaaaaccagtttgtgtttctttcttaaaagaaggaaaatataaagaaacatatgcctggcagctttgaaagaaagagaatattcttctcttaacaaggcattccaaggcctggatgtggctctgttaatacagagaagtaacaccttgaggaaacaaagcgtgctacttcacccccaaatcacagcggtaattaccttcccgatgttcatttgggtaaaaatcatccttcattagatttacgttttctgatgttggaatactaaattaggtagttgtcttcctaataagtcaccttgggtattacctgtgcattctctattcagatcagtggtctgggaataaaacgtaggagggagaaggggggaattcgggaagttagatagcgttggtggcaagatggaggagccacaggactgttctgaatgatgccaccaaaatgttggtttcataaaaaacaggctaataaatcctcttaacaagaatttaccaacactgaagttcagctttactatgctctgcaagacgactgcgttaatttcctgaggctgccgtaacaaagttctacaaagtgggtggtttaaaataacagaaatgtattctctcacagttccagaggccagaagtccaaaacgaaggtgttaacagggctgtactccctcaaaaggtgctagggaagaatgcttctttgcctctttcagcctctagcagctcccggcattccttggtttgtggctgcaggattctaatctctgcctccatcttcacatgactttctcctggtctgggtcctcctcttctttctcttataaacacttgtcattgggcttagggcgcagctggataatgcaggatgatctcatctccagatccctaacttgactacatctgcaaagacccccctctggcacccaaactggagtgcagtggtgccatcacagctcactgcagcctcaccctccccggctcaagtgatcctcccatctcagcctttttttttttttttttttttttttgagacagtcttgctctgtcacccaggctggagtgcagtggcgctatctcggctcactgcaacttctgcctcccagagtcaagtgattctcctgcctcagccccttgagcagctgagattacagaagcacaccacacccgggtaatttttgcatttttagtagagacagggtttcaccatgttgaccaggatggtctccaactcctggcctcaggtgatccgcccacctcggcctcccaaagtgctgggattacaggcgggagccactgagtctgacctattttttaatgttttcattgatatgtcatagatgtacccattttcagagtgcacatgataatttaatacattcatataacttgtaaagataaaatcagtgtaactgggataaccatcaccttaggaaaaacccgttttatttctaaatttcatttatttatttatttatttatttgagacggagtctagctctgtcgccgtgctggagagcagtggcgcaatctcgcctcactgcaacctccgcctcccaggttcaaacgattctcctgcctcaggctccggagtagctgggactacaggcgccccccaccacacccagctaatttttgtatttttagtagagacaaggtttcacaatgttggccaggatggtatccatctcctgacctggtgatccgcctgccttggcctcccaaagtgctgggattacaggcgtgagccaccgcgcccggtcttaatttttgtttttttttagtagagatggagtttcgacgtgttggccaggctgctctcgaactcctgacctcagatgatctactggcctcagcctcccaaagtgcttaaattacaggcgtgagccaccgtgtccggccaaaagccattttaaaattgtctttctctgtaattactggttcatccgaagcatcatatgaaaagtgttttctgttgaatgtgacactctttaaatttaatttctatttctttcttttcttttcttttctttttttttttttttttttgagacggagttttgctcttgttgcccaggctggggtgctgtggcgctatctcagctaactgcaacctctgcctcccgggttcaagcgattctcctgtctcagcaccctctccccgcggtcccccccgcccccccccccaacccgagtagctaggattacaggcacatgccaccacgcccggctaatttttgtatttttagtagagacaaggtttcatcatattggtcaggctggcctggaactcctgatctcaggtgatccgccagccccaaagtgccgggattacaggcgtgagccaccgcgcccggcctttaatttctatttctaagcctgtggatattcacttttgcaatgctgcagcagttttcaaaaccagagtctaaattcattgcagaagtccagtaacccctggtgtgcttgatggcaatgtccacgcggacgcttctgttctgtaatgatttactgacaacgtctgccctgtgtgaaccaacgggcgggcaaggcgctgcagggagggactccaaagacacacgcgcgcagccctcctcccgcccgcagcccttcagctgctacagtggccacagctattccgaggtctattccggcctcgccgccgtggcgaggcttgcgcatgcgcactgggcgcctgaataatggctcaggcgccggccctgcctgcgttgcccgcaggccggagtcccccaccctgctgcgggtttatcgctccagctcatgctcatactcctttgtaccatgggattttacttacaaaacaagttcaacgataaaataattaagaattttaggagtgcaggggccgggcgcggtggctcacgcctataatcccaatactctgggaggccaaggcggtgaggatcacttgaggtcaggagttcgagaccagcctggccaacatagtgaaacccccgtctctactaaaactacaaaaattaggtgggcatgatggcgtgtgcctgtaatctcagctactctggaggctgaggcaggagaatcgcttgaacccaggaggcagaggttgcagtgagccgagatcatgccactgtactccagcctgggtgacagtgagacctgtgcaaaaaaaaaaaaaaaaaaaaacagcagagcattgaaccaggcgcaaaggcctttcttagagggggctgtcacatgcccatacagttatgtgggcttaagctactcctatttccagaggagcaggcgaggcagttctagcagcctcatctctagtcttgcatccgtggagtcagccggacaacataatgcttataaccagccttcttctagaaacatgtttcaatgtaaagtggtcttcagatgaaacaaaagggaactgggtacctgtgtcctttaaggttatggagattcagccacttgttgactgagcgcccttgggcaagtcccttaacccctccaggccttggttccttcatttgtaaaagaatatagcattgtaccaatgttaattttttggcttggatcattgaaagttggctatgtaaaatgttaacatacaggaaagccaggttgtgagaattgtgtatagtactgcatttttgcagcttctctgtttcaggggcagatgacttggaaaacaaggagggcctcccatcttgtattaggtttagaatgcactggcactgataaatcctgacttctactcaaggttttgttgtaaactaatgtgtcctgctgggatacactgcttaatttctaatcccttaccttagaaaactgtggatattgaattagattttttttttttgagacagcgtctcactgtgtcacccagcctggagtgcaatggcgcaatctcagctcactgcaatctctgccccctggaggggatctcacttttttgcccaggctggttgtgaacttttgggctcaagcaatcctcctgcctcagcctcccaaaatgctacaattacagcctcccaaaatgtgagccactgcatccagccaaaaaaaatctcaagtgattctcctgcctcaccctcctgagaagctgggattacagacgcccgccaccactcccagctaaatttttttgtatttttagtagagatggggtttcaccatgttggccaggctggtctcgaactcccgacctcaggtgatccacccacctcgacttcccaaagtgctgggactacaggcatgagccaccacacccggtctagatatcttttttttttaattagatttttaatgtcctttctaattttaaaatgtaagaccaattaaagggtttctaggttctcctttgcctccttagctctttctattctattttgattttttctttctttttttttttttttcctgagatgatgtcttgctcttgttgcccaggctggagtgtaatggtgcgatctcagctcactgcaacctccacctcctgggttcaagtgattctcttgcctcagcctccagagtagctgggattacgggcgcgtgccaccacgcccagctaatttttgtatttttagtagagatggggtttctccaggttggccaggctggtctcgaactttcgaccttagttgatccacccgccttggcctcccaaagtgctggaattacaggcttgagccactgtgcccaaccttgattttttcttttaattcatgcttccagccctccttagctatgttgtcctcttattttgtatccactcagtacatgctgagctcatccagagttagtacttagcagtatccatgagtactgcccttaggaaagggcccgtttctaccctatccagttggaagaaggtacctgtcacccagagctctgaccccagtcatctttagctaaactggtgtctctcaactttgactgcatgttgaaatcacttaggaagattttaaacttgctggtgggccagttccatccccagagattctgatttgatagatctacatgtgaataggccagactcccacttttttcttttttaagagacagggtcaggccgggtgtggtggctcatgcctgtaatcccagcactttgggaggccgaggcaggcggatcatgaggtcaagagatcgagaccattgtggccaacatggtgaaaccttatctatactaaaaatacaaaaattagctgggcgtggtagtatgtgcctgtagtcccagctacttgggaggctgaggcaaaagaatcggtcgaatccaggaggcagaggttgcagtgagccgagatcgtgccactgcactccaggctgggtgacagagagagactccatctcaagaaaaaaaaagagagacagggtcttgctctgtcatccaagctggagtgcagtgatgtgatcatggctgactgcagcatcaaatttctgggctcaagcaaccctcctgcctcagcttcccaaatagctagacctacagaccaccatgcctggttgattttattttttgtatagatgggatctcacttttttgcccacgctgattgtgaactttgggctcaagcaatcctcctgcctcagcctcccaaaatgctgggattacagcctcccaaaatgtgagtcactgcatccagccaaaaaaaatcttaagaactattttattgtgatataattcactcaaatactacacaatgcaactgaagtgtacaattcaatgatttttagtatagtcatagagttgtcagggaattaaatttttaatttttgttatacaggggtacaaaatgtgaaagaaccaataatttccatttgattatgataagtttttcagattttttttctctagtcctgttctcctatacaagtctggttgaaggaatgaaggtaattaacagtgataaacttacctttaatgaaaagaagtgtcattaatgagaaaaaaaaaaaatcagttttctctcaatgctcattcatcttccctgaaaggacagaatgcttccaaatggtgatgattcattccaaaatgtatatgctctgctttatgtactctttgattaatccataacaatcgattaccattgcttactttattattaggtttccccagcaccattacactcctgactaatgaaaatactaagaagaatctattagtagcatgcacaatatcattctagctaatgctgaatcgctaactgccttcaaaatttgaaggcatggtcttacaatgtatgggacctctacaatatataacgagtccatataaagtacttagaaaagggcatagcaccaagtaaatgttcagtgaatagtgcgattacatcatcaaaaccaggacactttcaagagtaaaaggggacattcaatgtatttgctgttattttattacacagcatctattttgcataattaaaatgataatacaaacaaatggtgattttaaacaatttataattaaaccatggaaagaaatctcacataagttgtttaatttttttcattagaataaaggcaactgctgggtgtgatagctcatgcctgtagtttgggaggccaaagcaagcagatcacttgagccccggagttggagaccagcctggataacatcgcaaaatcttgtctctacaaaacagacaaaaatgaggatcgcttgagcccaggaggttgaggctgcagtgagccatgtttgagccactacactccagcctggataactgagcaagaccctgtctcaaaacaaaacaaaacaaaataaacaaacaaacaaaaagaattaaggtaactataaataaatagagcaaagattgtcattttgggttgctgcttttgaatcacactatacccctcctgccctgatgaacacatgtagctatcaggtttttttttttctgagacggagtctcactctgtcaccagggctggagtgcagtggcatgatcttggctcactgcaagctctgccttccaggttcacaccattctcctacctcagcctcccgagtagctgggactacaggcgcctgccaccgcgcccggctaattttttgtatatttagtagagacggggtttcaccgtgttagccaggatggtctccatctcctgacctcgtgatccacccgcctcggcctcccaaagtgctgggattacaggtgtgagccaccgcgcctggcctgatagctattagttttaaacagccaaagcctggcgtggtggctcacacctgtaatccctgcactttgggaggccaaggcaggcagatcacttgaggtcaggaattctagaccagcctggccatcatggtgaaaccctgtctctgccaaaaatacaaaaattagcccggcgtgttggcgcatgtctgtaatcccagctagtcagaaggctgaggcaggataatcgcttgaattcaggaggtggaggctgcagtgagctgagatcacaccacttcattccagcctgggcaacagagtgatactctgtgtcaataaattaataaataaataaatagccaaaataatagatgtctgtgaacctggttagttcttctggagtcatacattcaagcaccagttggtctgcagaaatgccaggctcttacacatttggatttctggtgcaattcatctgtcactttttgacatgtggtcaattttatgataattgaagtttaagaggaatttgtagaaaataggtctttgtacttaaggtgtaaggaaataacacacaaatgaattttcccagttccagaagcttttatcatcaaaatttctggttattttagatggaaatttttctatatgtgtgtctcataactgttttccaagagagaccaagtctctcttttagggagtttcatttcacatcctgaaaaaatatgcatactagtgggtacagtgtgttggacttccaggcaaaagaaggcagagtgctgtacctaccaactgcatgccaagaatgaatgccttcctccttgacagacatgactgcctttgtttcagtcccagtcagggaaggagtctctggaatcagcacctcacagattccctcttcatggtattctggcctgacagctttgtcctcttctatacggtgacttctgacagatgcaatccactttcacagcacatgactgagcatacccaagcctgggcaccagttttgaatgaccatatgtaactttatcctttttcctcccactcaagaaaatatagtggaaagcaagtaagagtcatattactgtataaataacctcaaatctgctctgattttttgttaaagcaagccaacatgggtatatttgcaaacttgcatatactctctcttttttttcaagacagggtctcattttgttgcccatgctggagtgcagcgatatgatcaccactcactgcagccttgacttcctgggctcaagtagatcctcccacctcagcctcccacgtagctggaactataggtatgcacaccacccctggctaatttttgtattttttatagagatgggggttttgccatgttgcccaggctggtctcaaactcctgacctcaagtgatctgcctgcctcagcctccctaagtgctgggattacaggagtgagctaccatgcccgggtcataacttgagtatattctcgaaaaaacaaaatatttgtaaaattaccttacaacttattatgacacaccagtgcatgctgtcactccatgacacataaatgttgtcccttatattggatctgcagtgagaccacctttctcttttattcccagaatgttaatttattatttattcattcatttgctagttcttttattcatttcacaaacacataatgagtatttaccatgctaaatgctaaggatgcatagatgaccaagaccaaaaatcctctgctgccaatgagctcatatgtactgaaggaagttagatatatcaacaaaagaaatcaagatgtggctgcgtggtgactcatgcatataatgctagcattagggaggcagaggtgggaggatcacttgagcctggaagttcaagagcagcctgggcaacctagcaagatcccatccccccgcccccaaaaaacagcaagatgtatgtgcatatatggatatagatatattgtagatcatatatctgccagatggttagagagggacaactgacaaccactgctatgtaaagatataagagaacagaagggtctacagctcacctgacggggaaagggtggtcagagagaggctgaatcttaataaatgtaacactttgtcagatatataagagagggcagtccttctggtcggtgccatggccaagctctgcagccagtgtgctggtctgaagggccagcggtagcaaattgacttacaccttaatgtaatgggaagatacaagggcacgtatataggctgggcacattggctcacgcctgtaatcccagcactttgggaggtggaggtgggtggaccacctgaggttggaagtttgagaccagcctggccaacaaagtgaaaccctgtctctactaaaaatgcaaaaattagccgagtatggtagcgcatgcctgtaatcccagctactggggtggctgaggcatgagaatcgcttgaacccaggaggcagaggttgcagtgagttgagatcatgccactgcactccagcctgggcaacagagtgagactgtctccaaaataaataaataaataaataaatacaaataataaaataaaagaaatttttttaaagaaagatgatagggctgggcacggtggctgacacctgtaatcccaacactttgggaggccaaggcatgtgggtcacgaggtcaggagatcgagaccatcctagccaacatggtgaaaccccatctctactaaaatacaaaaaaattagccaggcatggtggtgtgcacctgtaatcccagctactcaaaaggctgaggcagaattgcttgaacctgggaggcagaagttgcagtaagccaagatcacgccactggtgccactgcactctagcctgggcaacagagccagactccatctcaaaaaaaaaataaaaaataaaaaagaggatgttaaggattagagtccccctcttctctgtcctctctttctcagccccccttcacttatatacactttttctcccagctcaatcacctctcagaagcagcctgcttaaatcttattagctttgatctgacaatatagtcatcattgaattacctaaaatttctgagttgcaaaaatacttcttccccacaaagacttatacatgaacattgctggcaggattattcataaatagccaatggaatattctttagcataaaaagaaccaatctactgaaacttgcaacagtatggatgagcctcagaagaattatgctaaggaaaagaagccaaatacatattgtatgatgtatatatctacctatttttataaaatttctagaaaagaaaaatctatagtgaaagaaagcagatcaatgctctcctggggctaaggttgggagagggattcattgccagtgagcatgtggtaactttttagggtgatggaaatgttctaaaacctgattgtgggattggttgcacaaccataaatttactagaaataatttaactgtgcacttacaatacgtaattttttttttttttgagatggagtttcgctcttgtcacccaggctggagtgcaatggcgcgatcttggttcactgacacctctgcctcctgggttcaaatgactccctgcctcagcctcctgagtagctgggattacaggcacctgccaccatgcctgactaattctgtatttttaatagaaatggggtttcactatgttggccaggctcgtcatgaacccctgacctcaggtgatccacccgccttggcctcccaaagtgctgggattacaggcttgagccaccatgtctggctacaatagcacataaatcatatgtcagtgagactatttttatttatttttatttttatttatttatttatttgagatggagtctcgctctgttgcccagcctggagtgcagtggcacaatcttggctcactgcaagttccgcctcccaggttcacgccattcttctgcctcaacctcccgagtagctgggactacaggcacccgccatcacgcccggctaattttttgtctttttagtagagacggggtttcaccatgttagccagaatgatctcgatctcctgaccttgtgatccgcccgcctcagcctcccaaagtgctgggattacaggcgtgagccacggcgcccagcctcaatttttttttttttttttttgagacggagtctcactctgtcaccaaactggagtgcagtggtgccatctcgtctcactgcaacctccacctcccaggttcaagctattctcctacctcagcctcccgagtagctgggactacaggtgcaggtgcgcaccaccacacccaggtaatttttgcatttttagtagaggtggggtttcaccatgttcgccaggatggtcttaatctcttgacctcatgatctgcccaccttggcctcccaaagtgctggtattacagacgtgagccaccgcacccagctcagtgagactatttttaaaatgtactgcccagcccacttccctgcccttttaagagaatgtattaaacataattgaacctttttcttcagggtcatcagcataactatgttgtattttcagtatagtaaagtgattcagtgatggttgggtgattcctcagcaagttgcagaacctccaaagcttcagcttcttcatttgtgaaatgaagatgataagcatttctagcacatagggttattaggagaattacaatgaaacatgtataacacttagaagagaggtaaagaaaactcagtaacagtagctgatagatgctgatgatgacctaccatgcttcattttgcagatgggagaaaagggagaaagtggtagggagatgccaaaaaatccaagatgttaaaatcaaaaacaactctctgaggcatgtcagtttatgttccctatgatcttcctggctttcctagtttcataactacttacaaatcatttatgcatggggcgtttatcaaaaacctgtgatgtgccaggcacttttctttataggatctctttttaatccttgtagcaatcttgtgtgatcagctactttaccaatgaggactcaaggtttgaagacaagtcctgcctctagtaagtgatagtcttaaatcaattctgagtttgcctgacttcaaaactcacactttccattataacaatagagtaagaatggtgacagtggctaatgaacctgcaaaggggacttttcttttggtagagatggagtttcactacgttgcctaagctggtctcaagctccagggctcaagggactcctcctgcctttgcctcccaaagtgctgggattaaatacaggcttgagccactgtgcccagccaagggaacgtttttgaatcaatactttaattttactagaaaggggccaggcgcggtggctcacacctgtaatcccagcactttggaaggctgaagtgggagaatcacttgaacccaggaggttgagactggagtgagccatgtttgtcccactgcactccagcttgggcaacagagcaagaccttatcaaaaaagaaaagaaaaggaaaaaagggccgggcacggtggctcacacccagcactttgggaggccgaggcgggcggatcacgaggtcaggagatcgagaccatcctggctaacatggtgaaactccgtctctactaaaaaacataaaaaattagccgggcgtggtggtgggctcctgtagtcccagctactcgggaggctgaggcaggaggatggcatgaacccgggaggtggagcttgcagtgagccgagattgtgccactgcactccagcctgggtgacagagcgagactccgtctcaaaaataaataaataaataggaaaaaaaagagagagagaggaaggaaagaaggaagggagggagggagagagggaggagagagagaggcgagagaggaaagaaagaaaggaagaaagagagagaggaaggaaggagggagaaagaaaggaaaaataataataaatttaaaaaccaataattttactagaaaggccaatgatagagcaatgtagtggtttagagaaaatcccactaagatgaaggtcctgaaaaagatcctgctttctctctgctgcttcttctttttttttcgagatagggtctcactctgttgcccaggctggagtgcagtggtgtaatcttggctcactgcaacctttgcctcccaggttcaagcgagccccctgctcatttcttgtgaaatttccaccagagcacaccttgggggcaataattctcaaaatttccaggtgatagaattcttggacaaagaggtcctcattatgaacagccatgaaaaaactaacatacaaaagataatagatgttgtgctaaattaaatagcattacctatcgtatgctaaccagcaagcaccatttctaataaaaatgtgtggaagaaaaataaattttaagtgattagtgaattgttttttacaagttggtgaatcttattgttcaagggcatatggaagttctttgtacttttctttttttccttttttttttttgagatggagtctcgctctctcgcccaggctggagtgcagtggcatgatctcggctcactgtaacctccacctcccgggttcatatgattctcttgcctcagcctcccgagtagttggggctacaggcacctgccaccacgcccggctcatttttgtatttttagtagagacacggtttcaccatattggtcaggctagtctcgaactcctgatcttaggtgatctgcccgcctcggcctcccaaagtgctgggattgaaggtgtgagccaccacacccggcctagttctttgtacttttcttgacatttttctccaagtttgaaattattgccaaaacagttgaaaataatcagcatgtaattttattgctttatcaattaaaaaaacttaaaatttaatctaaatggaaactttactataatactaagatttagcaaccctgtgtgatcaattatgaatgtgcttcatgaggtcagaggccagaatatcaaagatttgtatttaatgtttatgatcaacctccaacaaaaccattttctccctgtattagagtttactccattgctgactcctcattgaacactttgctgcaccaacccaaccaactcagagggttagagaattgtttgagacccctcctacaaaaattaaaaaattagccagctgtggtggtgcacacctgtagtcccagctccccgaaaggatgaggcaggagaatcgcttgagcccaggaggtcggggctgtcatgagctaggatcacaccactgctcttcagcctgagtgataaagcaagacgctgtctcaaaaaagaagaagaagaaggagaaggagaagaagaagaaggagaaaaagaagatgatgatgatttgctcttactgtagaccttagcaacctcagcacacttttttgtttttcctttccttattctttttttttttttttttttttgagacggagttttgctcttgttgcccaggcttgagtgcaatggcgctatctcagctctctgcagctcactgcaaccgccgcctcctgggttcaagcaattctcctgcctcaggctcccaagtagctgggactacagctgcccgccatcatgcccggctaatttttttttgtattattagtaaacagggtttcaccatgttgaacaggctggtcttgaactctggacctcaggtgatccacccgcctcggcctcccaaagtcctaggattacaggcatgagccaccgcacctggcccctttccttattcttaaaggaagcactttacagctctgctttgacatatctgaattgccagcattactactcttgcagtttggggccatgatgaagtaaaataagggtgacttgaacacaagtattgcaatctgttaaccaataaccaaacaactactaaacgactaaggggaaggtagcctctatggcgtctatagcatggagatgttggacaaagggagaattcacatccagtcaagatgtagcagaacctcgaaatatttcatcacataactcagaatggcacaaaatttaaaacttatgaattgaattgtttatttctggaattttccatttaatatttttgcactacaattgaccacagataactgaaacctgggaaagcaaaaccaaggtaaggggagactagtgtatccatgcctcagtaccaaactctttcacttactgtagtttcacaaaacattttaatgtctgttaaggatcccttcactccttttatttattttcagaatgtattatacattacattgaatagatgagtacttaatttcaagatacttcctcttcacattttaataagatttggtaagtactagagagactcaaggattgggggcaggaaaacaagggaacattcagatgttaattagctcaacctgtccccacagacactgcgagttgtaaaagagagaaaaggaggaagaaagagtttagagggaggaagggaggagacaagaaagatgaggttgggcactttcacctggtggcacttgcctataattccaacaatttgagaggccaaggcaggagattgcttgagtccaagagctggagatcagcctgggcaacaaacccagaccccatctctacaaaaaatacattaaaaaattagcctagcatggtggtgcgcacctgtagtcctggctactcaggaggctgaggtggaggattgcttgaccccagtagtttgaagctgcagtgagctataattgcaccaactgcactccagcctgggtgacagagtgagaccctgactcgcaagagaaaaaaacagatgagtttgcggtgttcccttcccctgcaacatggctcctgctaccccattccaccgaaatgctcttgacaaaggacactaggtttttctggttttgaaatccaatggactcttttcttagggtcttgtagatagtccccaaaagatagcagtgctttgctgatattcttattaacctacaaggtcagacccagtttgaatagcggcacacctcctattcctttgagttgagttcatcaccccagtccaagagaatctaatccagacacaatgatgtctgggtcacacaataatctctgcatttattttcatgcctcttcttccccttcgcatcttcccctccttacgtcatccttatttcttttctgcttgagtttgagaatggtacagtgaaggattttaaggaggggcagggtgtgggcacagaccgattgagcaccagggataaaaaatatttcccaagaatctccaacattcaccttgcagcatactttacctgagtatctctacagttgataaggtccatggttctgtgtctaatacaatgtttgaaagcaggggcactcagtatctgttgaataatcaactactcaattatgcattgcttgtaggtcagaattgctgcaacctttcatgataactgcaggttatcctcaagaactcatttctgcagaacctggcgaagcccagatttgatataaataagtgtagtttcattgacatttagtctagggcaagtgaagcaagtaaattacccaatgaggtgatttataaattcattcaactcaattctctgataggaagctaagcaacgtgctgtggtcattgggcctgatttatatcagaaaagtgtacaaaagaaaatggaggttctctatcttgctcttgtcctctcctggtctcctgttactatataacaggcatccttttcctttaattaccttcttcatggcttgagagctttgatgacttgattaagccttgcagtgcagttccagtccctacccatctgattaattagcccaaaccttattaacttcctaattctgatcaataaggcactgatgctcaactgtgcaagggcaaactaaggaggcaattttatttcaagacacagagtccctactacttttttttaaccatcttttctttatcttacattttaacaccagccaagttggaatatggtaatataagaatagtcccacgaagtcagcacacactctccagcactagtcacttggtgcaacagtcctattttggtgacattatttggaaattttgcgtgaagggcctctgttattcaggatatcaggcaaatgttgctctcagccaaagaaagagtatgacaacgatgacgataatgatgatgatgatgatgatcatgatgattcctgctctgcaggaaatggacaaaatatacaacaagaagcacctcttctccaaactcaaattcagaatggagttctccaacactgagagaatatttcaatattctagaccagcactatccaatagaaatattttaaattttctaatagccacgtttaaaaaattcaaaatcggccaggcacggtgactcatgcctgcaatcccagcactttgggaggccagagcaggtagatcacctgaggtcaggagttcgaggccaggctggacaacgtgatgaaaccccgcctctaaaaaaatacaaaaattagctgggcatggtggtgggtgcctgtaatcccaggtactcgggaggctgaggcaagagaatcgcttgaacccaggaggcggaggctgcagtgagccaagatcgcgccactgcactccagcctgggcgacagagtgagacaccgtctcaaaaaaaaaaatttaacattggggccaggcgcgatagctcacgcctgtaatcccagcactttgggaggccgaggggggtggattgcttgaggccaggagttcgagaccagcctggccaacatggtgaaatccccatctctgctaaaaatacaaaaattagcctggtatggtggagcacacatgtagtcccagctactggggaggctgaggcacaagaatccctggaacctgggagccaagatcatgccactgcattccagtctgggcgacagagcaagactttgtctcaaaaaaaagaaaaaggccaggcacgttggctcacgcctgtaatcccagcactttgagaggccaaggcgggtggatcacctgaggtcaggagttcgagaccagcctgaccaacatggggaaactccgtctctactaaaaatacaaaattagccgtacgtggtggcacatgcctgtatcccagctactcgggagaccgaggcaggagaatcgcttgaacccgggaggtggaggttgcggtgagccaagatcatgccattgtattccagcctgggcaacaagagtgaaactccgtctcaaaaaaataaaataaaataataataataattattatgcctttcttttgtaaaacatttgtcagaggatgtcacatttctcatattttcccaactctctgaaataaaactctgtctcaaaaaaaaaaaaaaaaagaaatataggacgggcatggttgctcatgcctgcaatcccagcactttgggaggcggaggcgggcagaccacgaggtcaggagatcgagaccatcctggcccaacatagtaaaaccctgtctctactaaaatacaaaaaattagccgggtgtggtggcacatgtctatcgtcccagcttactcaagaggctgaggcagggtaatcgcttggacccggcaggcggaggttgcattgagctaatatcacgccactgcactccagcctagcgacagagcaagattctgtctcaaaaaaaagtaacaatagtaataaattaaaaattaacaagtaaaattaatttaatagtgtatattatataaaccagtatctcaaaaataacactgtaacatgtaacctaaataaaattgctaatgaaccattgtgctttctttttccacactaaacctttgaaatcaggtgtatattttatactttcaacacatctaaattccaactagtcacatttcaagagctcaacagacagctttggctaatggctaccatgctggacagtatagttctagctcagggaatctcaaacttgagcatgtatcacctggagggtttattaaaacacacatggttggctccatccccagagtcactgattcagtagtctggggttggagacttaacatttctaataaattcccaggtgatgctgatgctgcttgttgggcaccccactttgagagctaccacctcccaggttcaagcaattctcctgcctcagactctcaggtactggggattaacaggcatgtgccaccacacccggctaattttgtatttttagtagagacagggtttcaccgtgttggccaggctggtctcaaactcctgacctcaggtgatccacccacctcagcctcccaaagtgttgcaattacagacgtgagccaccacacccagccttattctttatttaaaataaagacaaggtctcactatgttacctgggctggtctcaaactccttaccttggctgatccacctgcctcagccataaaccactgtacctggcccgaaattctaaaacttaaagaatagccaagactttttttttttttttgagacgagttttgctctttttgcccaggttggagtacaatggcacaatctcagctcaccgcaacctctgcctcccaggttcaagtgattctctgcctcagcccctgagtatctgggattacaggtatgcaccaccacgcctggctaattttatatttttagtagagacggggtttctccatgttggtcaggctggtctcgaactcccgacctcaggtgatccacccaccttggcctcccaaagtgctgagattacaggtgtgagccaccgcgcccagtcagaatagactagattttaacttaaactttgaaatcattttggcatttagtatatgctgataaactacttagtgctttcattatctgtctctgcagggaccatctgtactacccagggcagggaatacacactacagaagccaatgagaaaggcttcacttgcccaaggctccggggctgtgagggtgggcatgccagcacctagagctgctggtctcactctccaacacacgtctctcctctgccaccgccgtgtgcctttcccttttttgtcagtttaagaaactcattacaaataagtaccatttcttatctttgtctccagttcttttctttattaaacgaattcagtagataatgtgtgcacaaagttcagacatcacaaaagagtggacagagaaaaagtaatgcctttctatacctctgtttcctagttttcgccaactagttgccctcccaggaactcaacccatattaccagggttttgtatgtcttctcagagataacctattcataaatttgtatatatgtttttgtatacatacatatgcaattttatatatatatatatatatatatatatatatatattttttttttttttttttttttttttttttttggagacggagtcttgttcttgtcgcccaggctggagtacaatggcacgatttgggctcacagcaacctccacctcccgggttcaagcaattctcctgcctcaacctcccaagtagctgggattacaagtgcatgccaccacgcccggctaatttttttttttttttttgtatttttagtagagacggggtttcaccatgttggccaggctggttcttaaactcctgacctcgtgatccgcccgcctcagcctcccaaagtgccaggattacaggcgtgagccaccacgcctggtcagcaattttttttattattatttatttatttgagacagagtcttgctctgtcacccaggctagagtgcaacggtgcaatcttggctcactgcaacctccactgcccaggctcaagtgattctcacgcctcagtcttccaagtagctggaattacatgtgggtgccaccacacccagctaatttttgtatttttagtagagacggggcttcttcacgttggccaggttggtcttgaactcccggcctcaagtgattcacctgcctcggcctcccaaagttctgggattatggacatgagctactgcacccggcaggcatttatttttatttttatttatttatttatttatttggcgacagagtcttgctctttcgcccaggctggatgtagagtggtgtgatcttggcacactgcaagctccgcctcccgggttcataccattcttctgcttcagcctcccgagtagctgggactataggcgcccgccaccacgcccggctaatttttttgtatttttagtatagacggggtttcaccatgttagccaggatggtctcaatctcctgacctcatgatccgcctgccttggcctcccaaagtgctgggattacaggcgtgagccactgcgcctggctttattttttaaattgaaacacaaaaataggcttccggtccacatttcagtctaacctcatctctaagatgtgaaacaatcagtaatgagtcatatcataagcacaatttcagaacccacaaatacagagcacagcttccataaaatcagatacaatagaccaaccttttcatgtgaaaaatgagaaatatagaaagataagttgcaggggccaggcgcgatggctcacacctgtaattccaacactgggagtacaaggcgggcagatcaccagtggttagcagttcgagaccagcctgaccaatatggtgaaaccccatctctactaaaaatacaaaaaaagttagccaagtgtggtgcatgcctgcagtcccagcaactcgggaggctgaggtggaaggatcccttcagcctggaggtggaggttgcagtgagtcgagatcgcactgcactccagcctggatgacagagtaagaccctgtctcagaaaaagaaaaaaggaaaaaaagaaagataagttgcaatccaagtaatacaccttatgtttaggcaaggtaacttgagggttgagcagtgtttgacattttcattccagaatgcttttacgttcttgccttcaccatgatgtttttgtttttgcctctgcctttgaccatactgtcccctctgcctgaaaaggtgtccccttcccccagcccacctccttttttagcttattatagtcatttcaatattttctagaaaaaggcaggttcttgaattactgggtaaatgaggtttatatgtttctccagatgccctgtattgagcccaagagtcgtatcccaaaacattttgccaacagggtgtgcttactgtctggctgtgactgacacgatattccaccctccccctgcgcttgcttatctcttactctccctttgttactaagtagattattacactaacctgacaaagttgccatgagggtgagaagagataatggtcataaaagagttctgtaaacaaccagactttggaatagttggacagaaaggtgttggcagagtggaggtgggggaaaaagggtgtacttgtgaagacaaactcacagacagaagctccaattgctggctctgacattagcaactgtgtggccttaggcaagttctagaacttctccttcttcttctttcttctccttctccttcttcttctttttttttagagaaggggtggggtctctctttgttgcccaggttgaagtgcagtgatgctatcctagctcactgcgggctcgaactcctggactcagaggctccaactcctgggctcagaggctccttccacctcagccccctaagtagctaggaccacagccacacctggctccagcatgtttctcagcactttggttgttacatcttcaagactagagtcagctgctttctctgtgaccaccaagcgagtggagatggaggttcccaaaggtgttgaacattctgacgcccgtagaccaccccaaggtcaagtctttgaactggagtgcccatacccctggggtacacaaacactttccaagggttatgagaccttgcgtagtcttttttcttttttcttttttcttttttgagacagagtttttgctcttgtcgcccaggctggggtgcaatggcatgatctcggctcactgaaacctccacctcctgggttcaagcgattctcctgcctcagtctccagagtcgctgggattacaggcatgtgccaccatgcccggctaattgtttgtatttttattagagacagggtttcgccatgttggtcatggctggtcttgaactcctgacctcaggtgatccacccatctcaacctcccaaagtgctgggattacaggcatgagccactgcacctggtgagaccttacctagtcttaggggaattacctaccaaaccctttactttcgcaattactcagcttcacaacagctttacaaaagaaaaatgcacgtctcacccatccgaaggcagctgtgtatttgctccagggtggaaaggcctcttggagacccaaagaggaagactgttttaatgctcactccagttgccttaaatcctcagggcttgcatttcctggtcttctccctgtctaatcttacatctattaaaggagaaacatggccttagaaatgtggtattttggtctgtatcagatatttttattttacatatatggtagagtaagtagtggaaaaatgataatttttgtttgactttgctccttcttttcctgatcattagtcacagaatgcgtcattcctgagagacagtaccaagaggaaagggaaagagagttggggaagaactatggactgctaagaaaggctgtctaggccagaagaggtggctcatacctgtaatcccagcactttggatggccgaggcgggcggatctcctgaggttggaagttcgagaccagcctgaccaacatggagaaactctgtctgtactaaaaatacaaaattagccaggcgtggtggtgcatgcctgtaatcccaactactcgggaggctgaggcaggagaatcctttgaacccgggaggcggaggctgcagtgagccgagattgcaccattgcactccagcttgggcgacaagagggaaattctgtcgaaagaaagaaagagagagagagagaggaaggaaggaaggagggagggaaggagggaaggaaggaaggaaggaaggaagaaaggaaggaaggaaggaaggaaggaaggaaggaaggaaggaaggaaggagagagagaaagaaagagactgtctaacatttgaacatgagcaattcttttttagctattctcaatactcggtcctgggactccacactctagggtaggggaggggataccttcaaacaggcagaacaattgcattagtaaagctgattccttttaaatatgattagaaatttttttttaaactgcaaaattattcaaaacatactggataaaaccctcagatagagcttttatgttattctttcatatttgatgtgtgttattcttaaaagaggtaaaaattacattagcaaatcagatcatgacatttgctaattatagtcaatcctcattttatttcatcttgtaaaatgtttaatatcttctatctcctattaacctcgaacgaatttatatgctagctgccagatcaatttgttttgaggagagcatatcttcatcttccattaggcacatggagaaagtttaattatgatccatgtcaataagagacacattttcagtaggtttactttttctctttgtaactccttctcaaaatatgtaatatacttatgtgtttgtattagttatgaactaatagaataataatgcagaatagatttgttaacacttagctgcatcatggtcacagggaaaaaaactagttgagaattttccctttgatggaaaatttatttatttccataaaatttattgatttacgtgttctattgtcagagagacatgttctagataaaagaaatattagtaaagccaggcgcggtggctcacacctgtaatcccagcattttgggaggccgaagcaggcagatcacgaggtcaggagatcgagaccagcctgaccaacatagtgaaaccccatctctactaaaaatacaaaaattagccaggtgtggtggtgcatgcctgtaatcccagctactcagggggttgaggcaggagaatcgcttgaacctgggaggcggagattacagtgagctgagatcataccactgcactccagcctgggcaacggagccagactccatctcaaaaaaaaaagaaagaaagaaagaaagaaaagaatagtaataaagtggtttttttcagacagagtctcactccgtcgcccgggctggagtgcagtggcacgatctcggctcactgcaacctccgcctccccagttcaagcaattctcctgcctcaacctcccaagtagctgggattacaagcatgcaccaccacatcctgctagtttttgtatttttagtagagatgggatttcaccatgttggccaggctggaataaaattatttagacaaaaaaaaaagtaaaaatgtgtggagtaagtgaaatgcaatgttcaaagagaaaaggaataatgtaaaattttcaaatgttaaagaggagattacactgggtgcagtggctcatgcttgtaatcctagcactttgggaggccgaggcaggcggatcacgagatcaggagttcaagaccagcctgaccaacatggtgaaacctcatctctactgaaaatacaaaaattagctgggcgtggtggcgggcgcctgtaatcccagctactcaggagactgaggctggagaatcgcttgaacctgggaagcggatgttgcagtgagcagagatcacctcattgtattcaagcctgggtgtcagagcaagactccatctcaaaaaaaaaaaaaggagactactagtgtattttttaatggataatggtgagtattcaataattaatgtacagatattccactagatactttttatgtatgtatgtatttatttttaatttattattattatttttcagagacaggttctcactctgtcggccaggccggagtgcagtgatgctatcatggctcattgtaaccttgaactcctgggctcaagtgatcctcccacctcagcttcccaagtagctgggaccacaagcatgcaccaccatgcttgattaattctccatatgttgccccagctggtcttgaacacctggcctcaagcaatcatgccaccttagccttccaaagtgctgggattacaggtgtgagccacagtgcctgctctaattccactatatactttttttttttttttgacagagttttactctatcgtgcaggctggagtacagtggcgcaatctcggctcactgcaacctctgtctcctgggttcaagtgattctcctgaatcaacctcccgagtagctgtgattatagatgcacaccaccatacccagctaattttttgtatttttagtggagccggggtttcaccatgctggccaggctagtctcgaactcctgaccttgtgatccacccaccttggtctcccaaagtgttgggattacaggcgtgagccaccttgcccagccgatactttttaaagagtgtataaccatttcattttttaaagtcagtgtttacaatgtgccagaaaagtcatcctttgtaattatttgaacttataatgaacaaatgcagatgtcaactttaaagtggggagaaggcacccatggttttccaaggttatttttaggaggatttgagccaagccagctaagccgcacctgaataagggtaatgttagccaccctgtgagtgtggtgggctcaatcctcaccctcacctctgcaggctggactgggaaactggagaagccacccaagaccagacaaggccccaacccagcgtggtgtcctgatttctttgttatgagcgatgtatgtccagggcacagaggccagtttggtgcaaaatccagagactcagcaaagccgagcacaaccagaacctggggaaccggtagcatcttcaaggctgaaggcacaggggtggctgaggtgctggcaaagcatatcaagcccaggctagcatcaaacaataattttcataggtcaggtgcagtggctcctgtattcccaaaactttgcaaggccaaagcaggaggatcatttgagggaaggagttggaaaccagctgggcaacatagcaagaccctgtctctactaaaaataaaaaattagccaggtatggtgatgatcatctgtggtccagctatttgggaggctgaggtgggaggatcacttgagcccaggactttgaggctgcaatgagctataatcacactgctgcaccccagcctaggcaacagaatgagaccctatctcaaaatgacaataatatatatattttttgagacagtgtcttgctctgtcacttaggctagagtgcagtgacatgatctcagctcgctgcagtctcaaactcctgggctcaagtggtcctcccacctcagcctccctagtacctgggaccacaggcatataccaatatgcccagctaattttgtttattttttgtagagatggcatctcactatgttgcccaggctggtctcaaactgctggattcaagtgatccttctgcctcgtcttccaaagtgctgggactacaggtgtgagccactgcacccagctaataataataattttaaaaaatttatttagagacagggtcttgctgtattgccaggctggagtgcaatggccatttacaggtgtggatcatagctcactgcagcccaaatacctgggctcaagctgttctcctgcttcagcctaagtaaagggactacaggtacatcccacagtgcttggctttcgaataataatttaaaatacaagaagcactagcttgggaaacatgatgaaaccccatctccacaaaaaaatacaaaaattagccagtcatggtggcatgcacctgtaatcccagctactggggaggctgaggtgggaggattgtttgagcccaggaggttgaggctgcagtgagccatgatcacaccactgcactccagtctaggcatcagagcaacaacctatctttaaaaaataaaataatgtggccgggtgcagtggctcactcctgtaatccagcattttgggaggctgaggcaggcaggtcacctgaggtcaggagctcaagaccagcctggccaacatggcaaaaccctgtctctactaaacaatataaaaaaattagccaggcatggtggcaggcacctgtaagcccagcttctcaggaagctgaggcaggaagaattgcttaaacctagtaggcggaggttgcagtgagccgagatcacgccactgtactccagcctgggcaacagagtgagacttcatctcaaaaaataaaatacaataatgtaatataaaataaaatacaagaaacaaatgaaggcctggcctggcttttctttttaataataaaaaggcctgttgtgaaggcatggtgtgaagcctacacgagctagttcactcagacacctggtgtcccgtgcagcagctcagtccctgagacctgtcaggagtgagagccagaagtttgctcccagtggaataaggaaaagatagatagtgtagtctcaccctagtcctctggttagcatttcttcaaatagataaattataatcaagacaattgccctggacccagagtctcctatccactgggctactgggaaatgttttctgttgccaaaaggccaaaatcttgggaattaagttaagggctaagattttatcagaagcctaatcatttcacccagaggtacatgtatgggatgtactgggtgcctgctgtgtgccgaacggggcagggtgccacctttataaatgccgatgctcccgttgttccagcctcaatcctctttcccctctcttcacctccctggcaatctcaagctctattgctgttgttgttcttcttcttctacttctttttttttgaggcagagtatcactctgtcacccaggctggagtgcaatggtgcaatcatagctcactgcagcctccatctccagggctcaagggatcctcccacttcagcctcccaagtagctgggatcacaggcacatgccaccatgcctgattaatttcgtttatttttttgtggagacaaggcctcactatgttacctaggctgatcttgaaatctttggctcaagtgagcctcccttctcagcctcccaaagtgctgggattatgagttagccaccacacctggcctcaggctctcttctgactttaactatcacccagatgctgatagctcccaaatctacatagccagcctcaagagagccactgaacctcagactaggctgccagaaaggctgacaacacccacagcataactagtaaccagcagcctctttcaactattccttcctggaagccccacatcaaacctcatcaacccacttagagctgagaagactgaggttcagagagatcgagtaactttccaaaatccccttcctaatgagagtggctaagtcatgatggaaaccactttccatatcttcccaaagcccatgccattcactcgcccatccacctccactcccagtccctcacttctgcagctaccttgccctctgctttcctggcgatagtgggttgcttggcttccccacacacaccctgctgattcccggtttctccgcatcttgtgcaaagcgaacaatttaagaagagactggaatggggaaggcttccctgaaaaagaggcattcaagttggaaactaaaaataagtttcttaggcagagagcactgagggaggggagggagaggctgttccactgaagggctttcccttcatttgtgaaatgtatgtgtgtgaaacctccagtgtgcctggagggtgggaaaggagacagctccactggaagttggaaaggccacccaaactcatcaggctggctctgcatgcatgatgatgcctctggaattttcctaggagcaataaaatgccactgaaaggctgtaagcaatgggggctaagatcaggtttgtggttttatatttatttttatatttatttatttatttatttttgagttggaatctcgccctgttgcccaggctggagtgcaatggcgcgatctcagctcactgcaacctccgtctcccaggttcaggcaattctcctgactcagcctcccgagtacctaggactacaggcatgtgccaccacgcctggcaaatttttgtgtttttagtagagacggggcttcgctatattggccaggctggtctcaaagtcctgaccttatccgccggccttggcctcccaaagtgctgggattacaggcgtgagccaccgcgcccagcctttatttttattttttgagacagggtctctctctgttgcccaggctggagtg

SEQ ID NO: 604 - DNA, 40001 bp, Homo sapiens
taaatcctgagaacttgactccttagagaaaggggacacacagacaaatttcttgggttcagggggtttaaggaagatgaagtgatcccactcacccctgacactgtgaaaatattcaaatacacacagggctagcagatgaagagaagaaactcagagaggagtagtcaaaaaaaactatggattttgtggtctctaaataaagaacccctgcccctgcccttgccctgtgcagagccctggggaagtggcaataaccaaggcaattatttggaatttgagcatagaagagacccatacccctctcccagggacactgtttgggctacctgctgccttagaggacacagaggcggtaaacagctcctgggcccccagtcagttctccagcatgatttgtgttctgagtgtggagctagacaaagccactagagaagtgcagaatccaactgggtgtcattaaatagctgagagttgtcgtcccattagacaggaaggatatatggggatgggatacacttgcagggaattctgaacagaatcaggcaataaataatgcaaagcaacctagatataaggagttagaaactcaaaccgggtgggagacttaggcaatagaatcacgtgaactctagagactccagcccctctctgcaggcaaggagttccgttatgattgttcaacttgcctgtgagtgttatgaggaaaactggatcttggtccacagcaaaatctgctgtatcacctcagtccactgagacggaaactgcaacttgcttactgttcaagttgttgaatgtttcctctatgagtctctgttgaccttgggaagggttcagattgagtattaatgcttttctgttaggtttagcaacaatctgtttatattaggcattttgagggtttgtaatgtttaagaggagtggcattaaataatctaatatattagcctcatgattccaattttaaaagtgttattgagtaattgtttagatttgtgattttactaggtttgtaaacaatattggaatgttcatgagaacttgagatgcactgtattttaaagtttaatttattatacttactagaattgtttaagtgtttgggaatgttctgatcgttagggattttgagtgtttgtaaatgaattcaaatatactaaatttataagtccagtttaaaatatataaggggatttaattaactaagatgtaaaaagcccccttaaaagtgattgttaaaatttattagatttataaataaaataatgagagttgtccgttgacatgaaaagcttatagaaaatgagagttcttttcaatgtattaaataaattgaatataatttttgaaaaataactacaaatagaatctctcctttcacacacaaagctcccctcaaggagatttaaacaatcaacttgtggtgcccacagcaccttacagaagtggcacaggagctgctgagggggcatgcatgtgagaaagagggacacctggggacaagctgacatcaagggcaggtgttcctgtccataatccctgcagtgcacaggcacagaaactccctggatttttttccccaccttcttatgaatatttccaaatatgcaaaatcttgaaaacatagtacaatgaacatccatttatccaccacccagattcaacagtggcaaactttttgtcacagtggtttatttacttctaactagatctatcggtctgtctatctatctatctatctatctatctatctatctatctatctatctatcatctatctatctacatatagaactatttcaatcattggcagatattatgactttttttttttttttttttagatggagtctcattccgtcatccaggctggagtgcaatggtgcgatctcggctcacggcaacctcggcctcttaggttcaagcaattctcctgcctcagcccccccgagtagctgggactgtaggcgtgcgccaccatacccagataatttttgtatttttagtagagacggggtttcaccatgttgaccaggctggtctcgaactccttacctcaggttatctcatgacattttatctcaaagtgctttagtataaatctcctggatgttttattttataatcataatgttacatcacacctgacaatgctaacaatttcctattgtcatctaaatcccagttccaattcagacatgtccaaatgatgggtttcttcttcttttgagtctggtttatttaattcatgttatgtttttgagatacatttatgtcatatagtacattctgctttatagctgtataatatttcattatattatatacatgtttatagatccattcagctggttatctatattattattgtttctagtttctgcctactcagatgattttttctaacaacattccaagcaaatcattatgcatcacatgtatctttatatcgttttaatctaaaacaagctttcacctttataattatttttctgaaactaatgtgtgttcagtggctaggacagttgtcatgaaaaatgtcctaaattctgaatttgtcagcttttccttcatagcattgttttaacatgtttctctgtttctggttttcttgtaaactaacaaaaggcttgtttaggttcaggttaaatatttttggcaagaatacttcctaagtaatggtgtgtactgaatattgaatcacatcaggagacacctaataacaggttgcctcactacaactgagttaagctcaggcgatgcgcttggtaagtgcctggaacacagcaaacgcaaaataaatatgatctattattaaccccactccacagatgggaaaactgagactcccacactttcagctaactttcttcaggtaacctggttttcaagtgacaaagctggaactcagacctgagccctcagattcatgacccaaaattacagcttcttaaagctaatggataccttacaagtcattcattcacttattagttcatctagcaaatatttaatgaaagtctactatgagataaatggttaggcaccatctcaggcactgggggtacagtggtgacaaatcaagtccccagggaactatgctgtagtagatggagaagggcagcaaacacaagaaataagacaattatagaagatgttacatgacttggagggaaatacagcagggtcaggggatggaatgggtgtcactgaaaaggtaatttcaaagcaaaggcttgcgtgaggtgacagtgtgagccacagagaagtctgggggagagtgttctaagcaaaggaaaccgccagtgcaaaggccctgaggcaggagcatagcagccatatttgaggaactttgaggagtagtccctccagcccccagccctgagtttatccaacagaagagtcccctcacagctgatcacagatatgaagacacagggacatattcctttgcttctttagagtccatggatgggtccctactcacacatgcacaggcgcatttgtgcttccctcttgccaacctgtccaaaggatcctcccaaggcccaatcacatggggtgggattctttgtacctctacaaagagaagatgagggaagagcagcatgtcacaggagtacaaaggagatgtgcacagatttggaggctgcaagcatttgtgtcggagtttgaggccaatgccatgtataggagctggagcatcacctcctccctttccctccctgaggctttcaggcttccccgaagtccccaccccaggtgatggcatcaatttgccccagctcagcctgcaacctcttattggtaattcttttttttttttttttgagttggagtctcattctgtcacccaggctggagtgcagtggcgtgatgttggctcactgcggcctccacttcctgggttcaagtgattctcatgcctcagcctcccaaacagctgaggctacaggtgaatgccaccacgcttggctaatttttgtatttttagtagagatggggtttcaccatgatggtcaggctggtctcaaactcctggcctaaagtgatccacccaccttggcctcccaaaatgctgggattacaggcgtgagccactgtaattcttgagagataacacgaggagtgcagtgactagcaggctgaatgatccactagtttaaatcgataagtaggtagattagaggtgaatcctcgtagaggaacttggatttgaagctgtgggaaaattgagtttccagtcactgcagacctgcacccctaatttgccacactggaacctggtagattccgtagcacatactgggaggcagctctggaactcctcagaggagagtagggagcctatgtgtgtcttcagcctgccctggaagtgcccaggaatcttcctgtgttgggtctgggttttcaggatggatttctacacgtatctgtggaactgagagtgtggactagactctctcgggtcaatcattggaaaagtcagattaaaggccagtgagttcattagaccccactattacaaacaaggacaaagctacaagtaggtagccgggatttggaccagagcccttgctttcacggcctgcctagctccaggagctggctgaaagggatccctaggtggttaacctactctgctgtgagcatgaagggcacccagacacttttttagaccagacctggtgacacagccatgggcaactccccccgccctccatctcccactccattcagtaccttgcttcctttcaccagcaagaatgtgctccaccatctcaaacagctgttgctcgctgtagtcaggaaaaaaaggctacaaaagggataaagtagttcaaagtgattttcttctcttcctacaaagtaagaattttcctgcctaagtttttttttgcagcttttaagttcgggggtacgtatgcaggaggtgcagatttgttacatagataaatgtgtgccttggcgattagctgcacagatcatcccaccacccaggtattaagcccagcgtccactattcttcctgatcctctccctcctcccacccctaacacatgcctaagaattttgaggcctgaaatgagggtgtgaggaatcaagggagctgaaggaatcacggatgcggcagaggaagccatccttaggagaggctcatggcacatttctctagaagaggttcctgggatgtttggattaggttggctaagccgcatgctgaagggactggggtgggattcagagataaggcagggaggcctgtgctggaggaagaaacagattttcccctctgtcctgcagtgcccaggcagctgtggtctggggggttacactggcctttcatatttgacttctcccattctgcgttccaggcctatgtctgatgatcagaggtgcacagtttttaaaaggttttatcaaagtcttgcttggacacaagatgagctattaaatgagaccatgctctttttgctttgaagattggtacagacaaatagcagataagagagttcctatgtagttcaaatggaagacggtccataaagaactccgaggaggcttttgggcagaagaacaaacatgaacttgatagcccatgtccatccgaagctgaaatacgaaatgctggggataatgatagccgaccctgactgagtgttggcttttagatattaactcatctaatcttcatgacaaccctgcgaggcagttactattattaaactcagttacagacatgaaactgaggcagagacattgactcatgtagcccaaggtcatagttagataaggtagagccaggactgggatgccagtagtctggtttcagtctgttcccttagttactcccatatctcatgtgctatccctctgagccaggtaccactgtccctgtataacagaccggggcggtctccaattcctgggcccacttggaggtaaaataggacccaggaagccaatcccacgccctggtatgaagggaaaaccagggaggaaacatggaactctccaaatacatttccctgtactgtacaacctcagacaaggccatcaaactaagtcctgcccctggttcaacaacacacagtatatgaaaagatgcttaacatcattagtcatcagagaaataaacatcaaaaccacaatgagctacgtcttcacacccacgaggatggttagaatcataaaaccagaaaataacaaatgttggtcaggatgtggagaaattggaaccctcatacgttgctggtgggaatgtaaaatggtgcagccacacggaaaaacagtctgccagtgcctcaaaaagttaaatatagagttaccatatgactcagcaattccactcctagagatatacccaaaagaactgaaaacaggtattccagcaaaactttgtatgcaaatgttcacagcagcatttctgtgaccgtcccaaagtggaaacaacccaaatgttccatcaaaggataaatgaataaacaagatacggtgtccacctaccatggaaaatgacttagccctaaaaagaaaaagtattgacgcatgctacaatgcagacgaaccttgaaagcattatgctaagtgaaaaatgccagacacaaatggtcacgtatttgtataatcccatttatatgaaatagccagaataggtaactctatagagacagaaaatagatgactggatttccaggggctgggggaagggagactggggattggctacttaacaggtagttaataggcgtggggtttccttttggagtgaggaaaggttttcgaactagatacaagtggagttgcacaatattgtgaatgtactcaatgccactgaactgtacacttgaaaaaggtttattttatgttatgtaaattttgccctgattttaaaaacttatttatttgtttgtttatttgagtcagagtcttgctttgtgactcaagctgggggtgcagtggcacaatcacagatcatggcaagcttgacctccccggctcaagtgatcctcttgcctcagccccccaagtagctataatagaaccacaagcaagcaccaccacacctggctaatttttaaaacatttttttgtagagacaggtctcgctatgttgcttaggctggtctcaaactcctgggctcaagcagttctcctgcctcggcatcccaaagtgctgggataatagctgtgagccaccatgcccagcctggtttttaatttttattttaaaaaattttttgtgataaaattaaaaaaatagagacagggtctcactatgttgaccaggttggtcttgaactcttggcctcaagcagtctcccacctcggcctcccaaagtgctaggattataggcatgagccactgtgcctggcctctttgttttgttttgttttgttttttaagctaaaaacaagacagaagtggcagaagagagtagaaatgttattttgttatctgctcttttgaaaactcgagcacttttactgagtgtgccttggtatagtccacaagtgccatcagccaactctgacacgtgcagggtttcctctgcctgggccctgatgcatggacttcacgaggattcacccactgactcttgcaacaccacaaaggccaggcctagaggctgtgccatggactgtgcaggtagaaaagggcagaactgggactcgaacataggcaccgtgctctggagctcatgctccaacccaaatgactctgctttgccgtggtgatatgataatgttaagagtctcaaccgccaccgtttagtgggtaccgactgtgtgtcaggtgtgtgctaagcagttcgtttattcacacactcatttcataaatattattgagacctcatatgtgccagttgctttttcagacactgggtcacaccagtgaaggagacagaccaggtgcctgtgctcgggaagcttacattccagaagggagaaacgatacacaaatagttgtgaatagcacatcatgtgcatggaagggctcatccagaatgcaaggtaagcgggtagggaggggataggagggcaggaggaagctagtttacaagggagatcctggaggccactctgaggaggtaacattgaacaaagacctgaatgatgtgagggagaaagatttgcaacgacctgggcaagaacagctccaaggcgcgagctctgagatgacaataagtttgcaggaatagcagagtcctaggggcctgagaggaggacagggggtagccgggggcaggtgggcggccatctaaggtcagagtacatggagactcaccaggctaccatgagaaatttgaagttattctaagaagaagccatctactatcttaattaacactcaccaacaacctgacgaggcatgtgctattattatccctgttttgttatcctctgaatctgaaggtcagagtggttaggtaacaaattcaggattccacggctagtaagtttggagctgggacttgtccctggtcctgtgacctcagagcccactgccttaaacaaaaaacaaaactgctacagatcccttaccaaagacatctcagccttgggctgcaccagttcaagctccccgcagtagcaccccaacgctgcctacaccctgcatgggaagcagagccttgggaaaccgggagatgcccagagaaaaagcaggaaagtgatgctagctctgggcacacatgagctcagcttaatcctcatgacaacctgtgagctggtatgattaataggcccgttttaccaatgaggaaaactgagacacagtcttaaagttcccagaagtcctaagggagtcaggtggcagaactggaaatgaacccagacagcctgcaaccagacccaaggtgtttatcctcaggaccccatgacctttattatggatccctgaccctcccaccaccctgcttctctccctgcatccctcttctcagggcaggctgaaccctcagagctttctttccaccctgcccctgccgttgcctgttgccagatcctgccaggctgcctggaacctatccattccctcttctccacacccagtgccccattcactccttcattctttcactcacaaagtaggaatgcaaagatgatcagatgtggctccaccctcaaagagcttactgtccagtgggcagaaagagatgagtagacaattaatagacagtgaataactccacgggaaaggaaggcacagggttacacctgaatggtggtggcggaggatagtcatccagaaaaactgaggaagtcggggaaggcttcctggaggaggtgatacctgaactgagacttgcaggacagaagggacaatagacactagtaagagacaacaggtgcttccacctcattcacagccctctgcagtcctgatctccaaagaatcctgtaccctgcacactctctgccctccaactttcgttcaagcagtaattggatgagcacgaaacacacgcttttattttgccagacctgggttcaaacctccattgtggcactagttagcagtcttgggctagttgttcagcctctctaagccttcctttcctcagctgtagaagaatgagaatagaaattaccatgtgtagctctgttggcagaattagcaacaacaccaattaacctggcacatgacaattatttaatcagcagttgctcttaatgttacactgtttgtgctgcctgaaataccttttcccctcaaatctctaattttttttttttttttttttttttttttttgagacagagtctcactctgtcgcccaggctagagtgcagtggcacgaacttggcttactgcaacctccgcctcccaggttcaagcaattcccctgcctcagcctcccaagtaactgggactacaggcatgtgtcaccacacccggctaaatttttttttttttttttttttttttttttttttttttttttttttgagacggagtctcgctgtcgcccaggctggagtgcagtggcgcgatctcggctcactgcaggctccgccccccggggttcacgccattctcctgcctcagcctcctgagtagctgggactacaggcgcccgccacctctcccggctaattttttgaatttttagtagagacagggtttcaccgtgttagccaggatggtctcgatctcctgacctcgtgatccgcccgcctcggcctcccaaagtgctgggattacaggcgtgagccaccacgccaggcctacccagctactttttgtattttagtagagacggggtttcaccatgttggtcaggatggtcttgatctcctgacctcgtgatctgcccgcctcaacctctcaaaagtgctgggattacaggcgtgagcgaccatgcccagccatctctacttttttttaaagaaatcatctgagatccaagagttgaaattcctatctcctcctccattcccatctcacttctattagaggacatctgagagcattggtgacgaggggcgtgtctgaatctcctactagatgctcagctcctgagaacgattgtgttttattctttttttttttttttttttttttttttagacgaggtgtcactctgttgcccaggctggagtgcagtggcacaatctcggctcactctaacgtctgcttcatgggcttaagtgattctcccacctcagcctcctgagtaactaggactacagcacgcgccgccaccacgcacagctaatttttttgtttatttggaaagacaaggttttgccatgtcacctaggctggtcttcaactcctaggctcaaattatctgcctgcctcagcctcccaaagtgctggaattaaaggcatgagccaccacacccagctgttttattcatttttaaccacttcagtattcagcctagtccctagctcactgaggttctcggccactgtttataaggttgaaatatgaatcaaatcctatcctgaggagtgtctgaggcaatcgggggtgtggaggggaggatcatcctggccttgggctatggcagggacaggccaggggcccagaccaggctaaataggtgcaacggagggaaaatgacacaggtcatgttcagaaagtgagaaaaaacagaaaagagaaaatggaaatgaataaaactgacatgcttcaaacagtctgacctcgtaaattcgagtcattttgttttacattaaaaaatatcatccacaaataggcaatacccaaaaaagaaatctagggaccttaaacatatgaaaaaacttaatagaagtcaaaaatgacacttagaaaaagatacaagagctcagagtactaaagacaaaaaagaatgtgtgtaccccattggtggttctcctgtccatcgttggcaagatgtagattatagctgggcccagtggcatgcacctgtagttccagctacttaggaggctgagatgggagaattgcttgagcccaggagttcgagaccagcctgggcaaaatagagagacccccatctctttttttttttttaagtgaataaaaaaatgtaaattgatgcaatattaaaatgtgcatacccttcaattcgataatcttccaggaaattctcttaaggaagttatcaagtcctggcactgtaatcataacactttgggaggatcacttgaagccaggactttaagaccagcctgggcaacataggatgacccctgtctctacaaaaaataaaaataattagccatatgtggtggcatgcacttgtacttacagctactctggaagctgaggcagaagaatcacttgagcccaaaagttcaaggctgcagtgagcactccagactaggcaacagagtgagaccctgtcttaaaaaaaaaaagaaaattgtcaaacaaatgtatgctagtatgtacaagattttattgcagcattgcctataataataataataaatggtaaacaactaactggttaatgataggctgctattaaataaattatggtacacccacgcaatagaatattatgtagacataaaaaaaagtgacaattctgtatttttgacattgaaagatgtttatgatatagtaaaagtgaaaaaaatcaggtgacaaaattatcatataatcccattcttgtatttgtgtgttgttataggctgaatgtttgcataccttcaaaattcatatgttgaaatcctaacctccaatgtgatgatatgaggatgtggggccttggaaggtgattaggtcatatgggtagaaccctcatgaataggattagtgtccttataaaagtgacgccagagagattttttgccttttctgccatgtgaggttacaacagtctgtgtggaaacagggctctcgccagacagtgaatttgtcggcaccttgatcttgggctttccagcttccagaactgtgagaaataaatttcagttgtttataagccatagtagttttgttatagcaaccaaaatggactaagatgcatgtatattgataaatacatagagaattttcaaaagtctggaggaatgtctgctacgtatggtggttatgtatgcatgctttaacttttcctcagtaaaacaaaataaattttatattccatgtgaactatccatgacctggcagtcaggtgaatgagttagctgcctcccttcatgcactgactacctgtccacattggccatgaccggagattccagttacatgatccccatcaggacatgagtctaaagccactagcagagaaactcttcccagaccagagcaggtcagacagggtgggtggcctttttttctcttgcctgcaagagcagaagaggaagaaactgctcctcagatgggcaggttcatgaggacaaaggtggtgaccgtcctcagtagctctgctgtggaattaggacactcaggtgagagctgggacagcctgactgaagtcctactccacaaagcagtggtaaacgggcagtggggaggaggaatgtaagaccctttcccccaaggggtcaccaagtccagacctaattgtcatgcctccttactgaggcacatccctgagcaaatgggtcacaaagcagctagctccaggcaccagcacatatttgaagtaaacacttgggcttgagcgtggcccaggctacagaaaagcaaaaacgtctctggatgaatggagaagcaaacaggagggagttcaagcaaaagtcaggatggtccctagaagtaggtcctactttatctgacagtccaccagaactttttcttctgttatttactgacacttccagctgggtgctattgtcattgcatgtctcttcaggcatttcatattttacctcccttattattaggctggccatgccccgaggaaaggctagtttcacaaatctcatcccacctcttcagtaccaagtatggtgccttgtgcagtagatcattcctttgatatgtggttattgagagcctgctatgccaggcaccatgataggcattggagagtctgtagtgaccaggacagatgggcctcctaactcaatgtatgcacattctagaagatgagcaccatacactgtacaaataagtaaacaagagaatatgaaactgaacgcaaggaagtccacctgccattcgactcaatgagcccagtccagagagagcctgagatgggagaagtgaatctgctgtttcctcctgagcatctccccatgctaaatgagattcagctgttaatgtattttcttataaaacatcatgcttaaataaaagccaacggcttcctctggtgtttgaccacaggaaacatcaatgtgttccaatttggaggaaaaaatggttctatcaaacttactgagtgatggtatgtgtttttcaacatggtcacctctctagggaattttcaagggttatgttgattacatgtgatttccacatcttatttatttattattttgagacagggtcttgctctgttgcccaggctggagtgcagtggcactatcatggctcactgcagccttgacctcctaggctcaagcaatcctcctgcctcagcctctctagcagctggaacttttcaggtgtgcaccaccatactcggctaattttaaaataattttcacatttttttttaatagatacagagtcttgctatgttcctcaggctgatcttgaactcctcggctcaagcaatcctcctgcctcagcctcccaaagtgttgggattacagacgtgagccactgtgcccagcctgtgtggactttagaacctaatctctaataaagttggactcctctgcctgttatgctgtccactgactatccactaattcaatctgtggcattcactaactcagtaccgtgtgttacaaagtccctactatgtgtcagtaactattctacacaccgaaactagagagatggatccaaagaagtaccactctcaaagagggaacaatatcttcaatatctaatatttgtataatgttttacatctacaaagtgttttgtaatgctgatccagttttatctacccagcatctctcattttctgggattgcacctctgtcttagcttgagctactataaaaataccatagactgggtggcttaaacaacggatgttcatttcccaattctggagctgggaggtccaagatcaaggtactggcagatttggttcttggaagatcctctttctggtttatagatgacttttcactgtgttctcttatgacctttcattggtgtatgtgaggaaatctctgtcttcctcttcttaaaaaggtgcaaatcccattttgaggataccagccaagatctcatcgaatcctaatcaccaccaaaggcaccaactcctaacaccagcactttgggatttagggcttcaatgtatcaaacttaggggcctacaaacattcagcccgtagcaaccccgtagcacccatacctttaggaaatactctttcccacactgcaatcctgtgttctcagtgggagccatcacagtttctaaactgtggctcccctggtcatatttaattgactgaagtggggccacaaggcttgagttgggtcagtcatgataatttttgcccactgtccaaactgaccggtcaatggaagagtacccagccccaacctggccaatcaaagttctttccaggatttgtccaccagaaactacagaaagagactacagaaagtgctgaagctctgtgatctgtggcgtgtgaacagtagctggccatgtttccagggaggaatatggcaccagtgctcagagggcagcaggagtgtgaaggatggagagagagcctcctgcagcagctgtttctgccaccctgagggcctccataccgctgcctcttccagggcaataggagattacccataaattcttccttttgactgagctggttcaaaatggttttctgggccagacgcagtggctcacacctgtaatcccagcactttgggaggctgacgtgggcagatcacttgagttcaggagtttgagaccagcctcgccaacatggagaaaccccatctctactaaaaatacaaaaattagccaagggtgaaggtggtgcacctgtggtcccagctactcaggaggctgaggcaggagaatcacttgaaccagggaggtggaggttgcagtgagccaagatggcaccactgcaatccaacctgggggatagagtgagactctgtctcaaaaaataaataaataaataaataaaaataaaagatggttttctctgtgtcacttacaaccaaagtgcctgagatattctttttcagacatcttttcattttctcctcaccttgaggaaggagctcagagaggttaagtgaactgcccaatatcccactgctccagaagagagcagcaagaattcaaatgctgcttcacatcctggttcacgccctcaaaagaggtttcccgccctggatgccagcctctctcacaggtgttttctgtactctcagtggtgtcttttttacagcccagagccgcacatgtcctgtccgtgttccggtcctgcggtgactcacagtcacatcacagtgcaggcagacgctcccctgacagcccattggctcttcgttatctgactcctgcctacctcgcccagccccctcctcctccctccagctcatgtgtgctccccatccaaccccctgcgtgagtcacatgctgctccctcggccagagcctttgtttgcctgccttggaggcctggcatatgccccagtccccacccacccaggaagcctccactgccacctaccacccaggcggagccccggcctcctccttcctctgtgtcttcctgggatcgacctccaacccagcagctgtctcattgttttcaaattcccaacctctgccttccagaataaaggcatgtggggacagggacaggaacttcatctatctctagccccctgcacaatccctgccacatagtggtattcagtttgttgctcaggggataaacaagagcaccagaaatatgaaggtcgatgcaaatatcgagtattcatatttctttaataatccacattgtttgggagtcaactgatgtgatgctttgaagccagtgaaagctgaacgggcaaatctgaaataccttttcagagattcatctgcactctatgtacccaattaatgctgagccattagtcctttccgaagctgccaggatctattaagccatttaacttatccttccgcacttcaggatcagtcccaagggcattttttcaggcctgggcagccaaagtataaatgacttaagtggtgagctttctctcactccccctgggaccccagtcctccaaagcagagctttaatggcgctaaagcactgtgaagcgaggaagcgcctaaagctgccactagagtcggcctcaaccctgaaggaaatcctggtttggagcccttgctcagggcgggccttctgaataactgcaacaggaaagcaccctctgtggggtgattggaatggtcccaggaaagtccccaggcctaaggatgcccctcaggaattcacaacagtgcttgaaatcccctccatttatcacttaataagtatttcttgagcacctactaggtgccaggcacttagggattctgacaggaatccttataggtttgttattttgagctaactgaggctttatcctgagctcaaaagcaaatatctcttggaggataacccactgagcattatcaagtcatcaaataccatccttcccaggacaccactaaggaaggtggcagctgtatggggagggtcttaggactcatatggatacaagttgctggggaaaagaagaggagtgaatcctgtggaacacaggctaactccctgtgtcatgagtggctgccatgggtcaggtcaaaggcaacttccatttccccacccctgcagcctcatgaaattgcagagaaacaagcagggtgggcatgtcaaatacacctcgtttatcagattcgcctatattcctcaacctggtatcccccccccgcttttttttttaagatggagtctcgctctatcacccaggctggagtgcagtagcgtgatctcaactcactgcaacctctgcctcctgagttcaagtgattctcctacctcagcctcctgagtagctgggactacaggcgtgcaccaccacgctcgactaatttttgtatttttagtacagatggggtttcacctattggccaggctggtcttgaactcctgacctcaagtgatccacctgccttggcctcccaaagtgctgggattacaggtatgagccaccgtgcctggccctggtcccatttttaattctcttaagaaatgctttagatctgcaagtggggtgtgcagatctaagcttcctaggtttggcatatagtttagcctctgtgagcaaaacctatttagccaggaccaactctaagttgcacccataataataacacaacagctagtgctctcatttaccaagtacccactagatgccaggtgcagtagtggatgctctgtgtgattggtgttttgcaatcatgtcaagggcatatacttttaagaacccaacgcttcgaggggatatttgctcaagatcacacaattagtcaacagatgaggtaagagtaaacacagtccccacttgtgcaactccaggacccatattcatgactattatgctgcggaaatcatgaaccagataaagttcacctttagtcccttgtctacaccctgaaggtgtaacatgagggatcccatctgctatggtttgaatgtgcgtgcccgctccaaaattcatgctgaaacttaatccccagcgcaactgtatcggaaggtagggccttctggtggtggggttgagtgctctgccctcatgaatggcattaatgccttataaagaggcttcacactgcgtctgctcctttttggcctttaaccttcctccacgtaaggacacagtgaacaaggtgccatcttggaaacaaacagcagccttcaccagacaccagaccttctggcaccttgaccttgcgctttccagcctccagaaccgtgagaaatcaatgtttattgtttataaattacccaatctgtggtatttttttaaaacagcataatgggactaagacaccatcagaacttgggaccaaaagaatacttttgccctctgagagctgattcttaacacagaataaaaatgaagaattactttaaagagatggactacctcaagggtaacttgattaaaggtctggagggaggaggagggttcagtggtcggtcacagtctcccacaacagataaaattagggacacactactatcatttcaaaatgtgattaatgtaaaaaatttaaataagatattttatattctttaaaatcaggactacatttttaaccacatcctcttactaccaaaaagaaagtcctgcgccatcactagggcagttttctctctggtggggagagatgtactgggaattatcacagcccggtgattccagccgctgctactttctaagttcttctcccacccagtgttggttctccacaacatgctgttcatggatatctgatccttggcagttacagctcacagtaaattagcaaacagaaattgggattattcatccactctcgtgaatttcaggcctagtcacctccaggtacaccatgaatatgccaggccctgggacccagtgcccacccgtgaggcccatccaggcactgagctggcctgcccaggcagacctgtaagtgcgtctcaggcctttagatggtcatgggccctgccaaccctctccctcctcgggaatcctgtgtttttgaactggccctggttggcctgcacatctcatgggaaacaggtatgacctgctactgcagggccagagtggggcactggtcttttcagcctgcctccccagtccctttggactctgccttctaagggctcatgactctttgccggacaaaccaatcatgcttttacctttgccaggtgttaaaaataaaaaatagctttggcggcatcgaaattcattataacttattatataaaatacatacttttattattaaatatagcattatatagtataaatatagatatgtattaaatatttataattaaattttagaatttttcaatgtgtaaaaagtagaaagaaaaatataatgaactcccatagcctcatcaccttgtttcaatattaatcaacatctagtcagcctggttttacccaaccaccacaccttcctactctgaacattttaaagcaaatcccagaggacacatgattccacccacaaatacttggctatgcactcctaacagataagcacatctttaaaaacatagccgtaatactgttattacctctaacaaaataaacaataagcctttaagatgatctaatacccagtctcaatgttcaaatttcccagattgtttcaaaagtatctttttataaatagtcgttctggaagcaaacaagattcaaatactgcatttggttgttatatctattttattctgagaccacccctcttcccaatttgttctaataccatttatttgttgtaggaagtaaattgccccacattctggatttatttccttttggtgttaactagttccattaccaccagtattttctataaactgtgaagttatatttagagcagtgctgtccagtggaaatataatttgaaccacatatttaattttaaactttctcttttaaaacttaaaaaaataggtgaaattattttaataacttatttaatgtaaaatagccaaaatattatcatttcaaagtgtgattaacataaaaaattatagatgagatattttatattctttttcttttatattcttcaaaatcaggtatgtattgtgcacttaaagcacatctcagttcagaatagccacatctcaagtgttcaaaggccacctgtggctaccggataggatagggcagatctaggagtttcaatagattccattttaaagttttaatgtgcaacgaatacttcatgggtgttgctgtgtagttcctgctttaaagttctctgtcagccgggtgtggaggctcacacctgtaatcccagcactttgggaggcaaatcacctgagatcaggagttcaagaacagcctggccaacatggcgaaacacagtctttactaaaaatacaaaaattagctgagcgtgatggtgggcgcctgtagttccagctatttggaaggctgaggcaggaaaatcacttgaacctgggaggtggaggtggcagtgagccgagattgcactgccactgcactacagcctgggcaacagagtgagactctgtctctaaataaataaataataaataataaaaaatataaatgcatgggtaggtaggcaccaaaagcaggatttgaaccttggccaagtatgttaaatactatgtaagagtggttttttttttttgaaacagtctcactctgttgcccaggctggagtgcagtggcatgatctcagctaactgcagcttctgcatcctgggttcaggcgattctcctgcctcagcctcccaagtagctgggattacaggcacctgccaccatgccatcagtatcaactgatgatcatttctgaattcattatttcattagggactgcaaactcataattttctaattctgttattccttctgcatttattaggggtaaattcttacataaaaatgacctttaccttgttggctctttagttactctgaaatatagttcacacaggaaagatgggatcgatgcttgttctctgtcaatttttagagaaatgagttgatacccaaacaacctctagtggtgatcaatgaggggtctctttttatcatcgcgagctcatggatttctatatttattacctttccatatattgcagtcattattcttttgcaatgttaaaaatgaacccatctttggccagtaggactctccagctggcttctggaccagtttttaagagcttttctgctttctggtaaaatcacatgtataaagctcatcttggacatttcctatcccagcaggaatcagctatttctccaaaggagtcattgctcattttactgctctgggcatctctgaacgatacaaaaagatctaaagaaagggaattagaaacaccaagatgatcaataggacaaagatgttacctttttggaagaagatgggtagggtgaaggaagacagcaagtttgaagagggtcttgcatggccttacctgctctgctcatctctttctctaaatctctgctctcctctccctttactcttaggactagaactattgccactgagggcaggtgaaagttcagccaactcggaacccggaggccccaccttacctccctttgtgaagagcccagagcctttgtccaaagctgcatcacttcccacccagcccttcctgagccaactccccgatgtctccagaagaacacagtcggcatcatcgtgataacatcagggaaactcctatttccagcagtttctccttcagctgcaaaaatgtgcagcagtagacagggcgtgggtttttgaagtctctgcaggaagtagagttattttctcagcaccacatctgagcgcatcttctaagggtggccgactgtgtgggagctgcaggagctcagccgggatgcagccctcccattccccaccctgtccactaccaccacgcctggatccgacaggcagggcaggaccccatgccacgtggtaactgttaaggaaaatggagccaggtaggggggatgtctgatacccttcctggttttcctgagtgttctttgtctccccaactcctactcacaataaatctgactacacttaaacttagatcatcataagagaccccgcaaatgcccaccatcctccactgctgtgatcatgaatctagaatggacatttcatatcaatgccacagtcccctgagaccatcagccagaaatgttatcacaactccctcgctttgccctccattcccagaaggcaaggaaagaaggaacccagtttcccagcacccagatgcctactgatcctggcacgcagctcaaagttcagttacattaatgatgggcctactgcatgcttggggcgcttccctgtgtgttttgtgtggtcctttcagaagtcctatggatagacattgttagccctatggtatagctgaagttgagaatccctggtggttaagtcattcccccagatcacatggatggcaagtgacagaggcaagacccatccttgggtcaggtatgaacgtctcgaaggcttggatctgtctgcacgtgggtgattatcacatccagacttgcactgaaggtcatgctggctgccatgggctgtgaatacctttcctcaatcaggcactttgtgtctattatctcatttaatctttgttctgctttataaagtggctcttaatatgccccctctacaaatgagccaccttatctaatgtcactaagatgtgtaccggacctgattccaaagcctatgcagtttccattaagcacctctgccttttgaaaagtaggtaatttctccatctctcctagcccccattttctgaatctgtggcacattaaatgcatataaatgcaaagacagatgacagtatctccatgtctgaaaggtagcctacgtgtgttagcctctggaggcaccctgctaggaggctggaatctgggatccaatgcggtccagcatttagcagagtgtgccgctgctccaggctccagagcattctaggtgctatgtaacatttgacattttgacatgggcattagaaaaaaaaaatacaactagcacactaaactcattatttcaaatattgatcaggataaaaatatgttaacaaaaaagtcattaaaaataatgagcttcttgtgagtgatttacagatttgactaaaatgcaaactgtcaatgacaaatatgagaattaatatactccaaagggtaatgaaggaacagtcctcctgacatctttacatgccaggtagcaccctggccttttagagaggtagggatagcaattgtaaagcagcactgggtcccctagctagaatcgtccattactggcttttgtcactaactgaaaaatgcggtcatggtttccttttctctggcacattaaaaataaaggacatctttttcctttcatgtggacatctgatgagatttactgaaactctacctttaacgctgcaagagtttatgggaaatagtaatccaccccaagaataaacagtaaatggaatgacgattttctaggaagtgctgtgtctggctgcggcagaagcagcaatgagctaagagaggttttttggcagccctgaagggccattgagaactgtgaactgtgatgaagaaagcattcatccgtttatatctctgtgggagtgccttctgtgaggcatcagggtgtctgccttatctggggatttcctctggcattacagaaaatgatgcaggttttgcctctgttccccggaacaagaggtgagaggctggcctggctggcgtgagattctcactcgtggtcattctcactgaggttggctcagaaatctgggtgaaatgattcacctgctgcgttggcatggcttggagggcagcttgaagctgagtttccaaagctgagccctttgcctaggaaaactcatttctgttctctcctttcctaaggacaggctgtggtcagcaagctcagtggttcatggaatgtctttagaaaacaagttgctccatgtatgcaagaaactggtacccaaatgccggttgtggcagtatttgcagcagcaaaaggttggaaacgagtctataattcatgagtgggcaactggcttatgtgatgcgatgtgacgtgatgaaatataatgcggctattttcaaacgatgacagcacactgctgtcattgacagtgtcaggtctgatagatttaaatgggcatggtggggcagaaaatgatctgtagagtgattccattgccgtgtacagtgcatctgtatgtatggcctaggaaagggtctaagaggcactccttgcctccagatggggtgcagggctgcttgatgaacttggggtgggtggggtgagagatggatcctttcctgacttactgtcctataaggggcagggggatacttgcctgagtaggagaggagcagtgggtagctaagcttgctcccagggccctctcggggaaacctgctccttttgcatttttccaggactggggagaatccagccttggactccaccagtgggcttcactcattgtctatgaggtggccaggctcactgtgtcctgagggccagacaccccagggtgctgctgaagaggatagtgcccattctatctctgtctctccctgagagcgggaccgcttcctcttccctcttccatggtggttggggtcctccatcccacacttgaactccccagggcccgttgtcctccctgcagttcccccgactgtgttcttcagtcctatcaagtctcaaccctcagaatcctgctctctgagaaggaaccaatgcacgaactccaggcgtctctgccaggcaacacatttgcattttaactgggattttctgggggaaaactccttacgaggaacaaggtaaggagcgcccacttcatccaggtcaggtttgggaataaacagtgagcccacccagtgggggcacctcccgtggcggaggccaacagaggtggggctttgggggacttcagacaaaagggcaggcaggtgcaaaagaggtcttgggggaagtgagtttcctccacgtgatcaaagcagacccagcaggcactgcctccgcacttgtgggaaggcgtgctcctgggaaccagaaagcctggacttagggatggaagaactaggctgggttccaatcttgtctcctccctctacccacaaacaaacctaggcaaatccagtcaaggaactgtcaattcctcatgtgtaaaatagtgataaaaacagtgcctttgtgtgaccttaacctgaaaatggaaagaaaggaaaaattaaaagttaaaaaaaaatagtgctgggcgtggtggctcacatctgtaatcccagcactttgggaggccaaggtgggtggatcacctgaggtcaggagtttgagaccaacctggccaacagggtgaaacactgtctccactaaaaatacaaaagttagctgggtgtggtggtgggcacctgtaatcccagctacttgggaggctcaagcaggaaaattgcttcaacctgggaggtggaggttgcagtgagccgagatcgcgccactgcactccagcctgggtaacagagagagactctatctcaaaacataactaactaactaactaaataaataaatagtgccttcatcctaacctatgggattcttatcatactaactgagatatgctggagtttactttccacgtcgcactgtacctaatgaacatgattcaaatgtctactctctcctccctgaggcggcagtgtggcctggtggctggtgcgccttctgccttagggggcctgtgacacagcaagggccacagtggtcaaatgcacagactctgaggccaggcagctggggtccacctctgagactttaacctctcaggaccccgtttttctattttaaactggagataacaataagactgtctacacaggcccactgggaggattaaacacttgtaaaagcaagtgagcagtgcttgactcggttggccctgtgtgggttcctggcagggacctctgaagaggggtgaagaagccactctctacccctgactgtacagccatgcactcaacgatgacgaacctgtggggggctgcccaagcaccccggtgtcggagaatcctgcttcatttcctagcaggatcgagccatgcagaagcaatgcatgactagtggttcctatcacgctgactctctaaggctaaaatgaattagtcacagataaaagtggtcagatctcaggattcgatgcttccctttctttcttaaagcaaggatgaggtctgaataataaaatgagcaataggccatttaaaaagaagcaaagctaggaactttcacaacaatttttcaggataaataaaaatcagtaaaataaagctattttaaaatgaattaaatttatgaagctattgaattctgagaaactgctgcctatctggcggggatcatggggtaacccgtgtaacaggaatactgggggcttccagtgtcactcaaatagctctgactatgtcacatacaattatgttggtcctggacatagaaggggaatacagggaggcaggaaattggcctccatggtgagggggatgccacatgctggggaggggggcagcaatgtatcctttgggactttagaggagggcctgagttgtgaggccaggagtgaggaggaaaagattcaaggagagcatggactctgagtcagacagaatgacaagaaatgaggcatcctcctagggaaagatatttggtaccaaaaaaaggtccattgtaagcttctttaaattcagtatgagatgggctagaaaagcaagatgaaaggagaattgtagcttagaaagcaattcatatggcaaagagttagtgggcaaggtctcttggccagagtggaaccagaatctatcaatgcaacatcttcctgggaagctgggaacctcaggctttacatcattatgctcttgtggcacaaaatcagacaaagggtatgttccggaccaggacccagtttattttccaaaaagaaattgttggatgttccaaccccataatatgtcctctacactgagggacagttcaaagcattcaacaaaactcctttgtgggggtgtttccttgagcaacaggagaacattatacacagatttgtgacacagcctggtggggtttgagctttgctttgctgttttgcttctctctcttttttctagtaaaaacctaagcaagaaggtatatttataatccccaaagggaaattctatgcaatagcaaaatgtaggaacatttgcagtggtgggtctggctgggatgccgggtgatggagctggttcctacacaggtatcagtggctccctgttcgagacagatctgaagttcaatcagtggccaacttttctgtccactgtcattgatgggttcagaaggaccaacttggagggcactgcttctagtcagtcattcaccacgaagcctgggggtgaatggcccccaaaagacacgtcctgcccagaacctgtgaatgtgactgtcttagtcgttttctgtcatttataacagaatagctgaaactcggtaatttatgaagaaaaggagtttatttcttacagttatggaggctaagtccaatgttgaggggctaagtctggtgagagccttcttgctggtggggactctgcagtgtccccaggtggcacaggtcgccacatggtaagggggctgagaatcttaatgtactagcccaggtctctcttcctcctcttataaagccaccagttcccctcccatggtaacccactaatccatgagcctattaatttattaattcatgaatggaactaatccattcatgaggacagaaccttcacaatccaaccagctctaaaaggccccacctctcagtactgccacgttggggattaagtttcaacattaagttttggagggggcattcaaaccacggaagtgaccttactgaaaagcatattttatagatgtaattaaactacatgtgagatcatcttcgattagggtgggtcctaaatccaatgacaactgttctcataagagaagagaaggtgatatgaaggcataagtagagattggagggatatgtctacaagtcaaggtattgccatgagccaccagaagctggaagaagcaaggagggattctcccctggatccttcaagcaaatgccattctgattttggacgtctggccttcagaactgtgagaacacatttctgttgttgtaaaccacctagtttgtggcaatttgttactggcagcctcaggaaaccagtacaaacccctagatttttcttcatatggcattcaatagaatatgttcattcggaaggggttcattggtttttaaaggcagtccctcccatttaaatttgccaagtacctgcatcactgtcagagagttgggccaaggagagaggagaggccttggagcggggagaacaggaaaacaatggccctggagttggagcttcaagaaagacgctgagctgtggggttggaggggtcacttcatctcttgctcatctgtcagataggaatattatgaagaagagcaaattagataaattgcaggaatgcacaatgtcaacataaagggttggctgagtccccaccattactctcaccctgggggagccctgctagaaagacccccttactgaagctttggatcagtggctgtagagtcagtgtgagctctacaggcagacaccccaggttctgtgtcttacagcttcgtgaccttggcaaattccttccctgagcctcagctcttcatctgtatggttgatacctagaataggtaaattcatagagacagaaagtaaaatagaggttatcaggggagggggggtgagggatggggagttattgtttaacaggtatggggtttctgtttgggatgatgaaaaagttctggaaactgatagtggtgatggttgcacaagacagcaaatgtacgtaatgagactaaattgtacatttgaaatggttaaaatggtcatttttatgttatgtatagtttactagaattttaaaaagcatgttagctgtgtttcccatcccagggcattgtggcagtagatgaccaggtagccagtatggtgggcaaggctggccaataggctggctgcaccagctcagtatttgtataaatggaaccttaatgatttaaccccaagaagagactaacgtgggatttcaggatcttaggcagggcccaggaaagaaaaacgtgctaaataactttgagtggaggagcggggtaagggttgaagagaaatccttcctgtgctcttgaaagtccagcaggggccaggcagagtgcctcacacctgtaatcccagcattttgggaggccaagcttcacttgaagctaggagtttgagaccagcctgggcaacaatggagaccctgtctctataaaaaataaataaataaataaatattttttttaaaaaagaagaagaaagtccagcaggtaggtggagactttttcttttcctttgcaaaagcagccaagaaccttctgaaccttggggctgctcttggatccctttgctctgtatcctcccattcaactaaatgtcccatatttggcccaatttcaagtttacattcgtttgtctggcctggagcctgccgtcttccaaggaagcgcagtctgcattatccgccctctctctctgaggaagacagatggatcggcaaatcgtgggctggagacaggaactcgggccccacctccggcctgtcaattccaagcccctcagagtctttgttgtacatcgctgccatggcgactgctggggacaacacctggccagcggaagcctgccaaagcccactgcagcaagagcaagggacgaagagggtatttccgggacagttagtgagcaattagagaccgggggctagagcgagcgagccagcccgagcagtcgggaagtgtttgacccagaatttaaaccacagaggctgaaaatataatttttaaaaatcaatataattgcttttgtaagtgctaaatactgcagaactctttataagttactttctgattctttattctggggcatagtgaccaataagcatgctggcctccattcctggcccttcttggggtttataattacagcagatccacggagagctcgcaaacaccctggcccggccaggcagagaccagctgtttgcacacagacctcgaagcgagcagggcttgcagacagtgaaacatgttctcgtattaacatctttctcacgagcactgccccctacactgctaacacagtcagaggagtcaaaagtggcttccccgtgtgtttctccattgcactccccgttatttaaaaaaacatggagttttaaatttcacgttctgtgatctaacttcccatttcccactcacaaacaaatgacatctggccactctcaacaataaacttggaaagatgagacatttcctgttagtgctccatgtaacccctgcttaaactttcaaattcctgaaataattgcccgaaaaataaatggatcattaaaaagtgaagaaaagggagaagaggggggttgggaacctgccaggagcgcctctgacagtcaatgttgataagtttttagcaatattccggcatttatttaaaaaaccatgttttaacactgatagatgaaaacagatttgttattctgcacaaccaccttgtggaaatcgcaattggataaaccttccaggctgctagatccaacatcacagctaattgcccaatttcttgaagtggtggtagaaaatattattttaaagtcctcatctgttttttagcactctgcttatctatccacctaattcctaagaaatggcatatggtctcacaacttcaacagttacacaaccccattatttttcaaagctgcgtttcgaagcctggattttcttcctcatcttcagctgccagctggacatttcttcttggaggccctacccttatctcccattcagcatgactaaggctggttactctgcaccagcctcccaaagccggctcccctctccacacttcctctttctctcaatgataacagctttctccaagatccaggctcaacctatggtgatatcatggaggcctgggctcttcccctcccagcccatatacacagggatccatcctatcacatcacatgtgacctttctttccattcctacaacagccaccaaccttgacaagtccagtgatttcctaacacgtgtccctcttccactttctgtccccatccatccaggcagcacctgacagctaacccatctaatagaccactctaatccagcattttcctgctcaaaatctttcaatgcattcttagcataaggcttgcacacaaggtgggcttcatgggtgtaggacctggccagtcgcacagggccccatgcttgggagggctctgcatttggtttgatctctgttgcactgtcttgaaattcttaatcatttttgaacaaggggccttatgttttcatttttcactggaccctgtgaatgaggtaatgggtcctgcttacatgctgagtccagaacccttagcttggcattcagaactgttgcaatttggctggctctgctttatagtctaatgagtacatcttgactcagacctccagtccagccattcatattgataatttactgtaactgagatatttcatgcttatttctgcttccagctctttattcatccaattcctctctcccaccataccatccctgctttatctctctttctctctcatttctatcctacctgccgaaggctgtaggagcccacctcttgcatcagcatgatctggatgtgagacatggagtcaaaggggatcactttggaactttaaggtttaatgactacaccatttggatttcagacttgtgtcgggcttgtagcccctttgttttggccaattactcccatttggaatacgcgtatttacccaatgcctgtacccccattgtatccaggaataactaacttgcttttgattttacaggctcataggcggaagggacttgccttgtctcagatgagactgtggacttggacttttgggttaatgctggaatgagttaagactttggaggactgttggaagggcatgattatgttttaaaatgtgaggacatgagatttttggagtggccaggggaagaatgatatggtttggctgtgtcctcacccaaatctcatcttgaattgtagttcccataatccccatgtgtcgtggaagggacccagtgagaggtaattgaatcatgaaggcagttaactccttgccattctcgtgatagtgagtgagttctcataagacctgacggttttataaagggcttttcccccactttgctctgcatttctcctcactgccgccatgtgaagaaggacgtgtttgcttccccttctgccattattgtaggtttcctgaggcctccctagccatgctgaactgtaagtcaattaaacctcttttctttataaattactcagtctcaggtatgtctttattagcagcatgagagcagactaacacactactcatatttgaagatccttctctcccatcatctctccctgcaatgatggtcttttcctcctgcaatgatggtcagcctcatttggcttttatgctaatttttctatcagtttcttcctttatttcatgagtcttattctcccaaccagtaaatatttgggttcaaagagcatgttttatttgtcagtgccatgcctgacaaataatgccttacagtgtgcatggttgatagtcgattgatgagctatttctcctctgtcggcagtgagggttttaggtagtttccactttacatacaagtaacaggcataacacaggttaaaatttgctcaggcaaagcgtagaaaactggaaatagtcatggagcagctctctatattatttccataagtatgtattgaatgcctgctttgtgtcaggtgctgtcccatgctcagcaacaggaaggcagttgcagagtggccactctcattagatctacagcaaagtgctggggtcacaactccagccccattgcccaagagcagtatggtcttgtacgagaaacttaacttctgtgtgccaaatttttccatctgaaaaatggggataataataccaaaagcacaggcaagaaaagaaaaaattgataaataggatttcatccaaattaaaaactgtacatcaaaagacactgttgagtgaaaggacaacccacaaaatgggagaaaacatttgcaaatcatgtatctgataagggattaatattcagaatatataacaaactcctataactcaacaacaaaaccacaaataacccaactcaagatggacaaagaggccaggtgcagtgactcacgcctataatcccaacattttgggaggcagagacaggagaactgcttgagaccaggagtttaagaccaggctaggcaacatagcaggatgctgtttctaaaaataaaaataaacagccaggtgtggtggcacacgcctgtagtcctagctacttgggaggccgtgtgaagcaggaagaatctcttgaatctaggagtttgaggctttagtgagctatgatttagtgcaggctagagctgcactctagcctgggtgaataaacacaggaaaatatgctcaacactactagtcattaaggaaatgaaaatcaaaccacaatcagataacacatctcacccattaggatggctatcatcaaaatggtggaaaacaatagcaaagacatggaatcaacctagatgcccatcaatggtggactgggtaaagaaactgtggtacataaacaccatgaaatactacacagccataagaaagaaatgatgtcctttgcagcaacatagatgcagctggaggccattatcctaagcaaattaacacaggaacagaaaaccaaatactccatgtcctcacttacaagtgggagctaaacattgagtacacatggatataaagatgggaacaatagacactggggactagtagagggaggaggaagggagagaagtgagggttgaaaaactaccttttggacactatggtcactacctgggtgacaggatcattagtatcccaaacctcagcatcatgcagtatactcatgtaacaaacctgcatatgtactcccaaaactaaaatcaaagttgaaaaaaatggtggaaaataacaggtattggtgaggaagtggagaaagcagagcccttgtgctttgctgatgggaatgtaaaatattgttcccactgtagaaaacagcatcataagtccttaaaaagttaaacgtagaattaccatatgatccagcaatcccacttctgggtatatacccaaaagaacccaaagcaaggactcagactacctgctcatgctagtagcagtattcattcacaatagccaaaaggtagaagcaatccaaatgcccatcaatgaatgaattggataaataaaatgtgtatacatacatatatcatatatttacacacatacatacatatacgaatattactcagtctaaaaaaggaatcaaattatttttccctcctctactctgaaggaagaaaaaagaatgaagttctgatacatgctacaacatggatgaaccttcatgctaagtgaaataaaccagtcacaaaaggacaaatatgattccacttatgtgaggtacccagaataggcaaattcatagagacagaaagtacaattgtggttgccagagtctagggggaggacagatgggcagttattgtttaataaatatgaagtttctgtttgagatagtaaaaaagactggaaatgggtagtgatgatggtcacacaacactgaatgtgtttaatgccactgaataataaacctaaaaatggttacaatggtaaattgtatgtgatgtatattttaccacaatttaaaaagcatggataataatagtctactacacaggttgttttaaggattgaataaaatattatttgtaaagcacttagaagaatgcctggcacgtacaaagtttggttaaataagtaggtgcaagggtaagaccaattgatttaattctaggtattatttccccaaactgagccatgctgctgcctaaaccctgcaatcacaagataatttccttttttttttccccctccagtccatgtaggtcccacttttctctgcacctctgatatggtttggctgtatccccacccaaatctcctcttgaattgtagctcccataattcccacgtgttgtgggagggacccagtgggaggtaattgaatcatgggggtgggtctttccctagctgttctcttgagagtgaataagtctcatgagatctgatggctttataaaggagagttcccctgcacacactctcttgcctgccatcctgtaagacatgactttgttcctcattcgccttccgccatgattgtgaggtctccccagccatgtagaactgtgagtccattaaacctctttcctttataaatttcccagtctcaagtatgtctttattagcagtgtgagaacagactaatacaactgctgacctatgcagtgcagtagtcaagtctgtagcatctctgtcatcctctacttgtttcagcatgttagtcctgtccactcaggttggctgcaggtttttgaggacagagaccaatccacgcatctctgtacagagtttggcagtgctgggtccattgtcaccaataacgaaacaagtgtcatccagtagatcctctgaattcagttctgcatttgtggcttatcagaataaggtgaaaagggatgaaaggaaaggtgagcatctgtcatacacagtcttcccgcagctcatttgttcattcattagtagtgagcatgattcttttcccatataccctgttatgaaagaaaataaatgtattttcttatagctgttctgagtttccagcaaggctccctgggtgtaggagaaacttacttgcagtcaatctagagttttccttccatctccccaggttggatctaagagctggagaggcttccattgctctatagctggggaggggagctggagatggaggcctggtcctaggtgtgatctaacctctgtgaaggacttgctgaaacattcccggcttctatggctggtcacagctgtatccacccactttctcaacctcaaggcctccaagtgactgtcagttccctgtgctcttagggtgccacagccagcccgagggatgttctgcagctgggcccacagagcaggctgtccaccatttatgccaccctcgggctcacagagaacatcctatggctcccaggtgaggcctgcacagccatgtctgctctggggccttgattccacctcctcctgggcttaagcagaggctggggctcagctctcatctctgtcaggttcctcagacacacctggggtttctcttgtcatgtgttcacctgggatgtggcttgtaggaatgatgcgggagagagggcaggggattcatccacgctctcctggcttctcacttctctgcaggacatctagttctgattagaacaatacttgtcctaatcaatggtttctgccctgagtttcctcaaaagtccttccttcccagtcacttgtttgccaagacaatcagctctattctgtggctgcctaaatggggtatagcaagggttatggggtagaaggaagtgttggggagagaagatgttaatatttttaaattatgaaatgtctcacactcatccatctgacaaatattaatcgagcatgctttccacatgacgggcacggtgctagtgctggacagaccacagaaagaaaaatggggacatcactgctctatggagccgacagcacagtgcagagcttccagtctggaggcaaagagctatggatccctcctatgcagaggaaactcttagcagaaaactgcaatctcaaaggatttaaaaatgacttcttagacagagggcaagagaatccattcaattttttattttatgttttttttggacagagttttactctgtcacccaggctgaagtgcagtacattctgggctcactgcagcctctgcttccctggttcaagggatattttttttttttttttttttgagacggagtcacccaggctggagtacagtggcacgatcttggctcactgcaaactccgcctcctgggttcatgccattctcctgcctcagcctcccgagtagctgggactacaggtgcctgccaccatgcccagctaatttttttgtatttttagtagagacggggtttcaccatgttagccaggatggtctcgatctcctgacctcgtgatttgtccgcctaggcctcccaaagtgctgggattacaggtgtgagccactgcgcccagcctcaagggatctttaggcctcagcctcccaagtagctgaaattacaggcatgcgccaccatagctggctaatattttttttttttttttttttttttttttttttttttttttagtagagatggggttttgccatgttggccaggctggtctcaacctcctgaccttgagtgatccacccgcctcagcctcccaaagtgctgggattacaggcatgagccaccatgaccaccctgccattcaacttttattataaataagaattaaaagaaaagacagcccctgagaagaactaaagcattgtatgggccacacttgtgtgcttacaaaatgcacacacacaaatacgtggtgaataaaatacccatctctctgagcaacggcatcccacttccttaaactctcctccattaggattaagatgcttggaggtggggaaatgtgtgtgggtgctgctgcttccctgatcccttttttgaaaataaaggaatggaggatcggggtcctctcacgggcaggtgtgtttcagctcccaaggcctccggcaatgggggtagccagggagaccaagggtgtcaactaggggaagagaaagttgaactagaatgaagagaggaaaccaagtcctgcagtgcccgggctccggcctcagggtgtcgggccagcatggccctgaggataacactgcccagaaggatcctcacggaggggcaggggacaaagcaacacaggacaccagctacattctgagaagagcggaaaagagattatgaaactccctgatggcccaatacggaaaacggggatttgcttctctaatgccacagaaatgcatccagaaaatactaattttttactctgatttatttatgattgcgaaggaaaggcatgttgatttccggctctctgtgatgtgcttttgttgatggaacttttttttgagacaatacaattgacccttgagcaacatgggtttgaactgcgtaagtctacttaaatattcaggttttcttccgcctctgccatccctgagacagcagagccaacccctcctcctcctcagctcgctcagtgtaaagaagatgaggatgaagacatttatgatgatctacttccacttaaggaatactaaatatatatatttttcttcctcatgactttcttaataacatttttctccagcttattttattgtaagaatacagtatataatacatgtaacatacaaaattcgtgttaatcagctgtttacatatggggaaggcttctagtcaacagtaggccgtgagtagttaagttttgggggagtacaaagttatacacatatttttgactgtgcaggaagtggagactagtgcccttaacccctgcattgttcaagggtcaactgtatatcacacattaaattattaacagaaaaataaatttgtaggccaggcacggtggctggagcctgtaatcccagcactttgggatgctgaggtgggcacctgaggtcaggagttcgagaccagcctggccaacatggcgaacccctgtctctgctaaaaataccaaaattagctgggtgcagtggtgtgcaccagtaatcccagctactcgggaggctgaggcagaagaatcacttgaacctgggaggcggagtttgtggtgggtggagatcgcgccactgcactccagcctgggtgacagagtgagacaccgtctaaaaaaaagaaaaagaaatgtgtaaaatatttatttgaggaagtctgcatttttctcaagcagttcttaccagctccaatgagaatcatgccagaggaacacagcggcattcttgtatttgtcagtgttggttgtgtggccctgggcattgctagatactgggataaagatgggtaagacagagcctgggtcctcaaggaacttaacagccaacaggaaggggaagataaatactcaatgaggaaggaaagaagtgtgtgaagaaggaggaagaggtggttacattcttggaatagcttgcatactcaaaactctccagtggctcccatcttgttctgagtaaaagccaatggccttttactgagatggcctccaaggccctgcttcaatggcctccaaggccctgctccacctgcctggctcttttcctctcaggcctcatctcctcctctctcactgctctctttttccccttcttccctccagcaagcc

SEQ ID NO: 605 - DNA, 20001 bp, Homo sapiens
ttctgactgcatgaactgtgacctgtgtagtttgattgtgtctattcctggggcaagtggcttgatcagtcacctccagtaggaagggcatggtgacagacctgttgtagaactgaattccagagaggagaccatgcccagcgtggttgagcccccacacaagttctccccatgggttccttctgtcctccttcccctgccccagaacagtcctcagagggacaatagggtagtgagtgtgtgacggggtcacgtgagccatgtggcctttcatcttccagcttctgtgtctgaatgactccctctgatttcacttagaatcccaaataatccacttgcacaaaaacatcagtgagctctgtcacctttatgtgacacagaggaaacttgacgacatatacgttgcacatcttagtacaacttataatccctcaacagctgtttctcttctccccttcctcttctatttctccgcttccctgctccttccttcccttcatggcccccagccaccttggacctactccccatcccacctcccctgtgcttcgggaacttcaggctcctggcctttatgaatagtagtgcagttcagcccttccagcatcgaactccacatggagagacacaggcgacccctcagttgatgggaccttctccgtttataagatgatcatctttgctattcaagtgagccccttggggtctttttcccttcatctaaagtcattaatacattttctaatgcatgtacagtgaaagagtacaattttctttattcttattgcctctttaattctggcttttacacaggacatccccactcctgtctagccatgggggtgggaagagtgggtggctgaggcagggaccaagcctattctctctaagcatggcgaggtctttttccctgagtccctggcaggaggggaatatcttcctggcatcctgagtctcagtcctggatttatggtgcagtgaccactttattcactgctatgagcctacttttgctttgtaagccaacagatttggtccaggcaagtatcaccaccagaaagaaagggtaaacatttctttttctgttttttgagacagagtctcgctctgttgctcaggccggagtgcagtggtgcgatctctgctcactgcaattcaagcaattctcatgcctcagcctcccaagtagctgggactacaggagcctgtcatcacgcctggctaatttttttgtatttttagtagagatagggttttgccatgttggccaggctggtctcgaactcctggcctcaagagatccacctgcctcgacctcccaaagtgctgggatcacaggcatgagcccctacacccagttcaaacatttcgattttaagcatagacttttatgcattttggtattgtcaggagagaatgctttatatttggcaagactttgtcttaaataagagaagtgcttttccaataagatgcaaacttgaaaggaaaagaacacaggcaagaaatattagctatttgggggaaacagacagataactgtctgctctctcctcaagagaaacataacacccggattagtgttactaggtgtggtctcatgaagtcagctggctcaacgttggatggaatcctgctctttgggagagcaatattcatgtgttaatctagtatggcagtcagtttcttttcagtggaaggaaaactcaaatgaaaaatgcaaagccttagcatcttttctgaccaagctcaggggtgtgggtttaggcgattagctgggttttcattctcactcctgggagggtgccagcattgtcttttcctggatagtggagtgtgtggcactcttgcatgctccttttccttcttatttcagtcccagcccaacccctcctctttcttctcatttaaaccaagccagtactaacccagggcagctccacagagaggggcctcttgaggatgggaaccagttttgcttacagtagtgtcccaggatttcgcttagtgcctggtgtacagtagctgctcaataaatacttgtggactacagaagaaaaatggaatggggaactagcaaagcaatccctgtgtaaagcactgtggcccctattctggagcaatttacaaactcaagagcagtaagactgagtagcgactcaaggggctatattcacaagcttggggtggtgtggtgttggatgtgctcatgcttgtctgtactggaggtgactgagactgatgctgttttcaaacagcaagacattgccagcaatcctcagaatctggaaggcaggcaggaattggaattggaatggattagcggctgtctgcttgtaggcaaagctgtctgaaatagagtgcaagaatcattgatgtccatcatggaacaagattctatgaattgaaagggacattagaaataacctaattcaacctcccctttctccccttcctgctctcctttggcagagagagaaactgaaacctaaagagtttaagagacgtattcaaaccacatagttagttggcaggagattctagaacatattcctgatctattcccaactccattgctccctggcgatcttactcctggaagtggttcttaaacatttcatggtcactctttgataattggatggaagctctatactttttgcatcacaaaatgcatatcctctgaattatacaaaattctgcatattctggggattcctgtaacttactatttattcccacgacctctgtttatttacaccattgccattggacaatgtcagaaatgcctctggggttaaaccaaagcttaatcttcactaaagattttaggtccagccccttttaagggctacagagccaaaaggcaattttcctattctgttggggagtggtaagaaagctgtaattgtaaaatgagatgaaaaaagaaaaaacactacaaaaggactagtgtggttgaatcccaggggtgaaaaactttctgagtggaagaacttggagaacgtagagtcattgcccacagtgggggactctggcctcactgtctgaaggattgcaaacatgcctacgtacagtcgtagcacatataccttggggaacaatgtctctctggcagggggcaagtataagatgacttaataaatcttttccatctctaatttctatgattctgtgaaataaaaacatgagtcacagaccttctaaaaagcaggccatttcagagctggcttgatcaccaagatcagaattaaagttaatgtctacatctgggaatttaaatgtgcagactgtggtgttcacagggaggcagtctgaaggacattctggaatcagttgattttcacactgttgctttttagcactgggtacttcagaaggtgtaataaaaaaaaaacaaaaccagtcagatcaaatatgtgaggagggctgtctgacattctgttcttgtccccacatgaggctgggactttcgtgtccaggagacttggttgctggttctgtgtcgttactctatttaacatcaccagtaccgtggagaactgccatggccatagggatgcccaggtagacagagatacaataatgtggtcttgggtccattcattcattcattcattcacaaatttcgaaagaatccacctgaccatgagtctattcgtcattgcatactgtgtctatcacatcaaagcacccttggatctgcctattgaaatcagaatagagcccaaactccttgaggtggcattcaaggcccaccagcgtgatctggcccctgcctactctggcctcgtcttcctttccttctcctcattcactgtgttcagcaagacacccttattttgaccccctggaatgccaaaaccttactgatctcaggacattggcacttgctcatccttctgcaagagtgacagctttgatctttccatgatgtccttatcacccctcaggtccccaactaaatatcccctcttcacagaggcctcccccttgatcgcgtgagctagtgctgtggtccagctcactctctagactttctctagagcacttgcctgtactgggtagcaccaggtttgtttctgtgtttatcatctgtcagaaaattagttctagggcacaaagtctgccttgttcaccactgtattgttagtacccagagctatgtctggtgtatagtaagtgctcagtaagaacttgtggactaaccgattaaacaaacttaagttagacaactactacctgccaggaactttcatatctgttgccgtgtaatgtttatagccttataaactatcatccgtatcttataggtgaggaaatggatttaggcagagtgacttgttcaggatcacagagcaaataagtgccagagtgagacttaagtcttataaacacacattccaagctccacctgctagaccccctcatgctttacaggagatcgtattatgagaagcttgaacacttcagatatttgtaggaaaagcctcagcattctcttcctgatctagccagggagtttagctcttccaagattttcagcttgaggcttacaaacttagctgataactcacctgcttctggaaacagacccagggaaggtctcagtatggcaccttgtcccccttcctcaatcctctccttgtgacttccacttctgttctgagccacttgggagttggcatcactgactccattcacctacagagccgctgccctgcctcgtccccttacccttcacagcccaaccctcaggttatactgagttcagagaattctaccataaggctgtcataagaagaggacctgtcccatgtcttggcaattgtgtgggccctccctttttctttccctacaggtgcaggggctggtaattagatcccaactacaaacagtcaaggcatggagggttcttagggtcagaaactcctcccctatcctaatcttccagatcattctgagaagcctgaagtaaaaacagtagcataatagggttaaatcagtatgctttattcttccccttcccttccttcttctcccacccccttctttcttctctttcagcagggagcatttactgggcactgtcagccctgagttaggtgagagtgattcaggggcagatcagacataatccctgcgtttgtctaagtctggaagaaagagttagaaatgtaaacacataggtgtaattaaatttttatttttccctctttaataatctggacgtacaattctaggtgactgggatttttcctcggaagataccacttcagcgccttttggacttcgttattgctgatgagaagtgtgttaaactctaagattatctgctgttctttgcagataatctgttgtttttctttttcatgttaaagacttttagaaagaaacattgatagtatatagtttcactatgatgtacccaggtatgggtttatctttatttttgatctcagaatttgaagtacaccctaaatatgagggtttttgttttctttaattctagaaaaatctaagctgctatcttttcaaatattgcttctccaccattgatattattatggacctttttcttctctcttccacatctctcttaactgtgtctatctgagctgagattggtctatgctgaatttcccaggcctgtttttcttttcttttttaaaattaaaaattttaaaaatataatcacaaacttacaaaacagttggaagtatagtacaagtaacttgttttctacagacctatttgaaggtgagtagctgacctgatgctacatcacctccacatgttttggtgtgtttcctatccctaaggacatgctcctacatagccacaaggaaattgtcaagatcagaaaattaacagtcatgttgctaccagactcccttcaaagctcaccctgttccaattgtagcaaaattattcaggctggaatcacatgttgcatttagttgtcatgtctcctttccttcttttggtctggaatggagcctcagtatttccttgactttcttgagcatgagcttttgaggagttacaggccagttagttgacgggatgttcatcagtttgggtttatctaatgtttcttcatgataaggttgatctcacacacctttggtgggaatatcacagaagtggtgggtattcttctcactgtattccatcaggcggcacattatttcacattgtcccattactgatgatttttctttgatagcttgacgaaggtggtgtctgccagactttgccagggtaaagttatcctcttcctctttctaattaaaatgtgttttatggggagatactttgaaactgtgtaaatatactgtttcttatcacacgttcaattcattcgtatctctatgaactgatggtttcctgctctatttaatggactgtaatctggtactcttatttattttgatactgaaattgttcttgatttggccattgggagtccacccaggctgcttctgtgttctttggatatatctccatcattttttgaggatctccttgctttttagtatgacaaaatgttttagtctcatcttacactttccctagcccaatactggaatttttttaagaaaccctgatcttgcagtacagaatagtacttagaagccaatatctgggtagtaggtgtgctcatggttcttgtggtatctgtgccccaaggccttctcagtggacagagctagggaatatgtacatgtgtattctatatacatacgtatatacatagagtagatagatatatgcatgtatataaacatatgtatgtatgtatgcatatatgtatgcaacatacaggctgcccccacatgtgagttccctctttacttggcttggtttccaggctgctgctcctgcatggatgatcttctcatgctgcttgatctaccttctttttaatttcactaattatctctttgcttttagtctagagtacattacatctttgagtctttaaaaattgcagtgactatatttttcatttccagtatttcaaataagcttttgaaaatcatgtgtagcagtcctttctttcatttttgtgttttgttgtataaatttttggtcatgtttaatggtgtctttctttcatttatttctctgagtatcctaaatgcttaccaacattattttttgaaattctaccatagagtttatttcatctggagtgaatttgcgttcaagtttgttggctaactttcctggtattaggtttcttgtgttttagaattttggtttgcgggtttaagtgagagcttttgttgttttctttttttctctctcttaatattcagttcttttttttattgttccatttttgctttatcactgagctgccaggtcttaaaattgagatttgattgcagactcagtttcttgtcatgaagctttgtttctttgttcccatatcccttggctcacaacttcttatgaagctacagttccctttatgaggtcagtaaccttttattttctagctgttaacataatcaagaaaactccagccttatggcttcttgcagggaacctggcccaatgcctacccacaagtggggaacctttagttctcattaccctgtcttgcttccagcagcttctggctatcactgcttctgactccagaacccagcaggcccacagtgtcagccctgaatttagatttttgtagatattttgagcatagatatgtcttatggtttcatctctttttgtctattatttggaagaaagttgttaaaagcaaaggtttaggcaaattaaatttagcagagtttatttaagcaaagaattattcacaaattgggcagccctcagaaccggaacagaaccttggaacaggttcagagaaacaccggttggctacatgatcaggcagcattatatgggcagaaaatggaaatgagatacagaaaacagaagtgaggtacagcgtcagcttaattggttatagcttggcgcttaccttatttgaacatagtttgaacagctggccacttgtgattgactgatggtcagctgctgtgattgtctgagactcagctatttgttacagaaacatccttttaagttagactttcagttagtttatgtactaagttaggttacagtttgttatgtaaggacccaagtacaaaggcatcctcaggccaaatttagtctaatttaacagagtggaaggcaaagaatgaagctatgagtctatcttgacagagaaccttattcttatttttttaatgtatgaatctgtgaaccctagaccttccttagcatcatgagacttctctacaacttttaaccacatacatggaaactcagtcccacccatgacttctggaagtaaggaatgtacagtcctttacaaaagtcttactactaaaggatcaaacacatttggcgatcagtagatagtaaaagtcagttcttttcccttcaaggttatcctagcccatactgaatgtcctctgatgggccttagaagcctcttctctgtctcctcccttccttctcttcctcatgatcaactctacctttcccaatctttcctcttctcctcccagcttccgtttgttcctctctgtggagttggggtggctggtgctggtggacatggtggggatgtgtatgcttcaggtactgcaatagagaaggaaggtcatgaagaagaggggctgtgcctgaatattctgagagcaaaactctggtgtgttacttaaatgtctcagtctcttttccctgaatttcaaagatcttttattatgttttatggccaagttccttgaaaggagacgatcttgctcccagttccagaaaaggagagggaagcgaaagaaaacttaattctgccatattttcacaaaattaatttggtccccattaaatgtcacagaatatgttgctttggaaaacttttagtccccattgtaagttcttagagccacaaagcaaatctaaggtacatctggaaacttctaactcattctacaaagtagaacaaaaaccaacaacttcttgaacgcttttgaggaataaactgaggcacataggcagaattcaattaaaagcacatcataaacttttaaaagtatcgtgacagcagtagaagcatctgaccatttcaggacaagacttccagttacatggaaaccagtttcatttctccagtctttgcagagcctaataatgtggtacaaacatgaggttattttactttatttgaaaaataattcatctcattttttttcaagttctctcaaatgaaatctgcctggtacctccaaaagctggaagccctttttttgttgttgtatttttgcacagttcagattttctgcttcttcaaagggtcagtttgtacagtgtctctggaatcaggcaatcttatgtcagaatcctctccaaatattcagattgtaattactatggtgccaatggaaaacagcctcttcttagacaaaaggatgatgatggtagaagcagaaggctatctgtctgccctcagttcctgaggtcccaagaaaagaagttttttgttagaggaattagactgtggctctaaagcatatggaaagcctctaccagtaagttatataatcagggactaagttctttggggtatgcagcagataaatggtctttttgactcttgacactggtaattgatcacctgctagaatgaatcatgaagggagggtatgtgagaacaggagggacctttctataatcacgagtttctaaatccaaaggctgtggtgactgtaagacccctctccagttttggtggctcctaaaaaatagggcatattataatgacacatggatgttttatagtcccatctatctaggtatgacaatattaattgaactgtcagattgctcgggactgagatgcttggtcaaaatacttggaattacagagaaaaaaattcccagggggtcaaagcaggtgtactcaatgtggaatgcaaaattcacagagttagtgttgcctgcctgcttttatctggtcagagattccagggagctgtggggctcattcatgcttgaaggattatattaagatgcctggatcttgcagagctgtctcaggccagcatgttgtgtgcacagctggttctgttaccttaaaacaccagttagttttgaattaaggctttgatgaaagatgtcagtgttgatcttgggaaactctttacacattaattcaagagacgtgttagctaaagagtttggggcatatgtttggagatgtactaagaggagaaagggaaacaaggtattatttctatattacctgactctggttggggaaaagtgttagaccttgccactttctgaaatttcggttgggaattaaaacacagattactattggttttaaaatgttgagttcatttaatcatgaacacagcattcagcattttctcaatggatatatagcagtgctaactgtaagaaaaaagaggaaaattaacttttcgtcttgtaaatagcaacccagaattctaactgcccaggattctgaagaataaattcattgaggccgcccagtttttgcaactgccatgaaaccacttaaagattttatgtctgagagccttgctcaagattgttatttaaaaacgactgtaatgtggaatacaagtgccttaaggaaactgtcctagaaactcatagtccaaggcaggtgagttctggccactgttcggttggtctaagagaagtaccattgtatggagattttaagtagtgtctagttggctgtgcccagccaggagggtgatgggagggtgagcatatcacttccctattttctattcattgcctttaccaatctaccccaaaattgggagttatcagtcctagagcacccactcggacctgcctatttgtcttctcacacttgtctcgcttctacatgagataagttatgctttttcttgtcttcatatctttgttcactccatttcttttatttagatccccttctgcttctcagagttcttcccaaatcccctgtttctgaggttgccacataaccctttggagctagatgttcagtaaatacctaagacatgaaatgaaatgaagtgaaacaaaatgaaataaaaaagggtcatcacaagatccagctttttcataccttctccctgtgaggtgccctttagtggcttcctggtcactaaaggcattcgccatcggtaggactgcccttgactgggcgctgctgttacccccaagtctccaagctgctctgtgttttcaggagccctccaatgtgccagggcaggattggagagctgggcatgtcctcttctctattactctttgctttaagggtacaaaaacagtgttgctttgtctgtttcctactgggagctcagagtaaacacagctatacattcttgattaacatctctcagcctccttgtaattcagatacatccaagtgagaggcatcatgctgtagtgcattcatgcatttattcatggacgaatgaataaattcatggacgaatgaataaatggatgaatggagtacagcatgatatctcaattcagtgatatcctgcagatctgactctgaaccagtaaggggttcagggtcagatccataggatacaatggtgatccagtagatagcatccttgccctcaaaaatttagggctatagtactgagccaacttggtgtgtctacctcctttgtctttaggtgttttccctgtaagcttcctctgattcttagggggtggattctgggcaggtctgtcctgctcttctgccaggtgaggccaggcaggtgtaatggggctggatttaatcctacctggaggtgacagtgggccatgcaaggggtgggggaatctctgtgtctttcattccctccctcccaagatcaggtgcttggggcttaccctttcacactcacccttgactcaatatcagactcctaccctcctaccctcggtttcagaaggtttataaacctgatgaataggacttgcccatgtgggacagtttggatggcaaggccgattcttgcgtggtatgcagctgatggtggaaacaaggacagctcagatggccgttcaaggcaggtggccaaggagcgcacaagaatggtggctgatggtgtgcaggttgggatcagctcctgcctggatcttaggtactggtcaatgaccacatgtgttgggcacggccctgggcagtcactcagagctgacccagctccttttggtcctgtctgtccagttctggcctcctcactgtagattcacagagctctgcccaggtcagactctccacttcctagcctgggcagctctcctctgctgtccatatcacactctccggtctttgtctatttttttttttgacaatccactcattcgagcagtttctcaaagaggatgctattggcattgtgataattaaatagtcataattaaatccctgcccccagatttccagcttaaccctacttcccaactccaccatccttgagaaagagggggaggtaccacttctctcgcagatcccaatgacagggtcatggtcacaaactctaagccttgtttccttcaaagttcagcttttgattctcaaaaactttttttcctctcaaaaaggctggtttctataacacaaaaatgtttggatttccccaattatcttgtttctgttatgtatttttaatatccatgtacaagcttagaaactgaatattaaaatggcctttttgcatccctgctgttattctacctggggcaatgaatgggtgggggcggatagggcctggcatttccaaggaaaatctgtgttcaacatttccaaatttcagtgcagtgcccatgtctgtctcagcagaaaaaatatagcttaggctccagtgggcgccttactccatcagctgtagctttctatgatgtcacctggagcatcgtccaccccgacattggccccgctttaatcaagatagagaaaaatatagcatggctccttaagatgtccaaagctaaaatagaagaatcatttgccagggggtagggggtacagatttaggaaagagatgacaagacacatttctagtttgaagcgagtagatatgtagcagaaggcaaggacaactttggagaaattgcagagcagttgagggtcccaggccctcaggcaaaggctaagaaaattattcagaataaaagcagaatctcattagaaaatatgtgtgaggtagatttgtaaataatgaagaactataaaagccgagaatgcttatcttgcttcactaaaaagtgaacagcaatcagaatggcaaagaataaaagacgtaaaaagagtaaaatggcaaagagcctgttagtactaagtgtggccaagggggtggtggggtggggagtgaacatttgcttacttagccattaagatggtgaattcagatatccagattctggagtatagtttgacaaaagtattgatatccttagaaaatatatactgtttgataaagtaatttcactcttgtatatacgaagaatgtttatcccagcattataatggagaaaaattggaaaatatctaaatgtaaatcagctaaggatagttaaataaatttatggcatggccattcaccatgataatgttgatctgtatttattgatcaggaaatgtaaccatctgttttttgttaaatttttttttgacatacaataaaagtacataattaatatataaaacttgctgagtttgaaggtaagtatatccccgtgaaaccatcacagtaacctatgccataaacctatctgtccgtcacttacaatcacctccaaaatttccccgattccttttattattacttttgtgatgagagcatttaacataagcatattttaaattgtacaatacaggattgttaactgtaggcacgatgctatacagtacatctctaggacttatttgtcttgtataatagaaattttgtaccctttgactaacttctccacatttctcctcccctatcatatgtttttgttttgttttgttttgagacagagtctcactctgtcacccaggctggagtgcagtggtgcgagctcgggtcattgcaacctctgcctcctgggttcaagtgattctcctgcctcagcctcccgagtagctggcattacaggcactcaccaccacgcctggctaaattttgtatttttagtagagacggggcttcgccatgttggacaggctggtctcaaactcctgacctcaggtgatctgcctgcctcggcctcccaaagttctgggatgacaggcgtgagccactgtgcccggacatatgttttttaagtgggaaaaaaataagacagactataaagcatctaaagatagtgtcatgccatcttggtaaacattttaaaattttatatatatatatatatatatatatatatatatatatatatatatatatatatatatataaaatttccaaactatttacatatttatatatatatatatgtttggaaatgtctaaaaggatgtatgctaaaatgctatctctgggctgtaagattgtaggcgattttcattcttttccttataatttgtattttctgaatgcttggtaaagagaataatcggaataaaagaaggtacttccccttaggaatccagtttaggttatttgtgcttttcttctcatcagtagccagaaaatggttgggaaaaatgggacagacagagcaacttgtaagggtcctgagactgccctgggagcctaaggtgattatagcttttctttctggaataaagaaaaaagattcaataaacagttaaacagagtttggatttcttttaacttttgttctgccaagtatatagcccatgtgtaagaagaaggtatttgtcataccatactagtgttttatttattaggaggaaatgatgtattttgatgtcctcacagaggtaaatggagcaggcttatttgtctctgtaggactatttgcactttttatctttctaacagcatcaaaatggagctgactccatcaagattgccttatgctcattaccttaggggaggtctgaattggctggaggaagcaggcatgtggggaaaaatggagaccaagccccagaatggttaatcaagtgtggtttagaagcccagtttcatattatttatttttcacaggagttttgttctttaaacaaaagaaacaagcgcaacaagcatggccataccttagtgggtccacagttaggtctgagcttggacctgtctcctctgcatctgcagtggagccacgcctcactcgactcagtagcaggtcatgtgtatgtgggaatattagggattgtaggagggttattagcatcactggaagcctcaaatttgaattcaatcttaaaaactggtagtttagggggagctgaatgatgagaacacatggacacatgaggtgcagggggaacacacacactggggcctgcaggagtgtgggggtgggaggagagagagaataaagaagaatagctaatggatgctgggcttgatacctgagtgatggcatgatctatgcagcaaaccaccatggcacacgtttacctgtgtaacaagtctgcacatccttagttttattttttagaccactttattggggcatgattgacatgcaaaaagctgtggatatttagggtatacaactccatgaatttggggagaagtatacacctgtgagactatcactaccatcatatcaaggccataaacacatccatcgccttccaaagtttcctcccaccttctttattattgtcattattatttaattattcatcttggtggtaacaacagttaacattaggtttactcccttagcaaattttaaatatacaatacagtcttgttagctataggcaccatagtagatctccagaacttatttatcttgcataactgaaactttgtaccctttgatcatcacctctcctttcccctgcccccagggccctggcaacccactgttctactccctgcttctgtgggttagactatttcagattccacatgtaagtgagatcatacagtatttgtcttttaaagaaaccaccagtattttattacttttatgccaggaagcctctaaattttgtattatgtacatcctttagtgaatagaaaagtgtgctgatagcttttgtgaatgtatttctgaaaagtgcaagaaaatgcattatttacaagcaggttaaacattcctcctgcaatttcatttatgagcttaattttcccaaaccctcatgaatatcaaaaggtaaactccatctcagcacacaattagtggctttatatatataattcttatttgatcattaaaacagcttctgagctctgcagaccaatctcttctcccctcttgaccctgccagcctttattttgctctagctttatgcaatgacctccacccctgccagcctttttgtctgactaggcccacatatgtgtaactgaaatatcatgaattccagatgagtaggatccaaatttgtgagcttattctatatgcttattaattccactgccccacacaggtggaaatgtggttttgagagatgttggacactgtgaatgttctccatgcactgcaaggatggaaaaaacatgtgctaaataactctgagctgaccgactgtaaaaactcatggtgcgcaatagctcttaaatttttataatggcctgcttacctttggtggtctcattacaaggcttcagtaattgttatgttgggattccgtctaatggtggaagcatgaggtaacattgttttaagatttcttaaatgagttaatacctgggaggtgcccttgccccttttcactcattaaacagaatgtctttgtctcttagcttatattaaatacatttaaggggacaaaagagttcctaaagggaataaaaaaatgtactggagtgagatgtaagaatgcacctagtcaaaccctgcatacaagcttatgatgagaagctaggtggtggtctactttgttaggttagaaatgttcttaaaagaacaccagctaccaaagatgggaactgtgtgtatatattgaaataaagtgggaaaaccaggtcagcctgaggattaataggaggccaaagtggctttaaaaaataggcaattgaagcaaagtgcttttaaagtttcacttatttaattaaaagtcacaattattcatttatctgaagctatggtttctttctagattcatggttaagaatattgattctggtgctagactttctgtcttcaactgtgggctagctttgtcatattgggtgagttgttcacttctgtaagccctagttttctcatctggtaaatggggaagacaatagtatcttataacattgttatgtggctttttttttttttttttaggctttaagttttagggtacatgtgcacaatgtgcaggttagttacatatgtatacatgtgccatgctggtgcgctgcacccactaactcgtcatctagcattaggtatatctcccaatgctatccctccccacgccccaccccacaacagtccccagagtgtgatattccccttcctgtgtccatgtgatctcattgttcaattcccacctatgagtgagactatgcggtgtttggttttttgttcttgcgatagtttagtgagaatgatgatttccaatttcatccatgtccctacaaaggacatgaactcatcattttttatggctgcatagtattccatggtgtatgtgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggccgggtcaaatggtatttctagtttgttatgtggcttaaaggaaataatccatgtaaaacatttaaatagcatgatgactggactcaataaatactgttaatttatgagtggttcttgttccacagatggtgttatttctgctctagacttgaaggatgtaatatatttttaatatatactttgtgtcttcacacatatctttttttttttttttttttgagacagtcttgctctgttgccaggctggagggcagtggcgcaatctcagctcactgcaacccccacctccggttcaagtgattctcctgcctcagcctcctgagtagctgggactacaggcacccgccaccatgcctggctaatttttattttttattttttgtatttttagtagagacagggtttcaccatgttggccaggatggtcttgatctcttcacctcatgatccacccgccttggcctcccaaagtgctgagattataggtgtgagccactgcactcagccttcacacatatcttatttgattcttcccaccatcttttgcgctaggcagggtaggtgttattatcaccttgtaataatcagggtagggtaggtaatatagtttggatatttgtctcctcctaatctcatgttgaaatttgatccccagggttggaggtggggcttggtaggaggtgtttgggtcatgggggtggatcactcatgaatggcttggtgccttccccatggaaatgggtgagttctctattagtttatgtgagagctggttgttgaaaatagcctggcaccgctactcttgttctctctcatcctccctctctggtcatgggatatgccagctctccttcttcttctgctatgattggaagcttcctgaggtcctcaccagaagcagatgctggcaccatgcttcttgtacaacctgcagaaccgtgagcaaaataaatctctttttaaaaataaattatccagcttcagttattcctttatagaaacataaaacagactaagacagtaggcttcagtaataaataggcccccaaaactttggtggcttaacccaatcaatgtttacccattgctcatgaaacagtccaaggaaggtattttgggttagagggcagcttctttcacagggtcattctgggatatattttccagctttgccatcctttaatatgtagacaaccaggtcctcatcattatccacgtgcaactggtgggaagaggaaaaggtggcacaataaatttttggcttgaaaaatggctcacatcacttctgtgcatattctgctgggtaggaatgacagttacatggccatgtgtaactggaagggacaccaaagatagagtctagctgtgtgcctgggaagaagatgaaacatatgacagatttatggtgaagagctagcggtctctgccacacgtacatttaacagggtgaaactgagttcctgggaagctaatgcaatttgcccaatgtggcatagatctttgtagccatcgtccaatatgttgggatatgatgtgaatcctagctagaatcgtaactgggggcagcggggcagtgaagaggatgtagaaggaaaataagacagagctgaggtcacggagagctagccggacatgtggcgtggggatgcccatccaagcaaattccctggagggtgctcacagctgctttgtttagtgctccatgccactttgcttgcatttcttgctgtttctttttcccatttgtaaacgcctgctgggccacttgccctgggtaaagaagtttcaaatctccactgagataaaacaatagcacctccccagctgctattgttgcaggcaccctggctgcaggctcaaggagaaaaccttgaatcaatttgcctcatggaggccgaggagttggctgcctgcccttcacaacttgttaaagtgaacacttagactctaggggggcgagagggttgattctcgctccgtgatcctccccactgattgttttaggtgctgggatgtcagtg

SEQ ID NO: 606 - DNA, 20001 bp, Homo sapiens
caagctggagacccaggaatgttggtaaaggaaattccggtccaagcttgcaggcctaagaacctggggagctgttggtgtaatcctccatctaagagcaagagaagaccaatgacctagcttaagtagttgggcagagagaaagaattcatcttcctctgactttttgttcagagccctcaaaggttgaatgatcctaacactgggggaaggcaattcactttactcagctcaccaactcaaacaaatctcttccagaaacatccttacagacacatccagaaataatgtttaaccagggcaggcgtggtggctcacacctataatctcagcactttaggaggcagaggcaagaggatcacttgaggtcaggatttcaagaccagtttggctaacacggtaaaaccccatctctactaagaatacaaaaattagctgggtgtggtggcacgtgcctgtaattccagctactttggaggctgaggcaggagaatcacttgagtctgggaagtggaggttgcagtgagtggagatcacgccattgcactccagcctgggtgacagaggaagattccatctcaaaaaaagaaaaaacaaaaaagtttaaccagatatctgggcatcctctgtcccagtcacattgacacataaaattaaccatcacaggttatatcccatttatggtgggctatgtggtgttgtgctcatgtaagatccatgcaaaggagtaggggagatgagactagaggtgaaagaatgcagggtcttaaatgccagatcaaggattgagagtttattcagtagatgatggggacacatcggagttttgagcaaaggcataatataatctagatatttacttttatcacattcatgaatagctaatgacaaaggaaggataattgatcataaaagggaagagaataaaagcagcaaaattactcaagacgtataatagtgcaagaattgagggaccaaagcaagaatcaaggaggcacctgtgggaaccataaggcagagttgcaaataaagtggggacaaaatgtaaaatagtcatgcatcacttaacaatggagatacattctgagaaatgcatcattaggcgattttgcagtactgcacacatcacagagtgtacttacagaaacctagatcatatgtgtgtgtgtgtgtgtatatatatatatgtatatgtgtgtatatatatatgtatatatatatatatgaaaaacaaatttcccagcagcattgctgaatatcaataatttcccctacttaatctgcaatgccagtatcaaatgccacatatcaggcttctgcatatgctccattataattttatgggaccaccatcgtatttgtggtctgtcatgaccaaaacatcattatgcagcacatgactgtaagtgattgaatgaagtttaggtttttagaagagtgttcgtaccattgaccaaaataaaaaaaatcaggaagagacttttgcttctgggttagggaggaaaaataatgaatatagaaatagatatgttgagcttgtacttctataagtaaaatcatatagaaatgttgacggcagcaggagaagtagaacttgcgcttcagagaaagaaacaaattgagatgttgtatcagtaaacatagattagcttatgctacaataataagctacatgaacatcttggtgacttgaaacaatgctgcttatttgtaactcatgcttcatgttcattgtggttcatcaggggcactgtgtccatcctagttactcaggagctccatttaatagaggctctgtctcgatgttaccaaaatgccaggggttcagtctaggtcctgttgcttgctgcacggacggaatcccaatcactgaggcaatgagtactgacagggaagcgggctttaatcaggtgctgcagccaaggagaatgggagataaggtctcaaagccatctccttgaccgactaaaatcgggaggtgtatatagcagggaagcagggaggtgggaaagcaggaattcatggaggtaaggaagcaatcatgattgatgagtggtctggaatattgttgttcagatgaaatgatccggtgagttttagtttcttgcctgagagtagatttcctgaggaaggaactcaaatgagacaaatgtaagtttcaagttttaaggctagggagggtcagtttctatgtttattcaaacaactgtaaatgttagttctatgggacaacagggatgacttcagtcccccttttctatagatcaattcctcagtcatggggaatctggtcatcgatctttctggctgcttcatgctgaggagggatgttgtgggatcatgaagaggcttggaaatgttgcccctgtggttggaatcagtcaggggtacttttattttggttttagagcaacattttacaccacattgactaagataataaattacatagataacccaaatttagataataccaaagaatatggagttgatcccttggggaagccaagagaaagttcctgaaagccgcatgttcactttatgatttcttatctagcgtctttgtctgggctttgaatgctaacttaaggccctcccaaggttcacaagaccatgactgttttccctggagggatcccaaagggactggttttactcaagtctggtgaatccaagtctcaacactggttaagaacagaagggtggctggccagcagcacctcagaagggccgatccattgtggttgcagctggtcctccgcatgacttggttctctggtttcagtttcaaagagtgaggaggcacatccgtagggaactggagcctattggaagtaaactcagagaaagtagttaatatatttccaaagggtaaagttaatacccttaccattataaagccagcccccactggtttgcataggaaacatatcatctgcttcatctgaggtgctccacttgacattgataagtggagttgagcagtttcccttctcagggtaaacagatcttactggctttaagtattcagtaagtaaacagatattagtggcttttatctagtcaaccaggctggctattgtcttgggaataacctcctgtgtgcctgtaatatatatatttatctgtgattgttcactagcgagcggtgggttctgagtcaaccaaaacaggttcttctactttgcagcatttaaaaccaaagacattgctcttcagttagttattctcactacccattttagtaaaggtttctgaggaagctgatggtaccaatctacaaaacagaacttatccctttacattataccctccggtttcaataattacttgattttgcctttctccaacattgactacctttttggaaactgcgggtctcagaggtgctttttggtgcccgggcataattttcccttttgtgggtagctttgaggctagtggtctgaatccaaacagtctcacatctgagcttggtttagtttgaagcccgaactccgcactctcttactttctttggaactattatagataacaataactaaggaatttaattttttttcctcgttagttcacatttccttatgcatccagtgagccagctccccaggagcttaatccatctgtaaattccatgggtaacttgtagctttaataactgaaagcagcacagctgcagctccatatgatgggtgaccagagtgccatcaagaatcaaaggttaatttaataacaggtgtactctagtgtttttttttttgaaacacaatttttctttttcccaacccccatttctaccaaagacaaatcatagtagacccaatttatttgcaaaattgttagtcttattctaggtggcctgattatttgcataaaatacagcaagaattattgttctcataggttcttttaaattgggctttgctggaacttttcataaggaatctcagatttgaaattaaagacctctcaagcccggccaaggatttatctgtgcctgaagatacttgtatgaattgggtgaattcctctcttcttgaggtcccagaataacttgtggtttctgggcctgtcagaaagtgacattctttacttaccacaggccaggaaccctgcaaaggaactgtgtagaccaggtacaagggcagtatttttaagggactttcataggctctgtaagtcaacatcaattcctcaaagcattctgctcatatctgaaaatacattattccagtcaaagccttggtaaaataaccagtgcctccaattgtgtccagttataaaagaaaacagaattttattaaacttatgcaaataactattgctataaattaggaatatgcacagtttccaaattttgcagaaatcaggtagaaacagaaatatgcttcaaattttgatcacaagatatactccacacaatagtcgaaggctatacttagctcaaaaggaaaaaaaaagcctcgttgactctaaaaacaaaaacaaaaataatcagcaatttgcaaaagcaaattttggactatagctgattgtaagctgctttttgagaagaatcaaaatgaaacaataattgtagatgacaaaagtcttaagacacccatagttaaagacaaaattgacaaggaaatttggttatttctgtgacaatttaacataataatcataattattcctgataatatactaagataaatcaggattttaggaatctcatacaattttggaacacatttatataaatataacccaaagaaagccaaactccatttcatatttgacaaagcttcctgtaaaattttaacatatcaaatgaaaataatatgtccctcttgggcttcagggaaccctactatctaaaaagttagtttcaagtcaaaagactgaatttagaacttgaaattttgattttggaaagttggtcaaataacaaaggtttaaaacatttcgtatcacaaaataatatcacaggtcactataaaataggtattcatttagccaaaatactaattaccaaataataaggcctaataaagacagcatgaggccaaaaaaaaaaaagtctctctctctctcctctttttttcctgcagtttactcaaaagataaacaaaaaacttttattatctcttattaatattatatgaaaattttattcaaaagataaaaacaaattttaccttggtatgatgtattatttatgttaaagctaatttcaataaatctttataaataattctatccaagtttaataaatttgaccacaggtaagattttcataagccttttataacctttcacaattctctatgaaagagcaggtcagtgctgtaggagaatcctgtgattctgacacaggggcccagacactggccttggaaaagtgtgcttttgatattgtttactttctagagaaaatctgaactaatcttatccctcaaaatcagccctacaatctcacatgcccacctcttccccaatagtccctgggccaagagagatcaaacactttaacttctggcctcatgtcttatgaaagcagttcattttgattgccatcttctctcagtctgaagatgaggctttgattggtgtcagtgttcaagatttagcagaaggcagtgcctttttcggacccagccaaagctctgtaactcaacagcacaaggactttattagcaatagagaaaattacgtgatgtaaaagccttaattcctcaatgcctctaagtcccagtattcctaagcaatcaaaaacctaataatgatgacacaggaattatcttggtaaaatataaaattttttgggggggcatatagcaaaaggcaaagaaagaccttccacagcgtgactgcttctctctttttttttttttttttttgagatggagtctcactctgtcactcaggctggagtgcagtggcgagatctcggctctctacaacctctgtctcctgggttcaagtggttctcctgcctcagtctcctgagtagttgggattacaggcgcccaccaccacacctggctaatttttgtatttttagtagagacagcgtttcaccatgttggccaggctggtcttgaactcctggcctcaagtgatctgcctgcctcagcctcctaaggtggtgattgcttctctttatgggaagcttatttagataacctgaaagtcaaacctgatgaacaatttcaacatggcaagaaaagccaagagtatagaatcaaattattctagaggaaaacattacttttctagaccttcaaaataaacattcaagcatcaggccacaacatcagttagaacaggaggaaaaataaagttacagaagctgacaaaaaagttgaaggagagagttatcatctcaggcctttacaatgagaaagaaaaaagctgaaaacagcaagacacaacaaagttgcacctcagagatagaactctgagaagttttcaaaaagaaacagattatagaattaaaatcaaagcctcttatacaagatcctttctcatataaaatcattctcttttccttataacctttcttaccaaaaatacatcttcatatccgtaacttttttacatgtctttcccctacttagtgtttccttttttttcgttgtttcataaataacttttccaagtccataatttgaatcaacctttagataacttctgaatttagacaaaattattctttttctcaataaggacacatcttctttggcatgctttatatacagaattatatattaactagaattcttatttttagtaaccttaaattttagtgaaaacctaggatgtaagaaatcctgaactgtctatcagaatttagcatttcacagatgaaaactttccacaatttttaaaaacgtgtttctctaggtcataaccctttctttattggaaatgacccagacatctaatgagcttccaaaataattagaagatttttaaatccacaaagattcccttacagtatttaccccatttatatttcattcatttttagcagtttatctagatgacttatgaaaacagtgatatcagaaaaagctagtaatgatttccttgttaaccatttttatgaccggtgcctaataggcattcatctaggtaagaatcttaaaggcacacacataggtattttcacccataacgcagaagattcacctgtttttgttaaaccaacaacattaaattagttttattcatttaaaaaaaaaatcacagaaagatcattttgttcttgtctggctttgcagtcttacaaccttttgtgccaaaccctgacaccttaaaatttccagcagagacaaatataaaacccagacaaaaatatatgctgacaactctgaagacatttttatttttattttactaataatcttaaagccagcttgcttatgatacatttacttcagtcatacacatttgaaaaatgcttggacttatttacttaacttatgagtgctcttttagttataggccaatttggtactgtatgaaaacacgtaacattcagatacatgtacacccatataaataaagagccagtaacttttaccttggaattctagccatgagacagcaatgcaaacttactagtctgtaaaagatagctggatccaaatgatttctgacaaaattgggacctgtccacatggctaaactttatttgctctgataggtaatccgatgaaggctgtgaaccaaaactttgggtaaagcagtttccatggtagttagatttccttttagaggtcaaactctcccaaactccaaagaatactggggccaaacacactacagaagaacattatgtactaactaggcccaaccctgcttagaacagcagcataaaatcctgggtacatggaagtccctcctgctttcctattcaacagcaaaatgaagactgccctataattcaaagaccttccaagatgagatgagacctggcacttttgaggtgggatggccatagccatcagcctacaactatattcagaccaaccgtgaaggatgcatcaaagtgggcagcgctgtgggatcaaatcccgacctcccacaactacatcaaaacatacacaaaacaatcaacaaaatataatacaactgttgcagcagcaaacaagggccaaaaggcccaaactgaaacagttgaggtgcttcctctctctgtctgtttggcttgttcaacctgcaaatggaaagtcctttgaaatttctcaagctgaggggagctgatctcactgtctggtaaccacaaaagacactcagttgccaagacacacaagcaattactaacaagccccaagagtgtacaaactgaaacagtcagagtgctttcctctttgacagttgggcttgttccatctacaaatggaaattcctccagaatttcccaaattgagaggagctgatcctgctctctgagcccacaaaagacactcacctacccagacactgatgccaaattaaaaaggctgttcttaggcaatcaagaatgcagttggagctggcaacggtggggctagagagagagagactgaaaccaacctctggccaaaaaaaggtgggcagctgcttaggagggcttctgaaactctgccagcccactgtggtcaagccacaagcagcacgttcccagttagggaaccaaaatctgttactgaaatagcaggggtttggtctaggtccttgtattagtctgttctcacattggtataaagaactacctgagactggataatttatgaagaaaagaggtttaattgactcacagttccacaggctgtataggaagcaaagcatggctgggaggcctcaggaaacttataataatggtagaaactgaaagggaagcaagcacatcttaccatggcagagcaggagagagagagagcaaagggggagatgctacacactgttaaacaaccagatcttgtgagaactcattcactatcacaagaacagcaagggggaattccacccttatgatccaatcacctcccaccaggtccctcccctaacattgggaattacaattcgacatgaaatttgggtggtgacacagagccaaacactatcggtcctgctgctcactgtatagaaagccaatcactaaatcaacgagtattgccagggaagaaggctttgatagggtgctgcagccaaggagaacaggagatagtctcaaatctgtctccccaatcgactaaaattggggggtttatgtagcaggcaaggtaggaaaacaggaattagaaaagagtaaggaagcaattatgatggatgaggggtctggcatctcactggttgtggtgatctggtgagtttcagttccttgcctgaaggtaagtttcctgagaaagaaactcaaatgagacaaatgttaagtttcaagttttaagactagggagcctcaatttctatgttgattaaaaaaaatcataaatatttgttctaatggacaatcaagtcagtttcatccatatgttctcaatgattacagagaaagggaaaggagaataagggaaaggagcaagcattggcttacaaaatttctgcccggaagtgacatatgacatttttttcttacatttcattggcaaagtgagtcacattatcactcctgagatcttatgaatgcagaaaaatgattctacatgtgcctatggcaaaagaccaccatttgtaaactgctgtactgacttccataggtaccatccatgtaagagacgatgatgacagagcaggaggtgccatctttgacgtaaagaggaaagagagaaaagcaaagctctaaagatacaacttcaaagaacattcttatttatatgacagtaggaggaacacatacttgagaagggaaaataaaaccatgtagacaagcgaagggctcagtttcatctagggtcacatctgtgagaagcatgtcaagaagtttcctcagtgcccaatctggagataagtcaatgaggcaaagctgggtctaaccttgaagaagacatggttggccttcaggagagctgcttcagggaggcaagggggctggataagaagccagtctgagaagggagccatcaaaagtgggggcagaacactgaaatatgggaaaaaggaagggacacaagatggttgcttaaggtagcagcaaaaccaaagctgctttgttaaatcaaacctgacacagtttttgattcacccattcagcaaatatttattgaacattcactcttgccaaacactgttttaggagctgggagagagaaagcaagataagtttcctgttcccatggaacttttcttctagtgcaacagtcctcaaacttttggcacaaggggctggttttgtggaagacaatttttccatagactggggcgtggttggtttcaggatgaaactgtttcacctcagatcatcaggcattaggttctcataaggagcacacaacctcgattcctccatgtgcagttcacaacaggttttgtgctctgatatggtttggctgtgtcttcacccaaatcttaccttgcattgtgataatccccacatgtcaagggtggggccaggtggagataattgaatcatgggggaggtttcccccatactgttcttgtggtagtgaataagtttcacaagacctgatggtttcataaatgggagttcccctgcacaagctctcttgcctgccaccatgtaagagatgactttgctcctaatttaccttctgccatgattgtgaggcctccccagccatgtggaactgtgaatcaatcttctttcttttataaattttatacactcctgtgagaatccagtgccacctccgatctaacaggcggcagagctcaggtggtaatgcttgcctgcccacagcttgcctactgctgtatggtactggtccatggcccaggggttggggacccctgttctagtggaggcaacatacaataaacaagtgagcaaggaaatgaatgagtgaagagatgatttcccattatatctagttcagataagataaattatatttagttcttccttcccttctgaaaggaagtaaccatgtgggtgggaggtatgagctgaagagcatattcacactagtcaggaaaggtctctcaggatgtgacatgtaagttgactcccagaggacaagaaacatcagtcaagctgattttgaggttttgagctggaatgttccatggcatgcaaaatctccaatggcaatgtcacagggcaaacccccaaattagggttcatcccaggaggccacatgggtccttggctttgagcaggaaggaattcaagagccagtcaaaagagtaaagtgaaagcaagtttattaagagagtaaaggaataaaagggtggctactccacaggcagagcagccccaagatcttctagttggctacttttatggttatttcttgagcatatcctaaataaggggtagattattcatctgagttttccaggaaaggggccgggaattcccataactgagggttcctccccatttcaggccatacaaggtaacttccagacgttgtgatggcatctataaactgccatggcactggttggggtttcctttagcgtgctaatgtattataattagtgtataatgcacagtgaggatggccagagatcacttttgtcaccatcttggttttggtggagtttggctggcttctttcccgcatcctgctttatcagtggggtctttgtgacctgtatcttgtgaaaccagtcctgccaaactcctatctcaagatcaagctctcacagaaaatagggacaaggtggaaatttaaaatttaaaattttaaaattttaaattttaaatatctgggtttgtatacttgtgtgtttgtatatttgtgtgtaaatacctacagtaaatgaagtttctggaagacatttacttctcaatacgtaagattcattagttagaggtatatgccttctcccttaggcaactctgccacagaatcatcttcagcagtgttggagctcagaaaccattctccaaaatatggtgctttgacatgctgaactgtagaagaagccttaaggtctcttcaaccttcccctcttcccaccatctctctcaaagcacaggataaagttgttaagttccattatctcccttaagtctggacccccctccccaccaaaaaggagaacaattattttgtcttcctgtcactgtaagaccaagaatgtaaccacacctgaacagaccttttcacaaggtaatgtctgcctctcaggcttattcaaattccaaagagaagtgtttacaagtaatctctgttccaggatccatggttcttcccagcaagcctttactgttcctcaaaagaattcctcttctcctcttcccataatctgttttgccaggatgctagagaagcgtccaaatccccttggcaggaggtaatcactgtgattctcctcatgtacgtgttaataaaattcgaatgccttttcaccaacgaatctgccttttgtgagatgatctttcagtgaacattcagagggtgaacgggaagtttcccttggtcccaacagctgtttgggaaagatggctgccgggtagcaatctgctgaggtggattctctcagtgttttcaatagtgcagactctttctttctatgatttttgaaccagcccttactggcttaacatgcaatacatcttctacttggatttgccctagtttcagatgtacagaatttagtcatatacctgtataaggctgagctttctcaaatattactgtgggacttaggaaggattttcctgggtctattcttttacccgtgtgggtttttgaaaaagaaacttaaacagatctctgcagaactctatgactagcctctgtagctttaggagatgaaagtataaaccaaaatgtatctgagacaatctcagtcaacttagaattttattttgccaaggttaaggatgtgcccgtggcacagcctcaggagtttctgacatgtgcccaaggaaattttgatacaggagctagaaagaaattatttaggcagttagtgagggtaagagagtctttggctaggtttcccttttaataaaaagcagcccccaaatcattttttttctaacaaagagaagcctgaaaaatcaagctgcagacataaaaaagcaagctagaagcttgcaggggtgaatgccggcagctgtgcacaacatggaggctccatcttcccttttctttgtcaaccacgtgtaaagaagcaagcaacatggtgccggccaggtagagaactcacttgcatgataacagatgagggtggggcggccagcttcttcgtgtgctatgtaaatggcacacctgatccaaccaatctctcatcccctatgtaaatcagacatcacctcctcaaactcatctataaaaccacgtgcatttcaccatggaaatggaagacccacgcaggacccccttctctatgcagaagagagaccttttctctttctctcgcctattaaacgtcctttttttttttcttttgagacagagtctcgctctgtggcccaggctggagtgcagtgtcgcgattttggctcactgcaacctccgcctcctgggttcaagcaattctctgcctcagcctcttgagtagcggggattacaggcatgtgccaccacgcctggctaatttttgcatttttagtaaagacggggtttcaccaacttggccaggctggtcttgaactcctgacctcgtgatccaaccgcctcggcctcccaaagtgctgggattacaggcgtgagccaccatgaccggccttaaacatccactcttaaactactccttgtgtgttcgtgtccttgatttccttggccgtgaggtaacaaacctcaggtattttcccagacaaatggctctgcttcagtttggctacagctgggatttatacattttagggagacataagacatccatcaatacatgtaagatatacattggttcagtctggaaagacaggacaacttgaagtgggagcgagaagcgggacttccaggtcatagatggattcaaagattttttgattggcaatttgttgaaagagtttatctgcagacctggaatccatagaaagaagtgtctggactaagataaggagttgtggagaccaaggttcttattaagcagatgaagcctccaggtagcaggcttcagagacaatagattgtaaatgtttcttatcagacttaaaaaggtgctagactcttagttaattctctcctggatcagaagaaaagaactggaaagggaaagggagtctctacagaatgtagattttttccccatgagagaaagctttgcagggccatttcaaaatatgtcaaataaatatattttagggtaaaatgcttcgatttcattcagggcctgctatttgtcaagtgatgctatactaaagtcaggctgggacttgaagccttattgttacaagaagtcttaagatgtctgttttgatgttaatgctggtcagttgtccctgaattccaaagggtggagggcataatgaggcatggccaacacccctgaccccggcttcccatcctggcctgaactaggttttcaggttaactttagaattcccttagctgagaggaggggtccaatcaaagggctggaaggcttagaattttatttttagtttacaaaagcaatcattttggccattatggtctgaattaaattgccactaggaaaaactatatatattttaaagttgggatgatgccattgtggtgggataatctggaagaagcttaatttgtgttaacttatttctatttattcttaatatttgcctatatcccccctgctataacatagctccctgaatacaggaatacttgtctgttttgttcctggatatttctccagctcctagaaagtgcctgacctggagaaggtgctcatgaagcatccaatgaatcagtgtttcttctacttgtgggactgtcctaccagtcccctattgactccagtagggatggcaccatgtctgagaggccaaagaagagacctggagacagaaggtttattagcatggagggggtgggaacttacatacagagaaatccagcggaggcaggctggacaggagaactactattgtttgtaaacagcatgttgtgtataaaacattttcacttagcaccctctacctggcaacctccatttaacccaaaacaaagggcctcaactccctctatggcctgtgttccaaagaatgggcagaggtttcagacgaccatcacagataaagcaaatctctgggttggccactgccactcttagattctgtgaaaggaaaatcttggggtccccaaattactaaactaaagggaaaagtcaagctggggactgcttaggtcaaacctccctcccattctattcaaagtcatccctctgctcactgagctagaggcagatctgactgcctccttcaaaaaggcttcagaaattcaatatgaaactgtcaggcctctgagcccaagccaagccatcgcatcccctgtgacttgcacgtatacatccagatggcctgaagtaactgaagatccacaaaagaagtaaaaatagccttaacagatgacattccaccattgtgatttgttcctgccccaccctaactgatcaatgtactttgtaatctcccccacccttaagaaggttctttgtaattctccccacccttgacaatgtactttgtgagatccaccctgcccacaaaacattgctcttaacttcactgcctatcccaaaacctataagaactaatgataatccaccaccctttgctgactctcttttcggactcagcccgcctgcacccaggtgaaataaacagccatgttgttcacacaaagcctgtttggtggtctcttcacacggatgcacatgaaatttggtgccgtgactcggatcgggggacctcccttgggagatcaataccccgtcctcctgctctttgctccgtgagaaagatccacctacgacctcaggtcctaagaccgaccagcccaagaaacatctcaccaatttcaaatccagtaagcggcctctttttactctcttctccaacttccctcactatccctcaacctctttcttctttcaatcttggcgctacacttcaatctctcccttctcttaatttcaattcctttaattttctggtagagacaaaagagacatgttttatccgtggacccaaaactccagcgcctgtcatggactgggaaggcagccttccctttgtgtttaatcattgcagggatgcctctctgattatacacccatgtttcaagggtgtcagaccacgcagggacacttgccttggtccttcacccttagcggcaagtcccgcttttcttgggaaggggcaagtaccccaatcccttctctccttgtctctaccccttctctgcttctctggggaaggggcaagtaccccaaccccttctctccttgtctctaccccttctctgcttttctggggaaggggcaagtacccctcaacccccttctccttcacccttagcggcaagtcccgctttcctagagggcaagaacccccccaatcgcttatttctgcaccccaacctcttatctctgtgctccaatcccttatttccacaccctgaccttttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccctagcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggaaaacggtctgaggtgcctgacatccaggcattcttttacacatcagtcccttcctagtctctgtgcccagtgcaactcatcccaaatctttcttctttccctcctgcctgtcccctcagtcccaaccccaagcgtcactgagtctttctaatcttccttttctacagacccatctgacctctcccctcctcgccaggccgagctaggtcccaattcttcctcagcctccgctcctccaccctataatctttttatcacctcccctcctcacacctggtccggcttgcagttttgttccatgactagccctcccccacctgcccagcaatttaatcttaaaaagccaaaggcatagtcaaggttaatgctcctttttctttatcccaaatcagatagcgtttaggctctttttcatcaaatataaaaatccagctcagttcatgacttgtttggcagcaaccctgagatgctttacagccctagaccctaaaaggtcaaaaggccatcttattctcaatatacattgtattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacgcctgaactgcagtggccaggcgttcctccagaacctcctcccacaggagcttgctacacgtgccggaaatccggccactgggccaaggaatgcccgcagcccaggattcctcctaagccgcgtcccatctgtgtgggaccccactgaaaatcagactgttcaactcacctggcagccactcccagagcccctggaactctggcccaaggctctctgactgactccttctcagatcttctcggcttagtggctgaagactgacactgcccgatcgcctcggaagccccctaaaccatcacggatgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctacttccctgactattcctggactacagctatatctcattgccacccttcttcccaatccaaagcctcctttgcatcctcctcttgtatccccccaccttaacccacaaatatgagatacctctactccctccttggcgactgatcatgcaccccttaccatctcattaaaacctaatcacccttaccccactcaacgccaatatcccatcccacagcatgctttaaaaagattaaagcctgttatcactcgcttgctacagcatggccttttaaagcctataaactttccttacaattcccccattttacctgtcctaaaaccagacaagccttacaagttagttcaggatctgctccttatcaaccaaattgttttgcctatccaccccatggtgccaaacccatatactctcctatcctcaatacctgcctctacaacccattattctgttctagatctcaaacatgctttctttaccattcctttgcacccttaatcccagcctctcttcactttcacttggactgaccctgacacccatcaagctcagcaaattacctaggctgtacggctgcaaagcttcacagacagcccccattacttcaatcaagcccaaatttcttcctcatctgttacctatcttggcataattctcataaaaacacacgtgctctccctgccaatcgtgtctgactgatctctcaaaccccagcaccttctacaaaacaacaactcctttccttcctaggcatggttagtgcagtcagaattcttacacaagagccaggaccgcaccctgtagcctttctgtccaaacaacttgaccttactgttttagcctagccctcatgtctgcgtgcagtggctgccgctgcattaatacttttagaggccctcaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcccagacttcaatctggcctcccacattattcctgataccacacctgacccccatgactgtatctctctgatccacctgatattcaccccatttccccatatttccttctttcctgttcctcaccctgatcacgcttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactacccctcagggattgttcaggcctcctccctttcctacacatcaagctcgaggatttgcccctgcccaggactggcaaattgactttactcatatgcctcgagtcagaaaactaaaatatctgttagtctgggtagacaccttgactggatgggtagaggccttccccacagggtctgagaaggccaccacagtcatttcttcccttctgtcggacataattcctcggtttggccttcccacctctatacagtctgataacggaccagcgtttactagccaaattacccaagca

SEQ ID NO: 607 - DNA, 73966 bp, Homo sapiens
ctcagttattccaatcaaagagggaaggccttagacgttctcactcacatattatgttaattttggtaaattgaaaaatagccacaggttcttcccgtttttttgcatccaggttcttacaatgtgatgtcacaaatcctcccataaagaggtggggtatatttttctacctgttgagtctggggtggccatgtgacttgttttggtcaaaaggacataagcaaatgtggaaactgcttgtgcattggagcctggcctctttctgagctaaaggcctgagaccactatgtttttatgagcatgagcaagcctgcaggggaaaagagagatcacatggaggaaaattgaggcatctgggctgacaatctgccaactgccaggtaggtaagagaagctgtctgtgcgaggcaaaattagcttcactaccccgcaaagatgtccatatcctaatcctcaggacctgtgaatatgttattttacatggcaaaagggactttgaagatatgactaagcattttaagatgggaggattatcctggatcatcttggtgcgtttattataatcacaagggagacaggagactcagagtcagagaagatggggtaatggaagccagggtagctgtcatagagagatttgaaaatagtatatggctggctttcaagatggagggaggagtcatgagataaagaatgtaagtggcctctagaatctagagaaggcaaggaagtagattcccctctaaagccacgagaaggaatacagtcctgtggatatcttaattttagtccagttagacttctgatctttatttagaaccctcaggaaatacaaactataacaagcagttttggtcttaagttactacgtttcggggtgatttcttacacaggaaccgctaaacaatacactgatctacaagttcaaaataaaaaataaagcaaaagagtatttatattaagctacttaaaaatagtcattttctaactctcctatggacttttacgtgggttctttacatcttctgagattccaaatgaggatttcatccattctttcatccagtacaacctggttgtctgttgtctgaatagtaatgaactagaccctgcagcagaaattgggaacttgtttctgctttcaaagagcaattatgttcctagaagtctcatcttgagcatgttgcttaagtctctaaatttcagtatctgcatcttcaaaaatgggataataatagtacttagcttagagaattgctttgagactcagatgcaaaaatgcttataaagcactcagctttacatgacattcaataagtattcaataaatgccagcagaattgaaaagagatgagggaaaactagatggcaaataaaaagtaggaaagacagtaatatgagaagtaacaataactcttatttattgtttgtgatgctctggaaaacttatgtttatgtttagtaatagtgacaaaaactctgcaaggtagattttgttatttttactttacaaatgccaaaattgagatttcaaaggttaagtatcttattaggtcggtgcaaaagtaattgcagttttgccattactttcaaaggcaaaaaccgcaattacttttcaccaacctgatatctgacaccagacaagcagccagtagcaccaggtatctaaccctgcactgtctaatcctaacgtcctttatctccctgaaaaccctaagtttgtggtagttttagttggtagttacacagtcttacttctgcactgttcagtagccaggtggctgtggcttagggttttcaagtccagtggagccttcaatgttgcttggcaatttttttcactaaatgcgggttaacagcctcaaccttttctctttgagtagattattttgcctcggctttcatagacaaaatagaggccatcagatattaacagtttcccttccctacattataaaacttcccacagtagtatccatccttcttttctgtataagggaaaatgagtcaatatttatcagctgcatgctttttatatctccagcctaacctgaactcttgaaccacactcatacttcttattacctatgaaacatctctactgggtatccaataagcttttcaaacttcactgatcttccttaccaaaatctgttgtcccatcatcttccccatgccaggtaatggcaactcacatccctccagctctttaggctacacactttggagttatccatgccagccaagtcattatcatttcttgtttggattatttcaataacctcctaatttatcctctttctccctccaacattgtgcacctgcaatctattctcaacacagtatctggagttattctgctaaaaatgtaaatcagattacattttctgtcccaaactatctattgtgttctcatttcatgccaagcaaaagccaaagtatttgcaatggcctataaaactccataccattgggttccccattgcctctttgacctcacagcccactattctcctcagttgtccatctccttgttgtcccttgactatgttggccttgtttggccttgggcctttgaatttgttcttccctttgcctggaacagtcttctccatgaaatttgcctggcttttcttttacttactttggattgttgcttgaatgttttattctcattgaggcattctttttatttatttatttatttattttttagatgaaggcttgctcttgtcccccaggctggagtgcaatggcatgatctcagctcactgcaacctctgactcccaggttcaagagattctcctgcctcagcctcctgagtagctgggattataggcacctgccaccacacccagctaatttttgtatttttagtagagacaggttttcaccatattagccaggctggtctcaaactcctgacctcaggtgatctgcccacctcggcctcgcaaagtgttgggattacaggcgtgagccaccacacctcgctcactgaggcattctaatcactttatttaaaattgcttgatactctacaccgttctgtatctcccttttatgtcttaatcttctccatagcgcttactaccatctaacattctgtatattcattttgtttgactccaccaactaaaatgcaagatccataaaaatgggattaaaaaaaagtaccactatactttgcagtggttatgacattgctggaatatagtagaacttcagtaaagaattttgaaatgaatgaatctttttttccttgctaaagaactttgtttacatgctgaatccaactttactgccctctttaggaactgattcatcagttattctcagaatttcctgtgtttttcctctctttcatctgaatatagtctttaggctataactgtaattaacaatcactaatctctttaaaaatatcttctctgtggtttccagtttaggctatttttctatgaaaattacagtaaagaaacacaagatggaatgaatgcctaggaaagataggaggctggaagacaaaatgagattttaaaaaatatctggaaattagaaagaggatgagagcaagatgaaggatgaggcagaggagtagaggcagctatagctcagaatatatggaagggagctttgaggtgtgtgtgtgtatgtgtgtggttggggcactgtcagcttatcttcctggtggtgcctagagaatatgtggacccccagttgacaaggagaaacagcagtaatgagaagtaaagctaaaaggagaagagttatttttttttgatatatgtgtatgcattgcatcagtctgttcacccatttcctctccccattgttatacacagaactgttcactggtgagctggagagtacgttgagattacaatgacttccttatacacccagtgttacgaccatgtgtcgctaaaaaaaaaaaaaatcctagtgcaaaagtcaatatatttgctgacactctactaactacttaaaatcatgccacatttcagtcttcttcatatttaggtcttgacttctatgaacagttgtttttgttagatttttataattggatttttgctagaaagaaaaaacattttttactcgcattaactctttcaatttcacaacaaatctaagaaaaatgcaacaacaggaaaattaaaacaaatggaaacattaaaagtatccatcaatatatacaaatattggttaagtaaattatagtgtaatcttactatatatcatgcaacctttaaaagaaagggaagtagatgtgtgtgtcctgacacggaaaaatactgaagatacattttcaattgaaaaaagcaaagtgcatgatgggataagtggactaggcacatggactgggaattagaagggagtgcttagaacacagtcacctggaatatctgaaatatctgaatacctaaaatatctgagagctttcagtttctgcagattgatgcagaatgcaaatgccaggagggagagaccctgaccaccagagtgcaggatggtgctcattctcaaacaatttggttttctgggtatcataagaaaaatatccagagaaaacagagacactgggaaaagatagttgcagtaaagaaggcaaaagaaagcaagaaaaagaaagaagaaaagccaattgtgcagaaaatccaggaatctgcccctaacacagcaaatattttctgagatctctaagcaaagagattcttttggaagacaaacactcaggacaaaggctgtgtatcaatttgagtatgacccaccccatgtcaaagaaggaattgagtagactggctggacagatatgaaggttgtatggttcagatgaaatctaataggccattttggatctgcctcactggattcacagtagacagtgccctgtgtgaagagcgaagatgaattttctagcgacttgctagacataaaagaagacttcttttagtttatttcctctggaaagccttgtgttcccgactcctaacttagaatacactcttgaagatgttgatgtaaacgaagtttgtatctttgatggacttgtggatgaaagcattcagaagaaggtgacatttcaaaaggcccaggaatactctttcaggacagcccacttgtctgtcattccagggatacatgaccagacaccagagtggaaataactctcatttagggatgctggccatcaatcaagtatttgatattctgtccacttgagactcttaactggcctgaagcattgaagacaggaatttcttccaaaaaagttatattcttcagagcacagtgggatgatgggcctaagattgcagctgcagaacaaagcgctggaggccctgaccaaagaacagggcagagggtggcagtgacacacttgcctttacttgacatcttcttggatcttcacaataagctactaatgacagggaccacattttgtactcttttttatctcccatacttcctagttcacaggatgtacttgtatttatattaagtaaaaaagtttatgtaacaaggaattagcccaaaaccacatggctttggatgtgtcttaattcatcttttgtacatatatcattatatgtgaaacatctactctttagagattgtttaaataataaataattattgttgtataaaaattaaataattatcattatataagaaaaaagcaaagcacagcacagtgcataaagatgattcatttactctgttgtgcttttttaaagaagtataacaatagatacatctattttggttatgtgcaaatatcctttttctgaagatgaattacacaaattgggattgatgattagctttgggataggtgggaagcatggaggcttttgctatttatttgtcaattttctaaaatgtctgtaccattgggtaggtgggaattttgtcgtgtttgtatttacctttcagaatatgtgcatatataatataaagatgtattgcttatacaatttacattaaaacatacttacataaataaaaaatattaaaaagcaaacagtggttgaaggtagaggggtttgggaccattgttttcattataagacagcatacttttgattttatttatttattttttattttcttagatcttgagcttgcattacttttacttagtggaaaataacaataaagatggaaaaaaggataaaggcagcagaggaaaagcatttgagagcttaggcccaggcaccagactgcctagttttaaatcttaggtctgctacttactagctggataaccttgggtaacttacttaccttgtctgtgtcttagttttcctatttgtaaaatgcaaaatagaaatacttttcatatagggttatactgaggattaaattatagaaattagttaatatggaaaaagtgctttatttagtatcttatacatagtaatcactgcctgtgatatattataaatatgttcttaggtaaagaaagggaaaaaacacataaaccacttcaatctgttttattttctccaccctgacccatgtctagtttgactaataattctagggttgggagtcttttcaagaagaaggagaagaccagggttgaagctgagcaatggtttggggcctctgaaagaggaaaaggcaatgggaagaatttttcaaaaataaaaattgcattctaattattatgcctgaatcaatacctttattccttcttgccatcctgaaaaatctttgtcctttttaccaagtgtttttttttttatattccacctaattttaaggaatggccaagccctactccctccaggatgcctttgataaagttcctggtgcatgcagaactctcttgtatatattgtttttcatcacatttagttccatcgtatactgtatggtctaattacaggaaccacagaaattagttgtaatttatcgtatgatagcattatgtagaaatacatcagtaatgtactaattactataggttttcagtatgtttattagattggtagtcatttttttatgaaagaacatcgattttcctttgacctaacatatcttgtaaaatcttgtactttctttttccttatattcataagtaaatctttagaagtggaaagctacatttcataatagcagtttccatttccacagatgagttactcctgaacccattataaatggctttcagtccaccattctgctaaaactactttcattgaggcatgcagtaacttcttacttgccagaggcaaatatgtatttcagtccttattttacttaactgtttaacatcaatgtcttgaccacttctggaatcttcttgaatcttctctgctggaatcccaggactttgggaggccaggtttggagaatagcttgagcccaggagttcatgatcagcctaggcaacatagccagaccatgtctctgtaaaataaaaaaattaaaaaaaaaagaagaaagttaaaagacaaatttttaatgatctgtggtacgtttaaaaagaaacacttagaaagtgaccttgcaaagccaaaatcattgatggcaaaaaatttttaatatagttcttagaaaatgcacctccatggaaattctcttttactcccccaagctgctggattccaggagaatttcttcttggctcaattcccacccttggccattctttctcagtcttcttcataggcatcaacatctaagaaaatcttctgcaggtctttcctgccacagctggttattataagtatcagaaatataaattatgataaattggatagtaaacaaggttaccatcatatttaacagaaaggttcttaagaactgaaacattgtagaacaatatagcacatcaaacaatatattctagggaaagtatcattattgagataatatcattttgagcatccaggattttggaaaagatatttctataggaaagtttaaaaaggctgggcacagtggctcatgcctataatcccacactcatgagtgtgccaggcacacatcatttggtggtgctgataggggccagaagtgctcttattcctcactcctcttttcattcaaaaggaattttcccctctcagcggtttactttcgtccccaggagaggcagactaatttcaagattggtgagtttcgaaggagaatctggcaagtgtagctccttcttctccccttggtctttgggatttgcctgcctgcagagaatctgctctagtggaccatatggaaatcttagtggtaaaggttgtaaacttgcttttcttcccccacagtgagtgggtgaataagtttgcttagttcagggctcataatcgggaagctcattgttgtcacatgttccctgggagtcctactttgatcttcatctggctcactcctttgcccatctcaattgatttagattcaagagggaaaaccagggggtttatttaatagtccattcgaacttcaatatcttcttccacatagagttactcttcactatatgtaacctcatacactgaagaaaactatcatttcacaaatgtattgttctacctgtggtagtttcagatagaaatcttcctatgatttcattaagacaagacataaccactcttaggatgacttcattgtcccgaagagaccaaagtacatccctcagtgatgcctaagcatacctctctcacgatcataaattcagcttagaattcctgtggtcacacattttgttctctatttttgccatgtaggtaacaaaataaagaagaaactaccacctaaaaaagtagaaaaagactagaaacgtgcaaaagaaattctgcttccttctttggaaaattagatcttgtccaatatcatatgattctctactgttctaggattttctcatattgaacttgaatgaaaacttccaaattctggtaaaaattttttccagaagccatttttataaaaaagataaaatttgaaattaagctgagaaatcataacaaatgtaaacctcttttctttgtggttttctctattatgtaatagtcataaagtgcattttataatattcactttttggtatgaaaatattagtcttttgagacaattccaatcagcatccctaatttatatgtaagggaaatattgagtcattccaggttagagggagaattcttggcacagttaaaaactgaaattctaagattctaatcctaagccatatggggtccaaccagcttaatatagcaagatgttctcaataactaccatggtgttattcagggactgagagaaccaaaagttaaccagacctggtcctcatccctgagactcttgcttacaagcaggagaggtaaatgtgaattcagaaaattgtctgatcctcctcttctgaagcaccagcataacaagtttgggtattggccaaatggattagtgctatgtttgggttcctggatgctggatcttgggtttgtaagtgctctgaagcaaccagaaatgggaagaattagttggaagtaaaaatatgaaaacaaccccaaaccccaactaaaccaagaaatagacaataaaaaatatttttggaccgggcgcggtggctcacccctgtaatcccagcactttgtgaggcaaaggaggtcaggagttggagaccagtctggtcaacatggtgaaaccccatctgtactaaaaatacaaaaattagctgcgcatgttgatgtgtgcctgtaatctcagccactcaggaggctgaggcaggagaatagcttgaaccagggaggtggaggttgcagtgagctgagatcgtgccactgcactgtagcctgggtgacagagtgagacaccgtctcaaaaaaaaaaaaaaaaaatatatatatatatatatatatatatatatatatatatatatattaattacatatatatatttcgagaagtccaaggtctatcacttttagaagtggaagtcagcataaattaaaatttgaaggaacaagagtctggtagacactaagaccacatagagaatgagaacaaggcagaaggaaaatgagaagaccccaaatcatcgcagagaacaagctgaccagcttgtgactcattcctggtggctgctggccatacaaattatgagcttaaggcctgtattggaattatgagcttaagccaaacactggatcatcgtggtacagtggaaagaggacagggatttcagcaaatcatacaagtagttgttagtttcagcaagtccatgtttcaaactggtacatcagtctttccacctagaagtataagggttatgtaggaatggggtacctaaaataatcaggaacattggcatatacacaggatttttggccttattatatttgctttcttttatgtcatgtgcttacctctagatctgggagtgactgagaccagccctaatgtgctgagatagacacattagaaatgagagaaatgagtgggtctctaaagagaaaactgggatactcttacccaatttagaagaaaataattccagactggtaaaaacagatgtcttccacaaagaggaaagccaaaatatcaaatgcagctgatgacaaggattatgaggaaaaaagatctctgaatttatcaatagtcctgaatgtgagaaaggcagtgggctgttctaggaaagctttgcagccaagcaaatgccaatctgaatcctggttgagcctcttcgtaatgttgtaatctctggcaaatcaaataatctctctgagcctcaactgtaaagccaaaattatgattactacctaataacttgaatacaaagattagaaaaacataggtagttatcattaacagtcttcaagagaataaacatttcagtggtgaggattgaatggagaggaaataaaaataatagaaatatacccctgatacaagaaaagtaatcaatgaaagaaaatagagaaatccgatgatagctagaagatggcatcaagctaaacttacttttaccacggcttccacctgccactatagggcagatctgtcacaataaggcagaaaatatggagacttggtagaaatagccaactgaagaaaaatatataaagaaaggagttaaatgtgataaaccaacaagtaatttaacatttaatatggagaaaagaccatttctccttcaaaactaaagataaggacaagatggcagagggagatagagatgctgaggtaagatgtggtttgatcctgaggtgtggcctttatagatagcccactaacacacacacacatacagacacacatatgcactggacacttgggtccttgtcttactgaagttttctaaggcaagtgctgactcctgtccaatgtctcctcctagaaggattttccttctttgtttcctatgaaatgatcctccttggattctcattctctcttaaaccttgtcaatatcctttctttctggttgtttcagaaaagctggtgttctcctggcttccagtcttggtccttttctgccatttttacatgcctgggtgagcttgcctagcttcccattgcttcaatttagtctcgaatattggtaattccaagatctatgtctctggacgaaactcttctccagcactcaaagacttcttatacaactaattggttacaggttgtctctggctaaatgtctttcagtcttaatatgtccaagatagaactctatattcactcaaaccacttcctgctccaacctgtgttgcccagatacccctcaaggaggacttgtatccagtagctgggaatgttgtcagcaagcagcctcagttgtcagctcccacaggtttctccacagcttcagagagccatctcacctaagaccatgccgttcctggactggtctacatccaattactcagtacagtgagagcacaaagccccagccatttcagctcccttcaggacaactttgatgagccgtatgctacccagagctcctgagacattgaccaaggcatcaggcctgcattgcaattcatcttctccttccacctaaccccgcttcctctgccttccttctacagaatttgatctctaataaatacttgtcatgccagtctttgttttggcatctgcttccaaagaacacaacttgcagcacaccaggacctacttgttttccaaagcagaaatctagatgttatctctctcccaccccactcattcaccagtcatcaaagactggcaattctttctcctaaatcttaccattctagctagtttctctactactccctactcatttccaatattctagctcagcttttgcatccttggcaggcctatcttaaacttgatggttaagattccttccattgaatgggcccagatgggccattgttttcctctttgctgaattgcaagtttacaagtctctctcctttatttaactgtctgcttctctgggctagatgccaagtcttatttttcttcttggtattcaaccttcccaaaacttcactcacaccctcaactccatagcagaaaccttacccagtccctgacacttagagaaactctgtatgcatttgggtaattaacacatcaataatattgtccaggtaaataagatttaaacaatacctaacgtgatactgtttaaacctacagttagatagttctgccttacagagagcttgtctataaaatgacttaaacacatcattcacacatcataaacctgcccctttttcatctttttgttatacttcattgtgaaacagttagccgtaatatccccacagagagtatttcatgcaggtaactcagttcactgggagaagagaacagattttaaccgttgcttattttgtatatttgtagctccagtttgccaagtctgaaaaagttaccatcatgttatgtatatgctgtatatataacatggaaaattatctgtgatcaagggaaataactaaataagggaggttaggatccatccatgtgatgaaatgtggtttagtattaaaaagcaaatccattcccagagattgactaggatgatacttgtaaaataatctcatatggttaaatttagggacctgaaaaaaattccacctaaccatctcctctgtagcattttcatttgattataatttgaatatattttcatttactttaagccttttccttggaattacctattccaagattcttaaatcagtggtaagagaactgttggccaaaattatggcatcccttgtacaaatgatctttttaaattatacgactctgctttaaaagcagctttatgcagccaagatgtttttagtttatgatttgcaagaattgctttgtgatttttgccactgaacctggtcttttatctttttcctctcccttgcagctctttttttttttttttttttttttctatctttgctgaggtcatctgagaaagatggagaggcttatcagtaatggcacattggtctttttgtttgcaatttaagattggaatctttcaaagaaaatggaaattggcatggatcactcttatcccttagaatttcaattttcattaagtagatgtttatggagcagcagcttgaaccaggcactgaaagtacatgggttcatatgtctatgaaaccatgtcttacggagaagacattaaaccctattaacaattcctaatctgtgtgatgaatgctgtaagggtaagcacagaaggctctggaagcactaaatcaatgtctgattccacaatgaacggggcagcctcctttctgggtaggtgacacttagtgtttaaaagaagaatgggaattagccagggaacaggaggaagtcatacgttagacaagctggaaaggaccttctaaggaggaaggagtttgtgaaattgcaagaaattctctattccttataaggagagtgaaaggaaggaaataataacagatgagactggtgaaaaaggatgatacaactataagcatttacaattttccatctctgattttctacgaaatgtggatttcagagataacagtccttctttttacagtggggtgaaagatagagatggaaaatgaaagcagctgaagattaccttatacgctaaaaaagatggatagacccattgggagaacaaaggatttgggagatagagccttccacagtcaggatgaagaaataagcaggtggaaaagttgaggaggtggtggagatagagggaaagagagagacaaagagagatggaaaaacacacacacatacaaacacacacataagacagaaatagtgagagacacatgatagagaggtagggacacctagagagaaaacaaacagataggcagtgagggaacaaacagagacagagatcgagacattcgttgaaagacagacattaaacaaggagacagagaacaggaaaggcagcaactactacagacatgagaactttaaggaaagggagttgctcttattgaggtttttaagatttcttgtgtattgtgttacataatgcccttcgtttttccacaaagagtttagtagaactaccctgcttatcaatgttttttgacttagagtttttcttctggatgtattaccatggtcagcctggctccatagatgcccagttatgtactatagtggtaagcagtgatgagattagggaaggcctgtgtgccccattagggtttgaggttccttagagaccagcttattgtagttagaaggtgagatttctctgttttgaccccacaatttatgcataaaaagctctggggaatctggttgcatctcaagaaaagcagcttgggcatcacctggcctgggaagtctttccaatccttgcagacctggttggtgccctacttctgtgttcccacagtactctgactcaccctgtttaccacaggtagaacatgggggaactctattcacatggggtgtagccttgtagtatagtttgaagttgtaatgtgatgcctccaggtttgttgtctttgcttaggattgccttggctattcgagctctttttcggttccatatgaattttaaaatagggttttctgccgaaagcaatagcaacaaaagcaaaaattgacaaatgggatctaattaaactaaagagcttctgcacagcaaaagaaactgtcatcagagtgaacagacagcctgcagaggaagagaaatttttttccatctatctatctgacaaaggtctaatacttaaaggtctggatataagactctaatatccagagtctacaagtaacttaaacaaatttacaagaaaaacaacattaaaaagtgggcaaaggacatgaagagacacttctcaaaagaagacattcatgcggtcaacaaacatatggaaaaaagctcaacatcactgatttagagaaatgcaaatcaaaaccacaatgaaacaccatctcatgccagtcggaatggcgattactaaaaagtcaagaaacaacagatgctggctaggttgtggagaaaaatgaacgcttttatactgttggtgagaatgtaaattaatttaaccattgtggaagactgtggtgattcctcaaagacctacaggcagaaataacatttgacccaggattcccattactgggtatatatccacaggaatataaatcattctattataaagatacatgcacgcatatgttcattgcagcactattcacaatagcaaagacaggaaatcaacccagatgcccaacagtgataggctggataaataaaatgtggtacatatacaacatggaatactatgcagccataaaaaggactgagatcatgtcctttgcagggagatggatgcagttggaagccattatcttcagcaaactcacaaaggaacagaaaaccaaacactgcatgttctcacttataagtgggagctgaacaatgagaacacgtggacacatcagaggaaacaacacacactggggcctctcaggttgagcagagggagggagagcattgggaagaatagctagtggatgctgggcttaatatctgggtgatgggttgatctgtgcagcaaaccaccatggcacacatttacctatgtaacaaaactgcacatcctgcacatgtaccctagaacttaaaagttgaagaaaagataaaataaaataggtttttcaaattctgtgaagaatgtcattggtagtttcataggaatagcactgaagctgtacattcctttgggcagtttggccatttcaacaatattgattcttcctatccatgaacatggaatatttttccatttgtttatgtcatctctgatttctttgagcagtgttttgtaattctctttgtgaagctatttcacctctctggttagctgtatttctaaatattttattcttttttgtggctattgtgcatagtattgagttcttaatttggttttcagcttgaatgttgttggtgcataggaatgttactgatttttgtacattgattacattgattttgtatctcaagacttcgttaaagttgtttttcagatcaaagagcttttgggaagagaacatgggtttttctaggtatagaatcatattatctgcaaacagggaacgtttaactttatctctttctaattggatgccttttatttctctcttttgcctgatttctctggccaggaatttcttccttgcttttctaattcaccaaagccaagtcttaaagattcagtggcctacaggtatctgctaattaatattattgtccccatataacctagaagaaacaagtagaggatgttaagagacctgctcaatgtgagggtaatagtaagtggcaaagccaggtctagatcatagatccgctaatgtttgtgtctccgctattttgactctacaatattacttctcacctgaatggagttcaattagaaaaaggatatagatacctgaccaaacacagtctgcatacttaagctgtctctagattacaaggagatcaagtgaaaattgtacctggtttgatccaacttaaagcttttttttttgataaactataccgattatctctcttgccaatggtcacataccttgatatccttgttttctcctgcatgttagatataacttactatgaatagtgaattacagtggaacaagccaagttgagaggttacagcatttgaaattggcctctcctactgtatgtgcatgttctgtgccagaaacagactcatttacaggagagaggaataacttcgacctgaattattatataacagacagtaactggtccagcagtctgggatgggtgaagaagttgtctaatgagggaattgttatttcaattgggaaaatagccttgttatagggagtgtgagagcaaatgataatctggaatcctggataagagaaatgggcatcagggagaaagagtagcaggaagcagaggccctacccctttgcctacaacaaggagagcacagtagagaactaaaaaatgcaaggaaggttttatttccaaagatttctgagtacataaatagcctaagaactcagacactaaatatgcatgaagaaagtaatggctggactaacaaaaatggtaaagatatcaagtcaaagaatggtaaatggagatgcttaaagttagtatgcctaaagttaagattggtccttgctaatgtggttgtctaagtgtgcagactggagtcaagatggaaagagagaagagggttgcagagtctaaggaacagcaaaggcttaatacttctttattgaatagataacagtactattttggagcgtctgacttaactgctgatacagacatgtacaaagagatggagaagttgttctaaaggatacttgattcaaaacaatatgcttgcagcacaaaaccaataatgcaaaatgtctgttaatatatgaaagacaggggtaatgctaagaatatatcattcaattagactatgcataaggaataagtaaatattttgatttacttacattgccaaaacaattttttaaaagtttgtttttattgccttgatgttgaatagaagactgtggagggagacaaaatcaccacagaatgaaacatttaaataataagaataactgaacttttaggcacaggtctcatttatttggactgaatgaatccaaactctccaattgaaagctattttaagagagagcctggtgatatagtcttccaaaaagccaccaccttcagaaatagattctgtgtgttatccaataatcagctggcaacataggtgtttatctaagattaatctaatagacttcgtttgcttaaaagctaatcattgcttaggagccacagtaactacgagttgagtgattacagtgcacgtgttggcaataattcctaaaagaatttaaaagcgtcaaagtcaaggacaagaactggtaatgattctctggagtatggtttgaatattagttttggttccccaccagggggcttcctggacccctttaagggcagcagtcaaataaaatgctttgtcccagcttatggacaaaggagtggatgtaacggactttcttttgctcgtgtaatctactacaagactcatgctaatgtacccctgcatagctttatagtgtgactacctaatctactcttcatcatcttagtattgagagatgggagattagacaacagaaaaaggagattaatacagactttacaagacataatgtggtcacatcccatctcttggcccagatttaagagcattggggttttaaaggcccagtggcttaaaagcaactaaccgaccagacagaatcctacccaaatactgcattacatttaccacatgaggaaatttagcattataaataattcagcccaagtggcacttctcagtgcagatgaactcaggccattttgcagcattaactctgatgatttttgttcaaacttattttctagtacaatcttggttcatctttaatgggctacttacatcatccatttaaaatagttaggttcatcctgctctcccacagaaacaatgcctatttctcagaatgatagttgcaaggagaggtctaatttcccaacatagattgatttgtgtgtgtgtgcaatgaaaagaatctatgtgcttttcgaagtggccagggtcacagtggctgtaatctcgttgatctagattaaaaacagactcttgtcctggtatgctgagtatgagtcccagttgtgtaacaagtggttattccacttttgtgagtaggcacataagactgaccaatatctcagggaagcagaaaaaatgaacataagattgttaagtgtttttggtcaagatagaatattatagtaaaatgatgtattttcccgtcatatgataatgcatgtgaattaaacaatacaaatgctacctttagattttaattagaatgatcatcagttactgagtaatttttgatgagtcactctttttcactaataggaaataaaaactccaaagataatggaagcgtttcactgctacatttaaatatagatttctggattattgttgtaataggtaacttattagttgggtagtaggaactacttactgacttcaggattttccatgataatatagttatgataaagggaatttcaaggttttgcaaattatagactggtaaaattcagatcccttagatattttttaatggtctcattcatcatttctcctttgtctgcatagtttataaaagtagaattcctagctctaattcatctttggaatgttatgtagattccacacctctccctactgcctacctacaccctcccagccccatcccctgccagatttcagcattctgctctctgttctttcccctctttaaatgaacgaaattgaacgcctagtacctcctcccataatactaagaagcagaacaatgctgtcatctgcttcattttatggacaccagtgattttcctgtagtggaataactcttgattaaatattttccatgctcctccacatttcctggttctacagctcttgtttccctgacttaaagcaaaaatattgcttggctaagataccatgctctatttcaaatcagtttgccactaaaatttggttattggaatgtcctttaaaaggcaaactacccatatttgaatattactcacaggataaaaaatcaaccagccatctcctcagtatgttcataaatttaataagtgatttttcaaagagctttttataattatccctcttttagaaatataacctcaaagctgatttctagttatggcttaatacatttatcaaaacataagttaatatataaaggcacatttatattatctgcaacatttaccttttccagctagagaaactatgttgtttatcagttattgtattaataatagtcattggttaatgttattagggaagttataccattttcatgacatgtcataacaaaataagccacaacagcaacaatagcaccagctctaactctggtactactactactattggtaattctgtgtctactggccctgtgagataagcctgacagctacacttattcccattttaaggataaggaacctgaagctgagcacacttcagtgacttattttaaggtcaaagcacacacccaaggtagaagcaaggaaagaaaccagtttttctgactttcaagaatacatagttgggtactgggtttttgttatgttaacagcacctgatatatcggggaagtttgactcttatcaaagcaaaataaacatatttatacaaaaaatatcacattaaaaacttttttgtcaatcttgagactccaaatttcatcattggtatgactgttttttcccgtcctccagaactttgtgtttctgcttggtcctaaagcattggagaagcttattcagataatcggtcagtagtctgccacagttgaactgcagttacaacattaatccagtttacattgtaatttagtctgaagttctgctgtttctgtgctgcacttgggcacagaagatttttatgaccagggaatcttggtgcctgagatcttggctccttacacaccctactcaaccattccccctttgaagtcttgccactttcttaggttgctgttagagcatatgcaggcaatacttaggggacttatagatctctctcgtttttcaggttatgtttcagtttatcaaatacgtaacttctcctttctgcctgacttcctgaccctcaaagcattattttctttctttctgcctaagactttgccaaagtcgctgaggctggggttgcagcctgctcaagaaggagcggatataaggaggacacacacaagttatcctgccgagcacgttacaatgaaaaggtcatcattagtggcccttttagtcatttaaaacatttactgagcccaaagctttcaccttctattctgggctgaaatgcagagaaaatttgggctggtgatatttgcatatatgctgtaaggagtagaagaaaatcatatccttcaattcttggtagtaagtggaaataactggtgactctgagcagattctgattagaacaataagatattagctttgttttcaaattttaataagattttaagtaagatttttgaaagcagaggaaagtttatatacttgactatttccattgtcagtttatcattgacagtcacaaatcagagggaagtgacaatcatctccagaatgagagaatacagcattcttcagaagtagtgcatggggccaggcatggtggctcacgccagtaatcccagcactttgggaggctgaggtgggcggatcacctaaggtcaggagttcgagaccagcctggtcaagatggtgaaaccccatctctactaaaactacaaaacttagccaggcatggtgatgcatgcctgtaatcccaggtatgggggaggctgaggcaagagaatcacttgaactcgggaggcagaggttacagtgagccgagattgcaccactgcactctagcctggatgacagagtaagattctgtgaaaaaaaaaaaaaaaaaaaaaaggcaatgaatggcttaattccttttctttatattcattttttttctgtactcaggaaaactattcatagtatagtagaagtataaataaaatgttcactctgaatctggataaattatttgatctgctgtcaaaagtcctttctttatttcataataaaaagtgtacatgatttattccagtttcagttcccctatgaacaaatagccaattctagtgctgtgttcaatatttttacttcagaacattgagtaggcattgggtcagaagcaccacctgcttagggaatgatttgccctgcaatgtctttggaaagaaaggagtgtcttagtttaatccagtatcatgtgttgtgtatcacagtatgtgagagctttagatcatcgatggaattttgatactgagtctcccatatactgcagtgctgtgtggttgtggctgagtcttaatgcaccatatgatgtcacttccccattataaaaacaaatgaagagagtagtgatttattttgatactttctttacttgcttctcaactccccacaagatctttaataaaactggctcttcagaaacagattaagaagccttgaaaatagttatatacgacatctttgtggaaagtcaggatacagaaaaacatgaaagatggatgaatttggcggtttgtaacatgttaccagaatctattttcatcccatgttcaccgtaatattaggacccagcaatgaattttaggttaaagaaaaagaaggaaaccacaaaaagaaaaaagaaaataatcagaaagtaattgatttataaacctttatgttctgttttaaactccaaaatccccataagagcgaatcaaagttccaagaatgaccaattgtgctcattaataataaaaaggcacactagagaagaagttgagaatatcatacctatgcttagtgatatgatgttttgaaagtgagtatacagttggaaaaatacagtttcattagtcctctcagtggtttttgaatcagggaagaacgctgagacctgatgagggttcatacaaaacttggttgaatgcagttgcaaaatacatcacctaaactataggtagggactggtgatggccagtgctcactcttggaaatattttctttagtgtttgactaggagttatccaactgtttttataaggcacctccaatttggcttagaatagagccaaaaagttaaatactagctcaagctcccacaatatcttggttttctatgtggcaagacaacaggattttcactttgccacattgcccatggagctgtaccaccctcttgccaaggttagaaggccccctggggcaaaagcaactgtcctgtttctgtttgtggttggactgaagatgttcacatggctaatgacccctgtgcccaaaagaaaagcaggtgacattaaggttcatgcaatattgatgtgttaagagggttttcacaactcaggaagctctcttagctgagttggttctccgaaaatgttgagtcctgttttccgtggcatggtgcagctgatgttgtcactctgtggtcaggagcaggaaagctggtggggtggagagagattagtggtctggaagtatgtaattggtatttcatggcaacagggagttgacagccctcagggaccacaaatggaggggaggaccaacagctcaactagattaaaacaaactatgattgaaaaaaagtaagagagaaatatattcaagcagttaagaatttgataaattactctatagatgaattccatattgccttccataaaaggtaaagtgttaaatgagataatatatgtaaggaagttagcctagtgccaggatgacagtgattaatcaattgaaaacctgcctgcttttagtattattctgtatggggagcagttgggtataacttaagcttagcacaagtattatttcatttaaattttccccttatttgtactagagaatttaatccttatttcagatcttgtacctgacactgtgggtggaaaaactccactcatgaatttggagcgggcaggcacacggctacggcagttgccgtccaactgagtgtggttagtttgtgtaactgaagccaagcaaagctaaggcagtgctagtacatggatccttctgttagactaaataaagaagagtgaacccatttttatggggaggaaaagaagaaaaaattgttcctaacagtaggggatggcttgagtctaggaacctcaggctgtgtctaaattttatcaaatattcagatgaagctgcacaaaaatttactcaatcatccagatgtttccagaaatacaatattttgatttcatgtagatgaaatcagggaaagattagattttatttttctggcattgtgagacacagtctcagtatctttcttattgtctggtgtgtctccctacttaggactatgttgtggggaccagcacagctgctttctggggttgtcagtccccggcctgggccactcttgaatctataaagggctgtttgttctgtgtgaaactcactcaggatggagcccagtttgacatttgggtcattggaatgtgccagctgaatttagtatccttgtgatttcaagtcaaaggattaaaatatacaaagccatggaatttaactttcctcctatccctcagatctctctgaaggagatcaaccaacaagggtccttctgatgttcaaagaaattaaataactttacattcacaatgatgctatatcctgtgtcaagaacaggttagcaagaccagttcttcactcaggacaagatcataaagaatgagcaggatgggaatgggtttagtacaacatgggtcacaaagcaggtattccagatgttggcttttgagtgaaagagttggaatagttcaaacacagatagttttgacatgaagatccagatgattaaacacaacttttcaacttcatttatcttatgtagcagagacgtaaatagagcataacctcagtcttctgaaggacatagattcaaattctaagaaaattggatccactgtatttcatgaaaagaatgcccaaggaagtaatagcatggctaactccatagatatagcacttgctgaattagctagtctatttaaaaatcctatgagctgtctctgttatcctcacacacagatcatggaagttgatcttaccagggtaagattcttctgtggtagtcagtacctgccttgtattatgactacacacttggagtactcagtacctactggaaatactagtttcggactttattgtcacatgatctcagacacagggcctacagtgagaagctgctgtgtagcagtctacattggaagcatattggcaccaagaaatgaggggaatattttgagcccaggctctaactaggaagtgaatcttcaggacacctagggctgaatgtaaacatctctcacgatggcagggaatctggccagcagagagcatagccagagagtagtcagctgagggagagagccaagaaacaggagcacgtattttggagagagctttagaaggaagaaaagtgcaaaagcaatcgagtgataaagactatgcttaaaatgtacctaaagtaagccatcagaataacccaatgccagagaaaagtagaggggacaaaaagaaagtactgtgggaaatacagaaaatctgcagacctagaagaagaattcagctgagatcagaacagatattattgtctttgtcatttctctggccagttctgctgtgaggaatagtggaacactgttatcacaaccctactggatagtatttagcctattgttaatactttgatttaagtttgggtatggcaaatatagttctcatgtttatgaatgggttcaaacattttaaaaatttcctattatttttataacgtcccaagttaaacattttgttagatatgaatgcctagactaggtaaattcagcttgaattttacagctaaatactgatgcctggagttgacaaaactaggtaagaaccaatccttagagactattgtttccacaagcaagtatgttatcagaaatttttacattgtgctataattgtgtttttatatcttttttccccatatacatgagctttgtggggctgatactgcaacttactcatgtaaatatacccaacattaaacatagggtattgttggtgcttcataagtttgttaaatattgatgtgtttgtatgtgtatatgtgtgcatctctgaatattagtggtgaaaagagagtgtgatccaaaaaacaaagtgaattatactggaaacaaatatccttggcttttcgtcttgcatgttgtaatccatcagccatcaccttgcttccaggaacattatactaattgtcataggttgtatatgtctgactcatgagatcatttagtgaaaagtaataatactaaagagaaagaggccagtaagtctgaagattcagcctcatgtattactccatggaagctattcagaaatttctataatcgaaccatgtgcttaaggtcaggccttgtcggtagattataactaattgtgggacttgatctataagagaagttgacagattaacatgtcacttggaccaaaaatacttgtagttgtgtgaactgaactgggccccagatgggcaaggtcaagctgtacaactccagaatggcaccactcacattgtcctctatgtgaattgtcctccgtagagttgtgctgcagacaatctgtgagttaatacacgcagctctggaggggaggtggattccaatgtgtagcagatactgtcagtgcctgacccatgtcactcaaatatctcagtttgctctgcctgactttcaacagccagatgagcccaaggatttatcatttccaatccccaaccctcagttgtgaaaagtggcagatcagaattactgaggagttaatacccttagccttcaccaatgaatatggaagttggtgtatatataccccagatcccttgcctcctggatgagatcattctgagacatatgttttatatgtttcctagagttcccctgtgggaataagctccagttgcccactgtggcagctggctcagcagcatatccttcattgactaccttttgtttatggtgtcatctccccactttccttttggtattgcttgtacttgtatttgaacttgaatcctgatatcagtatcttcttctgggagacctgaaactaaaagtaaaatccagatctgctttaaaattttcagaatgtggatgtgattctggtagctttggaggggaagccctctttcttgtctactgaagttggagtactggccttgatcagctgccatggtacaatggacactcctgcaaaatgtaacaggaaaccctcttaactgccatctatgtccatcgaataaacaatttaaaatcgcattagagtacccagcgactcacaaagtgctcaaatgaatgttgtttttgtttctacccaatattacaggctttttaaagtaatctggtcacaactttattctgttttcagagcacaagggaattaaatagaaaaataaatcttttctattagcctttcagggagctaaatggcaggaaaatttaaatttagaaaaggtgaaacagaaactcagaggatgtgacacagcaattaaaaatacattaggaaatgctgagtatgcttacacttagacaaacagggcataggcctaggccagtgctatccacagttactaaaacatactcattccaggggatgccacttatttggaaataggcaggaccatgtaatattgaagatagtttagtatagaaaattaagataatgagataatattattcatattagttataatataggagcaaaataattagaagaagaaagaaaaacaaaaaggataggcagagaatttgataaactggctcttttaaaaaggacatacatgtaaaacactcttgtaaaaggtggaggaatttagacttgaaataatgaaagaggaggatattcaaggggagtatttattgtaaaggagtggggaaagatatcaggactggctggcagaaatggaatgtggcaagtcagtaaactcagaacatatgcaggaccgcaaaatcctttgtagggtcacttctggggactttatcagcttatgtcactactccacccaacacccctaagagctgcccatctgcttcggaataaagccaaaaatccctccaatgggaccctacgtggtcttgtctcttacttctctatcttcatctcctatgactctgcctcttgctgccttatttctgatgcactggcctcctttctgggcctcaaacataccaggcacagtcccccctcaaagccttcacacaagctgttccctctgcctaggaggcatgcacacggctcacttcctcctctcctttaagtcttctctcacatgtaaacttcccagtgaagactgctgtcataatcctatctaaaatttcaatccttccattgaccaccctgccctattatattttcaattaatatttttcaccctctagtaaaatgtgtaatgtatattatatttatattttatttaactctctccttcccccttctcaaactagaatgtaaacaccttgagggctggaattttgtctacattttttcattgacctatctcaacgaaaatctcacctgcaacaatgcctaacgcatagtaggagtccagtgaatatttatggaatgaatgaatgaataaataatgacttcttgtttcttctggcagtcatcagcaccaggcacaaaacagttgttgaataactgaatgaaagaatcaataaatgtttatgagcttgacttagaaagtcttatagatgttgaggaaaagtttcaattagcctggacgttggtcacagacaccaaaatgtaaatcaaaacattattcaaagatcaattattctttccagctattggcacttacagtttaaccttcagctgtaaaatacgtcatcgtaaatctcttgactccaacatctcactttcctaggctaggagataggaattttacttaaataaaatttgtgacgtgaatacagtttctgggagagaatttctggcatggctaggagttgtctggcctagaaagaaaggaacctaatctagtttctctactttccaactcagtggttacaaataattagttacttaaatctagatttttgtaaaattgtaattaattaaacaaatgtgttaatactgactacaaacataaaaatattaatcttctcaaataaaatatattattttcaaatgaggaacattaacatataaaatgtattatacgtatcagtgagctagaagtatgttagagtaaaatattctttaaaagatttgaaaatacaatagcttaaatttaatgtgaaagaaattgatttggggctgaagtcagtttcaaaacggccttagtattctgttgtttttttttttttctgaaacaaatgaatcatgcacaatctgaaaagatgacttttttccagaaatgcctcaaacttgactgttttccagaaatgcctcaaactccagctatgtttccaccattacctcgcagcaagagggaaactgacaagtaatgacagttattctgactgtgtttttactgcaaaatccatctttctgtactgatcagcatattacttttacttgagccatagactgaatatggctagttgcctttagagccatgagattggatcagcccaggtcttcctaggtccttttaaataagacttgcatataaggaaacattcttgtagatgagctgtgaccagcaagcgtgacccaagttttgacaatttattgttatttttttctattactaacttgtagtgacatcccaatttaccatagacttgagagatatccaggtagattgtactttgaccatggccatgtgtagatttcaagcaggaggccagttttcatgctgcctttctcttggaggggatgctacttaacagtgttgtctattttccttccaaaacaaaacactataccatcaaatgcattaatacttacttatattttcaacagattatctcttttcataacttttaatcacacaggagaaattcttataggatattaggtgaaaagtgcagataacaaaaataatggattccaattgtataaaaatatatacaatttgaaaactggctttgataatttagttttgtattagaatatcttcatttagaaatctggaaacaaaaagtaatcctacgctgccattattattatttatttttagtttttgagatggagtctcactctgtcacccagggtggagtgcagtggtgcaatctcagctcactgcaacctctgcctcctgggttcaggcaatcctcctgcctcagcctctcaagtagctgagattacaggcacccacccctgcacccagctattttttttttttttgtatttttagtagagacaaggtctcgccatgttggccaggctggtctcgaaatcctggcctcaagtgatcctcccgctttgctcccactgccattattattgtcatgcccaatttgcttaggttctcttttttttttcttataaagctgactttattgctttataagatttattgctttttaaaatttatatatttatttatttattttattattattatactttaagttttagggtacacatgcacaatgtgcaggtttgttacatatgtatacatgtgccatgttggtgtgctgcacccattaactcatcatttagcattaggtatatctcctaatgccatcctccccccctccccccaccccacaacagtacccggagtgtgatgttccccttcctgcgtccatgtgttctcattgttcaattcccacctatgagtgagaacatgtggtgtttggctttttgtccttgcgatagtttgctgagaatgatggtttccagtttcatccatgtccctacaaaggacatgaactcttcattttttatggctgcatagtattccatggtgtatatgtgccacattttcttaatccagtctattgttgttggacatttgggttggttccaagtctttgctattgtgaatagtgctgcaataaacctacatgtgcatctgtctttacagcagcatgatttataatcctttgggtatatacccagtaatgggatggctgggtcaaatggtatttctagttctagatccctgaggaatctccacattgaattccacaagggctgaactagtttacagtcccaccaacagtgtaaaagtgttcctatttctccacatcctctccagcacctgttgtttcctgactttttaatgattgtcattctaactggtgtgagatggtatctcattatggttttgatttgcatttccctgatggccagtgatgatgagcattttttcatgtgtcttttggctgcataaatgtcttcttttgagaagtgtctgttcatatccttcgcccactttttgatggggttgtttgttttttcttgtaaatttgttggagttcattgtagattctggatattagccctttgtcagatgagtaggttgtgaaaattttctcccattttgtaggttgtctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtattgcctaggttttcttctaggatttttatggttttacaaactaccatcagagaatactaaaaacacctctgcacaaataaactagaaaatctagaagaaatggataaattcctcgacacatacaccctcccaagactaaaccaggaagaagttgaatctctgaatagaccaaaaacaggctctgaaattgtggcaataatcaatagcttactaaccaaaaaaagtccaggatctaccagaggtacaaggaggagctgataccattccttctgaaactattccaatcaatagaaaaagagggaatcctccctaactcattttatgaggctagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgagatgcaaggctggttcaacaaatgcaaatcaataaatgtaatccagcatataaacagaaccaaagacaaaaaccacatgattatctcaatagatgcagaaaaggcctttgacaaaattcaacaacccttcatgctaaaaactctcaacaaattaggtactgatgggatgtatctcaaaataataagagctatctatgacaaacccacagccaatatcatactgaatgggcaaaacctggaagcattccctttgaaaactggcacaagacaggatgccctctctcaccactcctattcaacatagtgttggaagttctggccagggcaattaggcgggagaaggaaataaagggtattcaattaggaaaagaggaagtcaaattgtccctgtttgcagatgtcatgactgtatatctagaaaaccccatcgtcttagcccaaaatctccttaagctgataagcaacttcagcaaagcctcaggatacaaaatcaaagtgcaaaaatcacaagcattcttatacaccaataacagacaaacagagagccaaatcatgagtgaactcccattcacaattgcttgaaagagaataaaatacctaggaatccaacttacaagggatgtgaaggacctcttcaaggagaactacaaaccactgttcaatgaaataaaggaggatacaaacaaatggaagagcattccatgctcatgggtaggaagaatcaatatcgtgaaaatggccatactgcccaaggtaatttctagattcaatgccatccccattaagctaccaatgactttcttcacagaattggaaaaaactactttaaagttcatatggaaccaaaaaagagcccgcatcgccaagtcaatcctaagccaaaagaacaaagccggaggcatcacgctacctgacttcaaactatactacaaggctacagtaaccaaaacagcatggtactggtaccaaaacagagatatagatcaatggaacagaacagagccctcagaaataatgctgcatatctacaaccatctgatctttgacaaacctgacaaaaacaagcaatggggaaaggattccctatttaataaatggtgctgggaaaactggctagccatatgtggaaagctgaaactggatcccttccttacaccttatacaaaaattaattcaagatggattaagttctcttaaatagaagaagttcacaattactattagctcctcctatagaccatataagctagtctctggaccactccaaggaaaagaagtactggggcttaggacttcaacatatgaattctgggaaagacacagcttagtccattataggaagtgactgcttaatgagtatgagttccttttggggtgaagaaaatgttctggaaatagtagtaatggctacgtaacactataaacatgccaaatgccacttagttctacacttaaaccagttaaaatggtaaattgtatgttgtgtgtattttattaaaataaaaaagtcatcacctagtcatgttgatttgatcttgggaaatgcttcaaatcagaatacatcttgccatctctaccattctagtccaagccaccattacttcctgcatgatatatgtcaatactttttaactacatttttgtgtccatctttgctctgcttcaatctttactctgccctaaaggcagatttttttgtttattcaattgtgttactccctgattaaaaattttcagtggtttctcattttgtttaaaatcaaatacaaaatttctggttgtaactacaggttcattatgctcaggtattggcctatatatcagccatatttcttttccactgattaatttgctttagtttcaatccattatcttttaatttttgagcaatcccggatcattctcatctccaggcttttgcatatgctattctcttcacccccactatgctgccttcactttttacctacctaacatctatcatcattcttaacttaaatgtcacttttcaaagagattttctgtgatttcttcatctaaattattttctttcatagcacccaatttctttcttctgaatacatagaacaacaaaaatattaaccactaatttatatttatctgtttataatgtttgtctcttccaccatattgtaagccctatgatggtagcaaccatgtttatttggttcatggctatatccacagcatatagcacagcatgcactacatagtaggcactcaaaaatattacttgaatgaataaataaatgaagaaaatggtagagttagactaaaagatttcaaaagctctatccacctagagattatgcagtttgtaattaaattaccttattttccttaattttaatgattgcttaaaagcttacaagtacttacaatatcccataaatactcttatagtgctctagtgtggctcttaaaatctttcagttaagcacacactatggaccaactcctgctgaaattggagtttgactcaataaagaaataagtggatattaataataatgaaatacaatctatagcagatttaatcaataaaatgagaagttagcctttgttttctttagtaagtgtattaaggaataaagaaaagactgaagaaaatgaagcaagaaaaaagatatagctaaggatggaattaaagaaattttgacagatggtaaaaataacttgccaaaaataataataaaaaacaaatgcaggattatctaagaaggtataaattactttaaatgactcagaaagaggtaaaagtggaatatataaataaccatactgaaggtctattcttataaacgacatcagctcaaaatgatttataagccagttctattcaacctttaaggaacagataattactctgttaaactttctgaagcattaaaagtgttgaaaaactttaaaattaattcaattgagctgcataatcctgttaaaaaacagaaaataaaagaaaaaataagaggaaactatagttcagtatcatttataaacataattacaaataagttaaatatttacaagttaaaattagcatttttttcagacaataatgtaaatgatcaaacaagttttattctagaagtgtaagaatgatgtagcattcggaaatttattaatataatttactaaattaacaaattagagaccattatacaattatgttattacaaaatggtattactcatgaatcaatccattcttttaaaaattgtattgttttaaattgccaaataaacattgtacatattcatggggtacatagtgatatttcgatacatgtaatgtatagtgatcagaccaggataaattagtctatccatcatctcaaacatttatttctttgtaatttctcatttattatgattaaacatttatcatattctccctctacccttcccagtctctggtatcctctattctactctttacttctatgatatcaactttttaagcttccatatatagtgagaacatgcaatgtttaactttcgtttgctggtttatttcacttaacatgatgtatctcagttccatccatgctgctgcaagtgacagaatttcattcttttttatgtctgaatagtattccattgtgtatatatacaccacattttatttatccattcacctgttgttggacacttagattgattccatatcttggatattgtgaatatgactgtgataaacatgggctgcagatgtttcttcaatttaatgatttcctttgctttggataaattaccaacaatggggttgctggatcatatggtagtcccaattgtagtttcttgaggaaccttcatactggtccttatagtggctgcactagcttatattcccaccaacagtgtagaggaattctctttcctttgcatccttgccagcatttgatattttttgtttttctgataatagccatcctaagtggggtgagatggtacctcattgtggttttgatttgcatttctctgatgattagtgatcttgaacattttttcatggatttgaacccatttatatgtcttcttttgagaaatatctcttcagattttttgcccattttttttttccttttgagatgtttgagttctttgcatattctggatattaatgccctgtcagataagtagtttactcccagtctgtaggttattgtttcactctgctgactgtttcctttgttgtgcagaagctttttagtttgatataatcccatttgtttatttttgcttttgtggcctgtgcttttaaggtcttattcataaaagcttttcccagaccaatatcttgaagcatttaccctatgtttttctaatagttttttttttttatcattttgggtcttatattgtatctttgatccattttgagttgatttttgtataggtgagaggcggggggttctaaattcattctagttttagtcatttatgccagtaccatgctgttatggttactacagctttgtagtatattttacgatctaggtgtggaatacctccagctttgttctttttgctcaagattgctttgtctattcagggtcttttatggtttcatgaaaattttaggagttttttctatgtctgtgaagaatgtcattggtattttgatagggattacattgaatctgcagattactttaggtagtattgtcattttaacaatattaattcttccaattaatgagcatgggatgtctttctatttgtttgtatactctcccatttctttgatgagtgttttgtagtttttcttgtagagatttttcacttccttgattaaacttattcccaggtattttgtttgttttttcatagctattgtaaatgagattaccttcttgatttctttttcagttactttattattcgtgtatggaaacactactgatttttgtatgttaattctgtatcctgcaactttactgaatttgtttatttacccattctaataagttttggtagaatatttaagtttttctatatgtaagatcagtcatctgcaaacaggaataatttgactttctcttttctaatttggatgccctttatttctttctcttgactaactattctggctaggacttcctcaacaccatttttaatgaagtcaagctaaaaataagtaagttcttccttaatttaataaaagaaaaaggaaaaacttagcaaatagcaaacataatacttaataggggaacattagtgtattttaattaaagtcttgatcaaaataagggtgcctaattctatcatgacaactggaatgggagtcctaacaaatgcaatgaggcaaaaagaaaaataagttagaaatatagaccaagaaactaacacttttactatttgcatacaatagaattgtctgagagaaggaatggaacaatatttagtaaaacaggttgatacaatgtcaaaatacaaaactcaatctcttttctattaacaataaaattttaattagaaaaaatgaaagagaaaataatccaactaaatagcaataaaattattaaatatatccacgaataagcagaagaatgtgtaaggtttttataggggatattatgtaattttattgatgtacatataataaagcctgaataaaagctttaaaatatgaaaactcaataaaggtgttaattaaacttaaataaatgtataaattaaagaaaatcctaattaaaatcccagtattttttaaaaatgaaagttatgagtttcttttaaaattcttttgaacaaaaaaatgcaagaatatcctaaaaaaaattaagcaagataaacaatgggagcgtaagttgggaagttttgttttatacttctttttttgttttgttttgagacagagtctcgctctgtcgcccaggctggagtgcagtggagtgatcttggctcactgcaagctccacctcctgggttcacgccattctcctgcctcagcctccccagtagctgggactacaggcacctgccaccgcgcccggctaattttttttttgtatttttagtagagaccaggtttcaccgtgttagccaggatggtctcgatctcctgacctcgtgatccagccgcctcagcctcccaaagtgctgagattacaggcgtgacccaccgcgccggccctgttttatacttcttaaaaaagacagaattgtgctctttattggagggaagtattattggggcaaatattacaagaaaactaggtttagttttggaagatgatgttgtcttcctttagctgggtgagtaattgctttgcaaatctcactcagtcaggttctaagtccaacatttgtagaaaaaaaaaaaatagaaaacttcaccttggccctagaccaaactcatcctcttatacaacatactggaagttctatattttgaggggattactggacactactcagccagtacaaagctcatgctgcacatttttatccttatcagactctaagtgtttattattaatttttgaggaatccagaaaggaagatggtgagtaatcaacactcccataaggaagttgtttgtgaaatctcaaaacaaaccaaaaagcaaaaagacacctgctaattacaaatacaagtttaaaattgtactttaatttaatttccaatatttgaatttcaaatttaaattcaagtttaaatatttcgatcctaaattcaaatttaatttgaattttaaaataatgggaaggtggtgtggtaaggtaatttgctctccatttgtgctaaaaaattttatctctacctcacataaaataacttccaggtgattatacaatcacaaaaaactactgacattaaagaaaagtgcaagagattattttgacaatgtggaatggagggaacctataaaagccaacaaacctataaaacccaaaagccattaaaaatgaatgaatttctctaaataaaaattaataatttctgcacaaggaaagatccatcaacaaagttaaaaaacaagcagcagactgggagaatttgcggcaaacacaacagaaaaagttaagtcctttattgcagcagtccccaacctttttgacagcagataccagttttgtggaaggcaattttgtcacggacagggtcgaggatgttttcgggatgattcaagcacattacgctcgttgttcactttatttccattagtattacattgtaatatataatgaaataattatacaactcaccataatgtagaatcagtgggagccatgagcttgtttttctgcaactagatggtcccatcttggtctgatgggagacagtgacagatcatcagccattagattctcataaagagtgtgcaacctagatccctcgcatgtgctgttcacaatagggtttcatactcctatgagaatctaaagccactgctgatcttgcaggaggcagaggtcaggtggtaatgcaagtgatggggagtggctgtatatacagatgaagctttgctcgctcacccaccactcacctcctgctgtgtggcctggttcctaacaggccacgtacaggtacccgtccatagcctgggggttaggaacccctactctaggggtttctatggttaaataaggaaaaacaaataacctaataagaaaaatgaacaaaagttataaatatgaaattcttcaagaaaatataaatgactagcatacatttcaaaatgtgcttaagttcattagtattgaggtgaattcaaatcgaagtagaaatgagctatctttctccatcagtttagcaaaacttaaagagatcgataatggccaatgctgactggtatgcaaactggtgctctcaagaagtattcatcagtatttaacctggctctacatttctgaagtcaatttgacattatctttcaaactaaagatttatatattattcgaccagaaaatccacatttaatatccttattttcttccacaatgaaggctttcttagatactgcccttgagcgtgtgagatcacaactcatgttcacgctcagtccaatcaaggatgttccaaggctcctcctcacatgttcagctaaagtttcccaatcatactcccaggcagctaggggagcaagggcttccagtctcagccccatggcatcacaatattggtatccctcccctataacaatttaggcaaaaggtcaagaactcaaaatagaaatgaagtggggagagcaggagtacgtatgtgaatggtgggttttggagcaaactacagaggatgtgccttggccaaaggaatctatatttataaaagaaatattatttttaaatgttggttcattactttaaaacaaaggaaatgaaatttatggggagcaaaggaaacataatttgcttcatgggcaatttcttgatatctcctaatcaagccttgccaccagtccagtattaccttcatttgtggttagcttcccctaactgttcctgcagtcttgaccagcccacacaccttatataggaccattgcaatctattgtaggctctaaaggcattgaatatctaaaagcaaactgtctcatcatggtttcttttcctagagggctccttgactcctctgcagatgtacaaacctcttctctagtgtcaagtctgtatgccaagggaatgggggtgatggtgaacagcattaagctactaaagctccaagcactcttccttttgacaaaggtgcccacttatcttttcattacaaagtcacttaagtgactcttcccagaacactgtaaatttgctacaacttcacttctctctctagaaagagatgcatctgataagtcctgcattggaaaaaattaaacttctgtgttctaatcccccagtcacatgaagactagtaggaaagctatatatatcaagaaatgcggacaaataccaaatacaacatgtgttctgccttcttacagagaaagggttaaggaaccacacctccaacttagaggccaaggttactttattcagttaggagaggaggcactgttttcatagagtaacgaaccacagtttttctgccccacagaattctaatgctgtcaagtatggtaagacagatgatcctatgtaaaatgatattttacaaagcaaaacagatataactcagtaactgtgcatctaattgacttaattgcctcatttatcacatgacttaagtgagctgatgttttctactctgcttcacccatgtaattcttgaaatataagagccaagacatggtgccaggcatgagcgagaaatcctctctcctgagaaaagatatcactggaatgatgttggctttggattccagtttattgaaaaatcaatgtccatttgtgcgaccaacacatatggctttcttccaggctgatgatggctttgggaggctggcaatcacctaatgaagtcagatcagcttacccggcacctgaattgcagttggcaaagtgactttgtcattaaaacccagtttatcattcctgttggtgttgttcttcccacttcaccccctcctctccatttctccagaagccacagtattgtttttctcttatgcagataacagaccaatggctccaatttttaacatttcaaagggactcatgtgatgtttggtgctcaaaggataaacaacttttttatatgtctgtgtcttttatgggttagagaagtacataaatacatatatatacatacgtacatgtatatacacacgtatatatacactcaagactgagtaggactacacacatatgtatgtagtgctactcagtcttgagtcaaaatagatgattttaaaagtcagagccaggtttgtaacaggcttaattgaaattcatcagtttagctgtcttgagtaaatcagcaaggctaactttgtctaatgtgttcatccatacatttctataaacagaatccagctcacattttacatatggctttaaaaaatttatcactaaagtaataccattttcccattattaaatggagtggcaatctaaattacaatactgtttttttttgtttgtttttttttagtcccccagtgttctcttcccctggagaatgccatcagagtgatagtcattggcaacagaagctctggcaaggcaggttttttgtttttttttctctccctgaaatctgccaagagtaacaaataattctgtcagaaagtgagcggtggctcaagcctgtaatcccagcactttgggaggccgaggcgggcagatcacgaggtcaggagatcaagactatcctggataacacgctgaaaccccgtctctactaaaaaaataaaaaataaaaaattagccgggcatggtggcaggcgcctgtagccccagctactcaggaggctgaggcaggagaatggctgaacccgggaggcggaggttgcagtgagctgagattgtgccattgcactccagcctgggcgacagagcaagacttcatctcaaaaaaaataaaaaataataataataataaagtgccagctcagccatgaagcatggttgctgggttcatatttggttccatcatgtgaagacttctttttgcaaggatagcaggagctcacaaagttaatgagaggatagagaaccaggcatggaggctgggtttaaaccaagacacttctatgccaagagggaagaatccaaaatcttttagtccaaacagactggtctagagctactgctttacaaaggacatggaggctgcttctgttgctgctatgaaagaatctaaacggtttcttttgtctctgtttcttgctgaagagtcacagtcccatgttggccgggcctgggacatttgcttcccttctggctggtggtgctccaaagagaaaggatgtgatctctttggtttcttcccacaaggaaaaggtagttgttgggaacctgccccgtatgatgaaagtcatctgcagtcagacgagcagcacctaaaccgggagcttgtgaaagaaaactgccagtgggtttctgaagggttcaacatgtgcctgaagtgcccagaacatgtgatcaaaacaaggaactgaaagcaacagtgagtatatggtcatttgtgttcagcattcccatagagttgaaatctaaaacaaagatctgaagttcgcaatgacttcagcagatctgaactgataagtattataaactggaaatgttcattggcaatttgaaggattcaagctccctgcaatcttgatgagtgaaagaatgaagtctactgagagtgatgcaataatgaaacatgcaaaatagtttcttaggaagcataataaacaggcaaccaagggatagggaaataatctagttgggaagtaaagtctattgtaaaaatctcaaggttaggaggaaatatagacaggacataaattcacagtgttctacagttgtagtaaggcatatcaccaaatggatataggagacataaacatcattccaatatatatatggaaattgctctttttacatagtactttatcacacaattaatttgtttttcccatgcagtccttgtttatagcaatatgttgattctgggcaacagattttttttaaaactctcaagtgggagaaataagagagagggagaggaatatacgttgagtgaatgttcaaataatgttccaggcattttttcatgtcttatagtttaattcttacaagagaccttccatgtagctgtgagctgctcacattccagataataaagctgagattcagagaggtgtatgagatttgtctaaggtcacataaagcagaaaccgatttttgtgcatgtgtatgtaaagagttgcatgaagtcatagtcaggatcacactatctgctgcccagtctgacttctggctcatcacttcagtaaaacaacactagcaaaggttaacagaaatttccaggtgatgaaattcagtggatatttttcagtcctcaacatctaacttcaggctcagaagcatctcactcatgatacaattttctccttcttgaaacctgtcttctacagggtgtcacatgtgagtggttatctttttccttcaccaaccaatcccattttgttctctttccagtgttaaccaccccttactggcattcctctcttcttattctttttgctatttctggatgatcttatacaggcccacatttaataaccaatgagaagcagatatcttaatgaatgcattctagaccagacctgcaacttttaagtccagtctaatctacaaaatgacctatatgataccacttttcagaatatcaatagtactctgaaattaaaatgttaaaactgagcttataatttgccccagcctgcaaaaaacccccaaccaatcaacaaaaacaaacaaacaaataaataaatgcatgcttgatcttttccagcatcttctgtcacaatgaatggtaccaccatgaatcacatttgcaattttatacttatttgcatgataattgcctgttagtcaaaatgttaatattgcatctccaatctgctgcagccctattcaaaacagtgggaaaatacctgtgaactagacaggcagtaatcctattgtcaaggattatacaatctaggaagggaacacagtaaaaaataaagagggcaaatgcagtagagtgtggcagagagggctgctttagctaggaagttaccaaataatttgagacttggatgatgaaatgaggcagccacatgactctgtgaaggaagaatgttccaaggaggaggagcagcaattgtaaaggtgctgagatgaagataagttgtatttgtcataagagctacacataagccggtatggctggagtattatataaaaggatagtgaagggagatagggtcagaaaattctgtaagacaaggacattcacatcagatctttggagtaagaaagaagtaaaataacaacaaaaaagaaagctgagttagcagttgaaggaaaagttacatttactttaaaaagttaaaccatgaaagagtttcagataatggaagtggcctggcatacactcaatctccgtatctactttcatactgtccccttttcaaggataattggaggcaagacatggaggccctttaactgatgtctctaaagtcactccatgatgaaagggcaaaaacggatgagttcagaaaattgtgagaagactggaaacgtcagctaatacattccttgtatacaaaagattgagcatagaaattctactgacatctaattgttggcatgtgcaagctaagtgttaccaaatgccttcctaaataggtacggggtggtgtggaaagaaatgtttctctgttgactaaatggtgaaagcagcaacctattcactgaattatccttagaggctgaatgctaattgattttatgtgcatgtcaagaagtcaatcaatggcaggcatgcagcaaaatagcagagtaaagaataatacacgaagcagattccagttaaatatggaaagcatctaatcttatccctggaaatgtctactttaatgaccacgtagctgttctttttgccagtttggcatctataaacttcagcagagtctcctcaatttcattctgaacatttatagatgcacatatattctttcaaaaggaaaccaacattgtaacatcataacctttaaacattttatttgtataaatttatgaggtacaagtgcaattttgttacatgcatagaatgtatagtggtgaagtcagggcttttagcttatccatcacctgaacaatatacattgcactcatcaagtaattaaagtgaaactcgtgtcatgtgaaattgaccactttaaagtgtacaatcaatggcatttagtacattcacaatgttgtgcaaccactacctctatctagttccaaaaggtgtaagcaacccaatgtctatcaatagatgaataaacaagtgtgatatgcctgtaaagttgaatagtattcagccataaaaagatatgatactgatacatgctgtgacatagtactgatacatgctgcgatgtggacaaacattgaaaacatgctgagtgaaaaaaaacccagatacaaaaggtcacatattgtataatttcatttatatgaaatatccataataggcaaatccatagaaacttcataagtttttatatgaagaatgatgctgaattctcctttaagaactgtgaacttttgtgaatgtaggagctgcaccttattcatctgtctcctcagctctcagtatacagttcctgacacagaaagagaaggctcgctgtattgccaaggttcttatcagagaagtggaaccaacaagatacatgcatacatacatacacatatacctatatgcacatacatatacatgaatgtttatagagatttattataaggatttgaccgtacacaactatggaagaggagaaacagtgtatgtgaagtttagttcctgaacttggtgctgggacatgatgcccacaggcaggtggctgggaagagaacatagttgtggagtgggcgaagcaaagacaaactggaagctgaatttgagctggagccctcaaaaatgaactagaacccacaagcattcccctttgccttcaagtttccaactttcatgatgagagttttctgcaggaatagctggtgcccctttgtcaggaagctaaccacacgctgggccaggagtcagagaagatgcagcaggatctggatgagttgggggcctggctgctccactctccagccaggaagccaagaggtcagcaccagctggcatgagctgcaacagcaacagtgctttgtgctgcaccaatcttctcagtaccagaagtagatagctgggattttacttctgcttcttcatctgggcttgaactgatcacatgaggaaaaaaaggtggatgtgggaaatgaaattccagtttagctaaattaatgcaatgcaaatttcgaacaccaaggagattcgtagaagaagttagtaaggaggtgtaagaagcagcattttggcaagcacttgggtacttaccttgcctatagagtgtgtgagaagtattttgcaaggaccttatatagaccagaaaatggattggacattttaccagcattcttatttcactatatcttcacaatgactctatgtcatagttacaatttttattaccataacaaaaatgaagcagggaggcacaatatgcaggtaagtcgtgatccacccttagcctaggtagcaagtagctgagccaggaaactgaatttagatctagcccattacaaagcccatgccctatccactgtagcacactacaccccaccttgatcttctcccaatttgtgtatagtgaagttttctgcttctcttgtttccatcttcctccctttctaaggaactaaaaaaagggggaaggggcagcatgggcatacttttcttcccctgtaactgatatatagatgacccagctgtgaaatttgtactttttcagtgatgcccatcagaaatgataggaagctcagcatcagaaaatggggtcttctcttttttcactcttaggagtgaattattctcttccttctggtgcctgtgctctgccctctgctgttaaatccacttttatcacctactccgaataatctaccctgaagctatggacaagtcaaattctgagacagaatttattcacttgtttgttgaatctcacaaatttccatcaaaaagtatgacattttccaatgacaaaatgcttgacagtatcacaaaaagtcttcatatgtaacttatatagccaaggatgtagatcaataaactgtatacattatttgcctaagatgaggcattaaagtggtaatagctaatattttccagcacttactctgcaaatggttctgagacaaaagttttatatgaattattttcttaatctaaatgaatacctaatggaagaggtaattatacatttctatattgcaaatgaaaaatctgaggcttagagaagttaaaaaacttgttcaaagggtagtgagctaatcagatctgtttgatctcaaagcacttggtctgcatgttcatgagatgccatttgaaactcattagcaaattattgctattatttaatgaatatccactgagtgcctgctaggtgtgcaaatagcggtagcaaattgaaacaccatggtgcggcataaaatgagaaatataattacaatcgtattttttgtcttctaataactctcttcaaagtcagtttctgaaagacatactgtagtaacatttggcagatgaaagcacagtctttgaaggatctatcccaaaaggatgggaatgcagtaattccctccaaacccctgctctccaaagatgttaaaattgctcattttaatagacagcaattaagtaaatctcacaactgcaaatataattgacaaaatttattcagtttcagctttttgaatgcacaatttgtgtacacaaaacaaactagtaaataacaggccttatttgtgttcattttatcttttcattactatacgttgtgaagatagggacctctacaatggaagaatctaacttaaggtagcaaaatgctcatgaagatttctgcggctagtccagcagattccgtcttcacctactttagattttacttttgctgctggtgctgtcatttccactgtccctaaagttcttgttttccttttcatctttgatctttaatgtgtccacagtagaaaggctgtggaactggattagaatgggaaaggagaccaggccacggtgatcttctagaagatcatctgtctcattttcccacactgcacactggattcctaactgcaatggtcagtggatgtccacttggtctagggttttactaggattctttaacccagagcttcaacagagctctgtgacaaaggagtcacagatgactcctccataacacaggatgagaactatggtttggcataaattttaacttatgctagttatgtggctattgaattatatatgacaggcaaatgggttctgatataagcttcaattcctcctttaaaacatttattttattttatgtttttggagacagggtctcgctctgtcatccaggctgagggcagtggcatgatcatggctcactgcagccttgacctcctgggctcaagcaaccctcccctcctcagtctcctatgtagctgggaccacaggctcatgccaccacacctggataattttttattttttgtagagacagagtctcattatgttgtccaggctggtctcatacacctggcctcaagagatcctttcaaaacgctgggattgcagacatgagccaccatccccagccaattccttcttactatgtgaattaatttggctgggtatggctcagaagtaatctttcataatgtttggggatttgtttgtttgtttttttctttgtatgaggtctactgatcctctttatttgcgtttgttttgttttgtgatgatgttacccgtagtctcttcttattttgcaagttttttcaaagtatactatatcaactgagttgcttaaagggaaattactttcttcaatctttctcaagatgacctactactgatcaccctttaccctgagtgcctgccctgagtgcctggactctgtgtctcttgttcatgtggttttttttcctccttaatcacgaaagtctgtgtcctgcctgtgctgtggcaatactttccctgtatggaatggctgctatgtattatctctcactttcacagtaatctttcagaatggtataatcatttccatttcattttacaaataaaataaaatactaaggctcagagaaattcagttacttttataaggtcacacaatcaagattaaaatctgtttgactttcaagctcagagtaactgaaagggtgctttatccatttccaaatttagtgagaaaattaactattagactggatagaaatatataatcactgtgaggcataaggcttgggttcaagccctgcttccatctttactatatgcttaattataaataagttacttgaactctctaggaaacagtttcctcagctgtagaatggacataattacgttatttaattctctggtatatcatgaggactaaatgcaataccacctgtggtatgcttaggacagtggatggcatgtaggaagatttcaataaatgctagctgccattactattgttgttactgttatttcctatccaaaatgtagccttctattacacagaaacatggttatcatatttactcagaaacatcagtggaagtccttcatgactgtaggagttcagaggtttgagtgtttaaccatttcataccctctgtcacatagggccatatctatgctgcaaaggaagaaaatatttttaaaattagtgctttccaaactatggtaatattaccactttttttttcctgtactgactctgttcttaaatacgaagtaaaatgttcaccaaatactaaacaatgcctaaagtagcctcattctataaatccctattcatggaaaacaatcttggcttggctttggtgtctgtaaatgtgaggattagactccctggaaaagctgaccagacagcagttaacaaataaccctccagcaagaataattcccggatgagctgggcaagatcagggctctcacttcccataaatctttgaccaggcattgcccttctttctgggaactaccatcattgctttccctcccctcccctcccctcttgtacccttccctcccctccctcttttccttccttccttccttccttccttccttccttccttcctccctccctccctccctccctccctctctccctccctccttctctccctcccttcctactaaggaattaaagcagacatcaaaaccaaattataggactaaacattttgtatgccagtgtctgtaacactatgtgtgctatgtgtatgtatgtaaacttgaaaagttaggatctcaagggcagggactgtgtgtggtcctactctcgaccatgcctaaaacactgagaggtcacactctatgccatggccacagagtaactgaggtgggttctgttctcaaaacaagcaaacaagtaaacattatcaggagttaatctcacacttggtgttctatgacattggccagaatacctcagatatatttggggaacaattatattgaaataatagacataaaggtaatgaaacactgggcctcctgttctactgttaaggatgatctctgcaaaatgaggagaaggaagcctgggtgacttaatcaacactcccttctgctttgctgtacaatgcctattagatgcacagtggtcttaagcacttaaaatattgaggttgatcctaaactgtccttctggaattgggtattctctggggtttatctatactagaacattgctcaccttagtgaggtgagtcagcctttcccagttctctatatagcttattaattgagctgtccctctgccagtggtttccaaacacaggtctatgacaagatttcactggtgtgaggtaaagtgaaaataataagcataacatagagactttttcttatggctaaatttattcaattgaaagcaagaccatttactctgagattatgtaattcctatattttgtgacaaagaggactttcttttatgaaaggatctgcataagagaagcttcagaaaaccacggttttaaagtatgggaaatggataaactgctctaggccataaatggtgtgtgtgtgtgtgtgtgtgtgtgtgtgtgtgtgtgttcattgtggggcacccacgtcaagggaccatgtgactggacagtccctaaaggaagcttctaataagaaactcagtggggggatgttagcaccactcagatagatgctaatgcagaggggttattccacacttagaagggaaagctattctacacttacagaaaagcctttaattgtcacattgcctattgctgttttgggatgtattttctttctctgggctgctcttggtgtactttaacattcaatttcaccgaaataaaattgtgccctaggaatggccttgatgagcatccaacgactaaaagagaatatgaaaagaaaacagtgtgatggtgttcctaataatggtgatatattaaaggtacattatggctcaagttttctagaacacagagtgcatggccagtgttgatcaacactgctttactgagaagtgcaatcagatagcaaaataaaggagagaaaaataagtatttcatatacatggggcatttaatcatcttaatcaaaatgaagtgaattcgtgatgtagttgaaattctgagaagctgctttaaaatgccatttttggatgtcattagtgtttatgagaagtgagtgactgtgctcaggagggtaaatgactggcccaggtttacacagctggagcatggcagagccaatctcaaaatcaggctaaactcctgagctaatgggcttttatcattcctgcagattagtgatacagagctttttgaggagtatctggaacaaggattattattctcattttggagaaaaaggaaatagatgcattgaggaatctagtaatcactctaaaaacaaactagcaaatcaaatccagcaatgtgtaaagagaattatacaccttgaccaagtgggatttattccagatgtgcaaggttgagtcaacatttgaaaatcaattaatgtaatctatggcatcaacagactaaagaaaaaaatacgtaatcacaataaatgcagaataagcatttgacaaaatccaacacccattcatgacttaaaaaaaaaaaaaaaacaactctctacaagctaggaatagagaatttctccaacttgataaagaacatctgtaaaaaccccactgctaacaccatactcaatagttataaactgggagatttcctgctgagatcaggaagaaggcaatcctggttcactcttccttttcaacatcatactgaaaatcctagctaatgcaataaggcaagaaaaagaaataaggtttacagattgggaaggaagaaataaattgcctttgtttacagatggcatgattgtccatctgatttaacaaaatctgatttaacaaaagaaacttcctggaactaacaagcaattacagaaagattgtagtatacaagaataacatacaaaggtcaattgctttcctatataccagcaatgaacaactgtaaattgaaattaaaagcacaatatcatttaaaatagcacaccccaaaatgaaatacttaggcaaaactgtaacaaaatataaacaaaatctatgtgaggaaaactgcaaaactctgatgcaagaaatcaaaaaagaactaaataaacagagaaatttatgttcatgtaaagagtcagtattgtcaagatgtcaagattgtcaagatgtcttttctccccaaattgatctatagattcaatgcaatctccataaaaatcccaagaagcgattttgtggatattgagaaattgtttctaaagttaatatggagtggtaaaaaaatccataataaacgacaacattttgaagaagacaaagttgggcagttaacactacccaacattaagctttactataaaggcacagtaatcaagatcatatggttggtattggcaaaagaatagggaaataggccaggcatggtggctcatgctggcaatcccagcactttgggaggatgaggtgggcggatcatgaggtcaggagtttgagacctgcctggccaacgtagtgaaaccctatctctactaaaaatacaaaaaattagccaggtgtggtggtgggcacctgtaatcccagctgcttggaaggctgaggcaaggagaattgcttgaacctgggaggcggaggttgcagtgagccgagattgagccactgcactccagccctggcgacggtgtgagactccatctaaaaaaaaaaaaaaaaaaagaaagaaaagcctcaaaataaaccaacacaaatttggtgagctgatcttgacaaaggaggaaaggaaaaaaaaatgcagcagcaaaggtagccaatggttctggagagctggccatccacatgcaaacaaatgaatctggatacacatcttacacccttcacaaaaattaattcgaaatggatcatagacctatatgtaaaacacaaaactgtaaaacactaagaacatagactaggagagaaattttttttattttactttaagttttaaggtacatgtgcacaacatgcatgtttgttacatatgtatacatgtgccatgttggtgtgctgtacccattaactggtcatttaacattaggtatatctcttcatgctatccctcccccctccccccacctcacaacttagatttgatgacgactttttagatactatatcaaaaagacaatccatgaaataacttattggtaagcacgttttttctgtgaatctaaaactattctaaaaataaagcctgttaaaaaactcaggtaataaacagtgagtgggtaggaattttgttaaaaaaaaaaaaagaagcagaagaataagaaaaagaaaaagagtatcagatccctagagagagcactggaaggggtcatggagagttgattctagaccttgctctgcagctagtcagcagtgtatttccttgggaaaggaataatccctctaggcttcattcctcatgtacaaaacgaagcaggtggaatacgtgatctctaaagttcctatgtccctcccaatgctcagttttggaacaaagcaatcaaggctacccttaaggaagttcatataggatttaaggggatctgaacagatcctcttatcccaaattatcatcttcactacctgatgtgcccagtattagagattcacttttttgttgttgttgtaacgtacatttccttgagtatattaagatgaagatcaaccccagccctaactctgcttctcaatacagttgcccttaggaactgttgtatctaaaggcataaggttaactagggtgtattttgtcagggaagaggaatcaaagtaaaatctggtatatgtatcaagtgtttgaaacatttaagtaaatgaatggatgagtcaataattgtaaagaagaagggtgtaaagataagagagctacagatgtacagaactgcattagggtcatagaaggagggatgaaccctaaaaaaagagaagctccaaagatagatttgcctgtttcatacttatgcctgtggctagccctgaggccttattactcacctcttcttgtcaatcattcatttattgagcacctactacatgccagaaactgtactcagcatctgcggtcaatggcaagtaaacagagggaatgaatctctttctcagagctatttgcctggctccttgctaaatgcccttacggcagggtagataccaggatttttgctaactttccaactcttgacatccttctgtactcataccaaactcaagaaagagttcaaatgcccctttcatctaacttcccaatcttcattgctttgaaggctagcagaagtaaaacttttccttggttcccctactgtgaataaatgctgcccccttctggaatattggcagaagtataaggaactgacagcagtgaaaattcttacagttcatggaaaattagggttagaaaagactttagttaagtctcattgttttatccatgggaagtttgatgcttggaaaggtcaacttgcctgtttatatcttggaagagaagagagttagtaataacaaggaatgcaagaggggactgaaacctatgctttctattaggtttcctcctttcaagtttactagactggggacagggttatagatattttcattgttcctatgcatgtgtttatctacacatttcccctcatttttcatcctattcatcccatgctttcatctctttcctatttcctgttttatagtgtagcgataggcaggctcaccttgagaacccaatgcaggttaagagcggtctcaagcagtgcctctgtccatgcacttgtgtgtcttctaactttttatcgatttgtgatatcttttatagatttctggggaaggatgtgtaaaagtacactctttatttataaatttaggtctacaggaacagatctaccattatcttatcttccactcattcattcagtaaaaatatattgaccatctactttgtgttatatgttgtgaatacaaaaacaaaaaagacaaagtctctgttccctaggagttatcacttattggagaagacagaaaagtaaacacatgatcagaggcagcagcatggcaaaagccctccaagaggaactgtcagaacatagatggaggcatcaaactcagactgaaggagggagggaggttacctgcaggaggtggtgtcttaccttccaggtgtctgaggattatgtgtaaaataaaggggagtacaagtgtcaaactgtcagcaaagttttctaacatgcctgttccatgctttaacccttgagaggcctcagagatttgtaaatctcaaagtgaaaaatatctgcttagtgatcactgaaattcaaggatataaacatccgatataatgtatgagggcaaattttacatgtcaaatcacttagaaacatcacttttagtaaaatcatgatagcatcgaattttcttttcatctacttctgtaattgatattaacatatttatacagcccaaattagtcccacggtttgtaaaacccttttctttactgagtatctgtgtcagcttgtgattagcagactctatagggtgtctaataaagaaaaagacaacataaaactggaaaaagacctaaaagtgtgatggaagtcaacgaacttgatgcttgcaaaatgttctgagaaggaaggttatttatctgtgttaacaacgccttgaagtctgttttagtgtgttgtagtggaatgcagatttaattcagagaaatgtgattaggagagaaaaaggagttgttaattcctggatggatcttgggcaagtcatttaatcccaagtctcagacacagggctacctctagcccatatggttcttatatacaaattaggaaaaggctcccctgtctttgtgggtgtagcccagctggcactaggcttgatgaacagaatgtgggatggatctcagccttctcttactccttagttgtgtctctttctgtaatgaataacctcctcaagcagatgtagatgccctggccagaaatcttaacagtaaaatggagctcgtacatcttttatgtaccttacaaggtggctgcaggagtcttatgaaaaaaaaagtatatacataacacacatgagttgtattataccaaatctaatgctccatatttggaagaaggagttcagtgagagtgttgtatcaacaatcacagatactctcattagagatgctcacaagagaacttacagtttctaattagacacctgctgcaaatgtcattcaggatggcctgaggatgttcatgttctgtggagtacagcaactctgatttcttggaaggattcttttgctatcaaaattccaaacagcagagccccagccacttcagagaattctgaatcctgttgcctaaattaacaggtggctgtaggcagaggactgtgttggcagccaatggccgcaggtgctgagagccaccattgatctactaagcacaccagaggcacagctaagcacagtctcatctttcttttgcattgcattgcatcccaaatatttgctatttttttctagaagaattagctcaacacgtatctgttttaaaaatatttctaataactacgttttaggttttatggttccatttaatttataaaaattcaaattactgtggtaaagcaattaagttttcattctttaaaccaaaatgggaggatgtactctgattttatacctatgacacacactcaaacatactaggcatgcttcctcatagggtctttgaacttatgatgtatctataatacctggaatgctcttccctgcatatctacacaaatagctcatcacctcttttaagtcttggaggtttggtttaataatgtcaatgtacagtaaatgtttattgaattgaattgcacattgaaggtggtgggaatcattgacccttaataggttattttggacctattactttttgaaaattacttaaaaatctctctatataattatccttctatttaaagctgatgtttattacattccattattcataagtagctttaaacaggattatccatattttttccaagtgtttctgctctttagtaatctgacagacaagccaactcctatgtttaacattagcttctagaattacaaggggtgtgtgtgtgtgtgtgtgtgtgtgtgtgtgtgtatgcaagcacatgcatgtaaaataatatttgaaatttttggtgatatccaagacactaagataaaagtacaaaataaaaaagtcacaggggcagtagatggatagagaatgacagtgatctagaggctttggacagccattccttttcccgccttgaagtattaccttctcatgtacctcatactctttacttaatccctcatcccaagttcatgtcctttgcagggacacggatgaagctggaaaccatcattctgagcaaacaatcacaaggacagaaaaccaaacaccgcatgttctcactcataggtgggaactgaacaatgagaacacttggacacagggcggggaacatcacacaccggggcctgtcggggggtggggggtagggggagggatagcattaggaaaaatacctaatgtaaatgatgagttaatgggtgcagcaaaccaacatggcacatgtacacctatgtaacaaacctgcatgttgtgcacatgtaccctagaacttaaactataaaaaaaaaaaatcccttatccccaccctttccaaagaaatcttccaaattacttggattggccaaatcatggtggaaatcacattctaaaaaaccaaacacgccaaaattttagcagttgttttaaagtttacatgatctctcatgtctttaataggccataatgtggttttaaagcctatgatgtacacatttttaaataaacccacatatatatggtgaactgattttgttaagaatgccaaaaatacacgatggaaaaaggatagtttcttcaaaaaattgggttgtgaaaactggatatacacatgcaaaataatgaaattggggccttactttacatcgcacacaaaaataaactcaaaatgaattaaagacttaactgtaagaacagaaactctaaaaatcttagaaggaaacatagggtaaaatcttcttgtcgttggtttaaaaatgacttcttggatatgacaccaaaagcacaggctgtgaaaggaaaaataaacaagtaggattatatcaaagtaaaacaattctgtaccagcaaaggatgttttaacttttaggttcaggggtacacatcaggtttgttatataggtaaactgtgtgtcatcggttttgatgtacagattgtttcatcatctaggtaagaagcatagtacttggataggtagtttttccgttctcgccctcctcccaccatccaccctaaagtaggtactgtgtctgttctcttctttgtgtccatgagtacccaatgtttagctcccacttacaagtgagaacatgcagtatttggttttctgttcctgtgttaggtcgcttaggataatggcttccagctccactcatgttgctgcaaagaacatgatctcattcttttttatggctgaatagtattccatggtgtatatgtaacaccttttttttttttttaatccagtctactgttgatgggcatttaggttgattccatgtctttggtattgtgaatagtgctgcaacgaacatacacatgcatgtgtgtctttatggttaaacaatttatagtcctttgggtatatatcccataatgggatttctgggtcaaatggtaattctgtttttagctctttgaggaatcaccacactgccttttgcaacggctgaactaacttatactaccacccttttctccgcagcctcaccagaatctgttatttttttgacttttaaaatgatagcattctgactgatgaaagatggtatctcactgtggtattggtttgcatttctctaatggttaatgtttagcattttttcatatgcttcttggctgcatatatgccttcttttgaaaagtgtctgttcatgtcaggaaaggaaagatttaacagaataaaatgcagtctatggaatgggagaaaatatttgcaaaccatatacctaaaaggggttaatttctaaaatacacatgaaacttctacaactcaatagcaaaaaaaaaaaaaaaaaaaaaaaccaacccaaataacatgattaaaaaatagacaaaagacttgaacagacatttctccaaagaaggcaaacaaatggaccacaggtatactaaggaaaatgctcaacatcattaattatttaaaaatgcaaatcaaaactacaataagatagatatcatgtcacacctgttaggatggctactataaaaaaacataaaaagcattggtgatgatgtggagaaattggaatccttgtacactgttcgtgagaatgtaaaattttgcagcagctatgaaaaacagtatggatgttccacaaaaatgtaaaaatggagctaacttatgactcagcaatcccacttctgtgtatatatccaaaggaaatacaattattatctccaagacatatctgcactcccatgttcattgcaccattattcacagtaaccaagatatggaaacaatctaagtctctatcaacaaatgaatagaacgagaaatgtagcatacacgtacaataaatattactaagccttaaaaaagaagggtatcctgctgtttgtgacaacatcaataaacctaggggacattatgctaagtgaaataagtagtatttgtgaaagacaaatactgcttgattctacttacatgaggtatctaatatagtcaaactcttagaaacagagaatacagtagtggttgccaggggcaggggagtaagagaaatggggaattgttgttcagtggcataaagtttcatttatgctaggtgaataagctctaggcgtctgctgtacagagtagtgcctatagttaacaatacagtattgcacacttcaaaatttaagaggatgaatctcatattaagtgtttttactgccaaaacaaaacaaaatcaaacaaaaatactccccaaaacaaaaaaacaaagggaaataaggaaaatttgtgaggtgttggacatgtctatttccttgatgtggtgatggtatattgtgtttggattgtccaaactcttcaaattgaacatattaaatatacgtagttctttgtatatcaatcatatttcaataaagctgttaaacaataaaacaaactgctttttaatttgatgtttcttgacaatacaatattatgattatgaatctaatcacactctcagggtcatatctcagatttaccacttactgtaagtgactttaggaaaattacataattgctctgggtctcaggttttcatctgtaagatggggataataacaggattacttcccagagttactgagaagagttaatgagattgcatcataaggtgcctagcacactgactggcatgcagcaaaagcttaacaaatgttagctctaattatgttttagtaaaggatgcgtttagtatattcttacatgttttttctgcagtgtttcaatgcttagcattgtctgctttacctttcaatcactagagaactatagggaccatgattagactgccagattcttatcttaacatgtgatgagagcaggagattgtggtatcactgatgaactgtgccagaatctcagggcaagtcatgcttgccactgtctactatatggaactgcatgtgagttctggtatctttaaacccattttcttccttgtcaggttcacaactaagccaactgttatggccagggttaggttccagctcatgctgaggtctgaagggagtgggtagatgagcagatagctgaaagaacacttagggggccgtaggcaggtgaaatgcagttttattcagcagctctctcatcagcagcttactcacactagttcttctacactgttcgccttgtctcagctgcttgagctggctactcccacacacagctgcacggttggctctctcttgccgtcagggtcagcagcttaactctttctctctctgggtatgagcgagcggagctgtgttctggctccccactgtccatctgcaaagacacacagctctgactgtctctctctctccttctctgggtgcaagcatgcctgtacagtgttagcagggcaattataccttttacagacaatagtggcttagagccaaatgatgagccttcccatgttatggctacatggctgtgataacaagcggagttatatgcctgcgctctaaaatcattgagtcatgtacaatgtaaacatcctaccttggcctatccttgaccaaagcacagccatgttctttacattcctcttatttgtttttacctttcagaatatcaactattcaagggcaagggagaattaacatttgtttaaaacctactctatgctggaagttgagctagtgactctaatataccacaatccttttcatcctcatttctacatataagaaactgagtgaagagcttaagtgatttacctgaagttgtagagttattaagtggccagctggaggttccactcctggtctctctctttccaaagcctcccatgcattgtgaattaaaaggatattccataaagaacccaaagagagaattttactctctattccaagcagactgttacttttattccaaaacactctccctgtcttctacttatagccctacttcatccctaggtgttagcacaggtgccacctcagttccttcttaactgatctaacctctacaaccttttcttctcagcaattttggtttgagagcaagcattgtttgtggtaaaggagatatgagaaggcagaagagccataatattgtgacttaaatgtgaccttgtgaaggagagaagaaaggaagcttggtggaattgtcccaggccaccttgcagtctagaagtttggcaaggccactggggagtccttgagtcaaaacctctaggcatggatctgccttagtgtcctgttgtgctcagtcactgcctggcaccagcccatgtaagagggaggtctcctagggccattcttgaggctgtcaggagaagacattactaacagagagactataatgaataaagttatgaaagtaggaaaaggcatgccattataagaaatgtgcccagaattctagtatggcccaagtctagggtatgggtgagactatgttgggggatgggagagttgcatatctatatctatagatatagatatagagatatatctggaggcagagggaagcttggtaatgtaagactcgttgtcattgtgtggtctggaccatcagcatcacctgggaactttttggacatcaaaattgcaaattgcaaattccaggatacccacccccagattactcaatcagaagctctgagggatggggcttgcaatgtgtgttttaagaagtcctccaggtgattctgatgcatgcttaagtttgagaaccagggcgtaataagacactgaaaaatcaggtatgagcttaaccagaaaatattatcaatccaatgccaactctttagggatacgctgcacatggtttccccattgtttaaatcagtgttttccagcctgaattataaattgtaggcttgaaaactaagctctctatcttgaaactatgtaaatatctcattccttatcaaaatgtcagttgattcatgtatgaatttatgtctgttgactcatagtttcatgttttattcacatgaataaagcttcaccaagtgaagcccttcccatgctgctctagcactggcacaccatggcagatgggcctccttgtggatgtcctcctcatactgctcgagctctgagtacgcatatcaggctgctccctgagtaaaagccattctcatcctgatccagttttgacactccatgctaagcattatcacatgatcaggattatggttcaaagtaattgcttcctggtacaccttgattcatttagcctcccatactaccatgctatatatgtgtgtgcgtgtgtgtgtgtgtgttgtatttaatacaagatgaaaactcataacaagcctgtcaactaaaaccaggaatctattgccaaaatcccagaagaatctgtagcccttagaatgtaacagaaaagaaactggggatggagtgaggggtgaagcttgtgggacattgcttcctggaggtagtgttctctctggtcaggtgtagagacatgaagagctctggtaacagtgcatgctaggaattgtagttttatatttactttcctgtaatgagacctgggattctgcacacagaaaaaaatatgtccccctaggatctattccagagttattgacgatgttattggagtccacaaatacatgaacttttgttggttggttcattggttttagtttccctggtgactctagatttgaacatctatttgggaaccactgtcttttatggatccttaacagattttggcaatttggctaaaaatttagcaactgaaatagcatataagaagataaggccataggaaatgggctgaaaactgagacaagaatagactgagatgatagaaaaattgaattatatacaattataaaataatgagatagaaaaggagactggttaagaaaaaattctaatggccttaaacttacagtggcaaaacttgacaaagaaaagagatgaattaattgggtaaaaaaataaaatggctatgtgcaagaccagaaagatgcattcattcaatacatattttttatcacctatgatgtgctgggctgttggaatacagtggtgaacacatgatacatggattcagctatataattgcactcacacactgtaaaggagataggcacttaataaatattcacaaaatacacattaaaactgtgatagcagctatggggaaaatctatgggtgctattaagggcatacatataccatgttaaaatttgtattagtcagggttctccaaagagacagagtcaataggatatacatgatatatgagaggagatttgttaggattggctcacacaattatggaggctgagaagttgcaggacaagccatctgcaagctggagaccctgcaatgctgaaaacatcaaactcagtccaagtcagaaggcctcagagccagggaagctgatggggtaacagtccaaggccaaaggcctgagaacccagggggccactggtgtaagtcttggaatttaaaggccagggagcctggagttgttgcatagggacaggagaaaaagagtgtatcccagctgcagcagacagatcaacacattcaccttttctctgtttttgttccctccagacccccagcagattaacgacaccttcccacactgagggcagttctttcctacctggtcccctcagactcacatgctaatcttctctagaaacaccctcacagacaccccaaaataattctttaccaggcttctaggtattccttaatccagtcaagttgatactaaaattgacataagactaatctggtctaaaagagaaataacaaggtaaaaatgtatagatattctagaggaggacaataactgaataactgaaatagaagacaataatagaataactgaaatagaagaattaatctgtcacagtggaatacaattgtatggagttcaaaatactaggatagttagatgaaattctcggcaaaattaccaagaaaggagatatagataccctctggcacaaaagttaaaatctaagaataaagaaaaaattcttcaagtgacaagggaggaacaggtgactgacaaagatagaaaatgagttgtctcagatgttggcgaggcagcaaagaaaagggaacgcttatacactgttggtggaaatgtacattagtgcagttactgtggaaagcagtttgaagatttcttaaagaactcagaactaccagttgaaccaataatcccattactctatgaatatccaaaggaaacaaatcattctaccaaaaagacacatgaacttgcatgttcattgcaacactattcacaatagcaaacacatggactcaacccaggtgcccatcaataataaactggataaagaaaatgtggaatatatataccatggaataccatgcagccttaacaaagatcaaaatcatgtcctttgcagcaacgtggatggagctggaggccatccatgtttccattctatttttaatttactagtgatttcctttacatattgaaaaatcattcaaattacatttttctcattattacatgacataaacacaacataaacacaactccgatatttaagcattctatattgtatcttttcttttttgtcaaaagctacagagctgtataaaatttcctttgtagaatgtgtttctatctatattacctgctttttaattttcttttttaaatatcaatttttatgttatgccatttggcatataaacatgtttagtgatttatatcatataacaaatatctttatttaagctaaatatcaggtacttatggacacaaagatggcaacactagatgctggaggctactagtgggaggagggaggcgagggctaaaacactgctaggtacgatgactcactgccagggccaggggatcattcataccccaaacttcagcattacacgatatactcaggtaacaaacttgcacttgtggctcctgagcctaaaatagaagcggaaaaagaaaaaaaaatgagttgcctttaaacagttctgcaatgggaaattttgggaaacagtgaatcatcatttaaaaaaaactggagaagaaaggcctataatacaatcattttatagtcagacaagttgtctgacaagttgtgtttatgtcatgtaataatgagaggaatgtagtttgaatgacttttatatgtaaagaaaatcactagtacattaaaaagcgaatgcacactttctatatcactggaaataagtgagaaagcataaagtataataaaaatacaaaaaacatatacaggcaaagatatatataataaatggggctaaacttttttaaattaaaaaagtctaaccaaatgctgctaagaagacataaaacaaaaattaaattatatagatagcttaaaaataaacaggtttgcaaatatttatgagacaagtaaccctggtgacaattttaatagcagacaatatagaatttgaagtgaaagatattcattaagccatagaatacaagtttactttgaagaaattgtaattcataagaaagataataaatcactaaacatgtttatatggcaaatgacatagtataaaaattgattaaaaaaagaaaataaaaaagcaggtaatatagacagaaacacattctacaaggtaaattttatacagctctgtagcttttgacaaaaaactgcaatgtagaatgcttaaatatagtaattactaagagcaaacttccaaatacatttcaaacttttactccatgaacagagaacatgctttgccttcaaacatcactacacagtaaatcaaaatatgcaatatgttccatgatgtaaaaagttacataggatatattcctaataaaatgaaatattagaaattgattttaaaatttcagtacattaaaactattaaataattaacgaattcaaaaactctttcatcacctacaaaagaggtaacctgtttagaaatggtgctaaaggggcaaatgagatattaaagtgtctgttctctgttctgactctgagtcacagagaaaattaatgttaaaattatagattagaaattttaaaattagaggactgtacatcaaagttattcaatgcacccaatgttacagtgagaggaaaatttacaactttatgttatttcattattaaacaaaacagcatattcatctattaaatgagtatttaactcaagaagtttagaaaaattaggtaaaaagcatgcaggagaaaatcatcaaagagaactattaaaaataaaatgagaaattatttagtaagtaaacagcaaaacagtaacattggtttaaaacatcaaaggggagtctctttaagaattaaaaaaaaacaaaaaatacatgtaaaatatattcaataaaaaatggaacataaaagtttataaaattaataatcagaatatatataaacagagagagggaacactgaaatatttcagagcatattatacatatttctaccttgataaattttaaaactcaatgaaaatgaatgtttttctaaataaatgaaattataaaatttgcctcattatgaactataagccaaaaatcatggggaaagtatagctccagaacatgggaaatattaaatctcttatcaatcattcatataaaatttgcatgatcttgacaaaatctgacaaaatgagcacaaaaaagaaaattacatatcaacgttacttatatttaatgcaaataagtatcctaaataattacaagcatgctaaattttaacaagcataaaataataaaggagttactcaaaaaaatcaaattaaaaatttaacacaagaaaaggaattaaaatattatattccctcaataggcccaataaaatatatgtaatcatttcaatagatgaattttaaaacctatgaaatgatcaactactatcaattcaaatcttaatatatttattcagaaaacagtaattgaacatctaccatatggaagtttcctttcttggtactggggatacagcagagaccaaaaggacaaaaatctctgttcacatggagttgatatcttagtgggagagtcagataacctgaaaaatgtcagttatgtagtatattagagctcataaatgctccagagagaaacaaagggtgacaggcagatagggaatgctggggatgggagagtgagttgcaattttaaacagaatgattaaggtggctttactggagagatgccattggaacagggactagaaggggcgagggaatggtcatgtggggatttggaggaaaaggactctaggtagagggaacagggccctgagtgggaaatatgccttggaaatatgcttaaggaatagcaggaggtaagtgtgccttgagtggcgtaagggaggaagaatgagaggtggtgaactggttgtataagaccttcaggggcattttaaggacttagggttttgttctcagtgagatggggaaccattggcggtttctagtgatatgatctgacttaggttttttttttttttttttttttttttttttttttgagacggagtctcgctctgtcacccaggctggagtgcagtggcgggatctcggctcactgcaagctccgcctcccgggttcacgccattctcccgcctcagcctcccgagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccctgacttaggttttaaaaggaccccctggctgctgtactgtgaatagatgaaagagtggtaccagttagaaaaatatgcagtgtattaatatagtatattgatacagcatatggatatactttaaataaatatatatacattggagtgtgctcagagttttattacctacagtggtacatgaatgaaaatgcctgcaaacctctgttcacaacagcagaaagccagcagctggctgatagtacttggggaagagcgcagactcctcttgtgtttagttttgaagagctaattagtgataacacctgctagaaacagaacagctgtgatacactaggatttttgacaacactaacagagagagagaaatgtgggtgggacctgagtcctgaactgtgagaggtgctctgtgtaaagatttgaagctgaaatgttggtatatgtataagtcacctgatgtttctttatattcttatgaacctttaaaacaacattgaggcaatcaacatttaatatgtatgaaatttgaaacatggtatcgatatgaaaattgtagtttctattcttatttacacatgcaatttatattcacatagtttaaatgtgctcatttttaaaacaatcagaaaaaaagcaataaagagataatgaatgaaatgtacccattatgtcatactacaaagttagatagctagttaataacattttgtgtgtgtatatatatatacgtatatatacgtatatatacacatatatatatatttgtatccttgtagtcacatatgcagtgttccgataaaaattacataaatcattaatgcatattttgagagtaaactcaattagagtagagcagtttttagaagacatttactttgaaatactttttactctgattctcttgatataggttcaattgacatattctggtggagattaaattggggagacgcataaacacacaaacatttacaaaaatgggaccagatctttatgttgtttacttgttatttagatgcattatcatgattaactacctattttgttaatatttttaaaattaattttgttaaatatacattctcacaaaagtgtttaatatcattgtagtcttccacaatataatactttattggatcgatcttctattttggcagctctgcattgtttagtatttatttcaattttagagagcaccaccctcaccgttctttgtggcacatctttgcacattttcttaattgttttcttattctggttctaatcaaatggaggatacagtttttcagatgtttttatttcacaggaagccataaacttattgtttttatatttaatatatggttttctaacagagtagaatgcaaaatatgcatacagtttaaatatccaaactggaatttcaaagaaatttcaagccattggcaggctactttgagagtggagaggctagtggggggtggggaaaatcagatttacttgtatcatcaaagtttctttggtggataaatttgagaagcatcctctcaaagtagaatttttagaaaaaaatggcatgtattttttatgacttttgatccatattgcaaaattttcctctaaacaggttataccactttatatgtgtaaacactgtttcgatttgttggaaggtagtataatcttccactgaaaaggctatttaaagtatatttttaaaaaatcatgtgcacaaattactactaattgagtttctacatttttctttattctcatgataattatgtcatcatcttgaaatgttgttcatgtaaacaacctctttggaactttagctaatttttaacaaatacaatgttcttaattatctgacttccacaaacagacaagggttaaagtgaatttcaaaatcactccacaagggtgggcagaccagctgtccccaaattttgtaaaaaaaaaaagtatttatagatatccaaatttattttaaaataaaataatcacattctgtatcaattttgatttttaaaaatcctcctagcttgtcagatggttgtcagcccaactacagttagaactaaacattgttctgtgagcacagcaatgagaactcttaagtggacagtattgtgggaaatggttaaataatagtctacaatcaattctgatttggaaaagacatagtataaaacctattatgagatgccaccttttgttattcactggcgtgcctttctcatatcagtataacttcttatgctttatgaataattgatctaatagtccccatagccattgtagaaatattttaaagctgcaaacataatgtaaattcaaacaaattaggtagtctataagctctctgaaagtaggacagtctcatctttgtctctttagtgctcagctcggtattctaccataaaaaagacgatcaatataaagttgtcaaataagtaaaatgaggaatactgcccccaaattaagatataactatttatttatttatttatttatttattagtttgtttgtttgtttgtttgtttagttcaagacggagtcttgctctgtcgcccaggctggagtgcaatgacacgatctctgctcactgcaacctctgcctcctgggctcaagtgattctcctgcctcagcctctggagtagctgggattacaggcatccaccaccacgcttggctaattttcgtacttttagtagagatgtggttttaccatgttggccaggctgttttcaaactcctgatttcaaatgatccgcccgcctcgacctcccaaagtgctgggattacaggcgtgagccaccgtgcctggccaagatataaaatttaaatacccacttctgagatgattttcaaattcactaatttaatcagcattaattgaatgtctcctatgagtaatgtgctggagatacagtggtgaatcaaacattgtccccaacctctgtatccaagacatttgcagcctttgtgcagctaatgagacagacatgctccccaaaccccatctctcctctctaccaagaaagacactctgtctcactagaatcttatcaaattccagctgggacacactagcatagatttatactagaaattaataattacaactaccctacttcttttcttcctccctttctttgctctagcgacactagtcatctttctgaccgtggattctctaaatactttccattcttaggaattttgtctttgctgttccatcgatgtggaatgctctgcttcaggattttctcactcgggatttgggttgaaagccatctccttagagagatcttttctattttctcctccccagtctcaactaaccatcctcactccagtcactttgtgacatatcagactgttttattttcttcatagcaattacaacttttctaaattatgtggtttacgatttccttcatacagaatataaattccatgaaaacaaagactttttatgaaagcaaatttatcttgttcaccgctgtatcccagtaagtaaaagggacattcagatttctttgcaattcttcctttctgtttctccttgccccttccctgatccacaaagaaccattgatctgcttttatttaccttatatcagtttatgcttcctagaagtttatacaaatggaagcatgcactcctttttgcccacttggcccatctttcactcagcataattattttgagattctttgatgtacagtgtgtaacat

SEQ ID NO: 608 - DNA, 20001 bp, Homo sapiens
ataagttaagcctgtggactcagaaatcagtgtcctgggttcaagggcagacttgtgtgatgctaggcaagttattcaaccactgtaagactcagttttcttatctgcaaaatggggacaataacactactttcttcaagggttgtgaggatttaattatatcatgtgtgtgggttgggcacggtggctaatgcctgtaatcccagtgctttggaaggccaaggcagatggcttgaattgagcccaggagttcgagaccagcctgggcaacatgacaaaagcccacatatataaaacatacaaaaattagctgggtgtagtggcgtgtgcctgtagtcccagccatttggaaggctgaggcgggtcgagcacttgagcaaggaggttgagcgagaggttgcagtgagctgtgattgtgcctgtgtactccagcctgggtgacagagggagactctgtctcaaaaaaaaataaaaaaataaaaaataagctacttaacagtgtgtctggcaccccataagctcctagtaagtattgaccgttatcaaaaaacagccactggaagattttggtttctagagcaaaccttctaatatcagcttcttccgtgttcttagtcttctcctctgaagtcaagtacaaagctttgaataactgagagtttgagtgtgttgaatgctggttaaccaagagttgactcccctgcattttgtcatttgtggatgtttatggacagaatttgcaaggggcctggtgggcatcagatggcacttgtcttgagcacattcattctgagggaaggaagtagatgtattaatagtttcccacataatggtcaccaccctcaaaccattaaggcaatccagcttctggaaaatccaggtcagacaataacctaccagaagtagaaggaacttcttccaaaaaaaaaaaaaaaaaaaaaagaaaatctaataggttttatctgagatcatcagggaatatatttttcttggagatgaataaaaaagaagcaactgttccatccacacaaaagtaataaatagtaataaaatctcctgtgaacagccgcttcttagtaacctgaacctggaagatgtgggttcaaagtcacggatagaaagatattagacgcatcacagagaaacacagagaacatggagaacttggttatggatttatggcatgtttatcaggctgaatatttgctttttaagggcctccccaccattctttgcaaagaaaatgtggctttagagaatgtttcaactcagcctcctggagggtggtgggggaaggggataggggaggcagaggggctgttgatctcatgttggaagagcaagtgagcaggtgaacttgcttgagcctcagcccctttgcataggaagttaactcaagagtcgtggtgttaggtcagcatctgagcaagtgtgccttctggaagagaggtcttagagggggttttacctgaagccagctcctgagttccaggctatggagtccttggcacgttggtaatggaaccacttcttccttgactctcacctctccccccacagcctctgatcctgtctgcacctccctgcccttgaatcttactgtctggtaacctctgctctgggctggccatccagtcccctaactgtatgtctcccaggctttctttcagtgggttctctgcctttaccaactgcccatacatggagcgcgttactttgtcccaggtcaaacaattatcattatctcagttctcataataacgtgcaattgagtactcactgtgtgcttattgctaggtatttcacaacaattatctaaaatctttacaaaaacccagagaggtgggtatttgtagctccaatttttaacgtaagattgaagctcagcttgcttacttgatgcttactctcttcatggtgctataacaaaataccttagactgggtactttataaagaacagaaatttaattctcacagttctggagtttggtacgttcaagatcaaggtgccatcagatttgatgtctggtaagggctcactctctgcttccaagatggcaccatgttgttgcatcctcaagtggtggaagggacggaaggaacaaacttgctccctcaagtccttttataaaggcactcatcattcataaaggtggagccctcctggcctaatcactctgaaaggcctcacctcttgagactgttgcgttgggaattaagtttcaatataaattttgaaagagacacaagcattcaaaccgtagcacctgatttgtccaaaattgcatagctagttagtggcagagccagaattatatccaaaacctgctctccaagagctggggtctttgcacaacctcagtagtcttcaactccatgtcatcaagggagttttctcagaataaagtcatatagaaggtaaataaatgcggagctgctgtaccttatcatatgtttacaatgaggcattcattttaagttacctgctagataaaatttattaatcaatttactaattaatatcaattaattaattaattcatttattaatttaattaattccatagaattgagttatttttgagcacataccttcttgttgtaagtgagaccctgggcaactaacttaccctctctgggtttataaaatggggataataaggcctccttggcaggttgtagttgggtttagagaaggtaatggtgtcaagtgcctggtacctgggaggcactgcataaatggtggttattactatgattttacacttaattttagtcaaaatataaagatcatgaggattaatttctaatttaattagtgacctaaaaggatgttggtgtcctttaagccaccagaatccagatgaaacttcagggctctccagccgtgcatgatagagaaggtcccatccacctgggagaatgtgaagggtaccaggacatgtttaagtctgtggagggacgtgcacacctgcttttatgagccagggaccctacccacaggggaatgattctggaatgggatacttacataagtaacatggcttctcagtgctttggaaaattcttcagttccacagccccttctggcagcgctagggggctctgattttgacattaccctgcatagtagatcggtaggtaacgtttattactccttactgtctttcttaatggctgaattcccggaagttagtattcctgcttcaggctgcttttcaagatgtgactttcacttggaacaacttggaacagagccaagagctggactttagggagggacttgggacacgaaatgctgcactagggatgaggctcaggaagagaggaaatagctccattcctttgcagctgccactcaaagagagcaagctgtttcttctttcctctggggtcctcctcttcctgctgccacatgtttccatatggatgtcctacgagagccatggagacctgcagttacccatgagtatttgttagtgttcctagcagatgcataaggaagagagaaggcaagtttgtcaggtggggcctctggttacatgaggcatttcccatgtggaataatggacttggagaaattgtgtatgcctttgggctgagctaggccaagtgacgtcaaggacatttgaatattaattagggcatataaaagctggaagggactcacagtcctaatcattgatttagaatgatagcattttatatctggaatttaggagacactccagggttctgggaagctgtgacttgtcccaacatatatttcttgagtgtattagtgagggcacttggctgcaagtgaaagaaactcaaattagtttaaggaaaaacacaagagcggaggagaggtattggcccatgtgcttgaaaagcccaggggtggatcttgggctgtgggcatggctggatgtcccgagccttggtctctttctttccattttagatccttgctcacttctgcactgggttcaacaccaggggacttttctgaatggtgacaaagatggccactggtatgtctctgttttcactattctcagaactggtgatcctagaaaaaaagagtatcaaaattccagcccagctacgaggaatgacatgactgacctggcttgggccacaggcctgtttcttgaaacaattgcttcatccagaattctgattggcaccgtctctgaaaccatagcttggttggagaatctgggatgtccttgctttctctacagtgacagaatttttgccacagttgccagtggtaggtggaataatcccctgccaccccacccaaaaatgttcacatcctaattcccagaacctaggcatctgttatgtttcatggaaagcgtggggagggagaattgaggttgcaggttgaattaaggatgctaataaactgttcttaatgagattagcctggattatgcaggtgtgccttgtgtaatcacagggcccttaaatggggaagagtgaggcagacaagaggcagaaccagagagagggacttgggaaaaagactcactcagccattgctggctttgaagatggaaggggaccaagacttaagaagggcagaccactagaagctggaagaggcatgacaatagattctcccctacagcctccagaaggaaccagccctattgacaccttgattttagcccagggagacccactttagacttcaggcctctggaactgtaagataatagatttgtgttgtttcaagctgctaagtttgtggtgatttgctatgcagcaataggaaactaatatactgtcccaaataaaaaggacactgctccgctttcctgcatccaggtgtggccacgactaagttctgggcataggaggaacagttgtgtggcagcttctggcaatgttagaccacctccctcccttcatctctctttcccactgctgcctagacaagcatgctaactggatcacaaggatgaggccataccctgaagagaatggaggcgtgagctggaaggagcaaagccacaagaccagccttggggttcccaccgccacaccttcacttgggcaagaaataaacttctatcttgttcaagccgcctttttttttttttttttgagatagattttcactcttgcccaggctggagtgcagtggcacaatctcggctcactgcaacctccgcctcccaggttcaaaccattttcctgcttcaacctcccgagtagctgggcttacagccgtgcgccaccaaacccagctaatttttgtatttttagtagagatggggtttcaccatattggccaggctgctcttgaactcctgacctcaagtgatccacccaccttggcctcccaaagtcctgggattataggtgcgagccactgcgccagccatgccagttattttaagtgttttcaaaactcacagctggagccaaccctaagtactgtagaaagaaatggccttaactgtgacatttaaggagacccaacagacccagtgtctccaaacacaagctaggagcatcctgaggatctcccggcggtggttcaggagctgtcgactcagtccttggctccccttggtgtctttcccattggatgctgcagtcttggcgtccctgccctcgtctctgtcttgcctcttgctgttgctgctggtgtttattcttaggcaaccctcaccatccctgaatcagcctggctctctggactctgtgcggctttggtgagtatctggtgagccagctctggtcctatggaatgtactcccaccctagttggcctgcccccacaccccactcagagaaagctaaataaaaatacaagatgtaattagcatggaagaccttgtcttaggtctctgggtgtgacttcacgggaaatgcattggttataatagctaacatatactgaatgcttaccatgggacagaaaattaagtgagtttttttttttaactttattttatcatcagagcaacagtaggaggtaagcactagcgttatctccctttacaggtaagaaaactgaagctgtgctagtagggaaattaaataattatctgagatcactcatctgttaagtggcagaggcagtgtataaaccaggcagtctgattctggagcccatgctgtgatagatcagtgtgctacctctcaagcccggtgactttcatcttctgagtagcacctcatgtaataaaatgtttagacaatcatgacaatggcttggagcaccaggcagggctgccatgtctggttgggtggactgtgcactgcacaactcaggaggtgccatccgcattgtcatatgccaattgtaaccccttcagttgtgcagaggacaatccacacaaccacatatggccactctgaggccttggggcttgcacaagccgatagcaggaggtcacagggaaacgccaggaactcagttgaggagctattaaaaacttcttgggtgttggtgttgaaaattaggaatcagggaagtaagccaaggtaatgggagacaggaacacggaggactcttgctggggcatcctgacaaaatgctggatggtctcttccacactcagacctacactagatgacttttacaaaggggggaggggaggggctagttttgtttttgcatcataaaaataagacacgcttattaaaggccatttaggaaatgtagaaacatttaagtagcttaatattttaaataataaaatattagcagttgtttgtcctgtaacccaaagaaaaccactgttaatattttattgtattggctgtatcttctctagggtttctctctctttctattcatatttacatcgatatctatacatagagtgagagctctctcaagggggagagatcaatatattatttgtacatggttgatcctgctagaaatatgaatattatttgtacaattttcacctggccttctagaaacagttcagatgggactgtgctcagttttgcttgtccgggaacctcttaaaggctctacttggctgctggcacaggctatggagggggtttggagaactagtaggccataggatggagaggctctagtaggtttgaagcggagaagcaggagcaatccttgggttggagaatccagcccagtccaacatagggtcctggtggtgaggggctcactgaatcccagaggccagtggaaagtcttgagcctgctcgtacaccaggggggttggtggcctccctgatgatgaagtcttcctcctaaaagagaccttctggggatgtagttcagcctcctccctcctcttcattaccttcctagcccaccttaacagcacaaacacattttctagctgaggaaactatgccctagggaggtaagttgaccgacttgaggtcatacagagagtcagtgtcatactgggaccagaactcggggctcctgacttctttccaagcctgcaaatgtgtgctgttgaagaccagtcttcctcctgaaagagtccttcggggtcccttgctctcgactgaagaacatgctggaataaagaaccacattccacattgctctggaataaagaaccatgtgctctgtaataaaaaacattccatggtcaaagcaatgtgggaagcctgcacattgcaaatcctctcttggaggttcataagcaatttagcttactaaagtctcagagaaggcctgcagcaaagaaacctgtttaacttggttcaattcattgtttcttgaacttatgtgggaagtttccattgttcatgtagttatgccttgaagaacatatgttgggaaagagaggctgtgttacgccacactgcctgtccactgaggccagaaaggatacctgaggacacaggaaatgtcacactgggtgagagtaccatccttccagcctaggaatttgctctctgatagggccaccaagaaaagtgttgcaatagcatgtggctgccctttgctgaagccaagcttagagggcagagatgtttttttgtttttttgtttttgtttgagaggcagtctcactctgtcactcaggctggagtgcagtggtgcgatcttggctcactgcaacctccacctcctgggttcaagcgattctcctgcctcagcctcctgatagctgggattacaggtgtgcgctcccatgcctggctaatttttgtatttttagtagagatgggattttgccatattggccagggtggtctcaaactcctgacctcaggtgatccgcccgcctcggcctcccaaagtgcagagattgcaggtgtgagccaccgtgcccggcctgagacaggattttcttagcggcctaatagctttaaatgatactgtgtctccaaggggatttaaactgaaaattccaagtagcttacattaagtaagtgccatgtgagcactttcttgcctgtcgtgttcatctctgtatcctcaatgccttgaacagtgactggtacacagtagatactcaataaagacttgctgaataaatggaatgaaatttccagttacttttggaggctacatagagttccaaaataactttcctctgcatgacataaaaactttaactttcctcttccaggctgtgagatttgcaactcactatttagatttaacaaatgcttatgcaatacttaatgcatagaaaccctatgctgggtatattctcatgtaaaaaatcccttaattaatattgtcagtgaccctgtaaagtacaatggcaaaaatggctattacttttgcatcagcctaacataatctcaattttccaggtgaggaggctgaggtttggaggtgttagttgacttagccaaggtggtgttcttaagtgttgaagtgagatttatgagcccatagccacagccaggagcagcttatttatggagcttccctggaatgataaaagtagacttaagataaatcaacaagaggcaggtcccagatgaagtctcctccaggttataaagaaaggcacttcctcttctgaaaagttgtctgcagcaaagactggttattatgactctcctgggcaccaaatagggactctaggccacctgttaagtgtctttgtggaaaattattctgcttaaagcacaataactctgagaattgagaaacatgaatagttcccagctgatggaacagctgaagcactaagcctccccaagccttggttacagcaacacaataccataacacaacagcatgacttcaaatttccccatccactcagtaggttgatagttctttttccacccaacacattgaatgcccaggtattgatcttactagtgctagagtaactttttcatttttaagaattaaaaaaagacagccattgtaacacctggttgcctcctgaaaacagtgtctatgcctctgagccagcacaaagtgctgttaattacactttgttcaagagagagtgtctggctggatgggaagattatgtttcaatatatttgtaggatgtttgagctgggaggagccctgagatcaacttgcctctcattttacagaatagaaaactgaggctcctaggccacccaaggtcatgctcttgattcttggggcagttttttaaaaaccgtgctatctgaaatataatcttggcttcatcaactcatactgtgtgattttaagcaagtacttaacctctctgttctttaatcatatgtcaaatgcaagcaataagagttacctacttcatggagttggagtaaggagtacatgagattttgcctgtaaagtgcatttccaagtgccagacacaaaaaattgctcagtaaattagaattttaaaatccttaccaatattgtcattctcccccccttttttccccctctacaactgcataatctccctacttgggggaatgagctctgggaaggaaggggctctctctgtttttctgccccttgcaacttggagatcaaggaagagcacattagtggtgtttatagtaggagtttccctgcatgctagtttccatgtctgcaggacatacagtgttctgtgagatcctgaatgcgttccccaaaagtttgtgttgaaaactcaattgccaggcataagaatgatacaatggactttgggggcttgggaggaagagtgggaggggagcgagggataaaagactacagatatggtgcagtgtatactgcttgggtgatgggtgcaccaaaatctcacaaatcaccaccaaggaacttactcatgtaaccaaacacaacctgtaccccaataacttatggaaaaataaaatatttaggtactccaaaaaaaaaaaaaaagaaaacctaattgtcattgtaatagtagtaagaggtaattaggctatggggactttgccctcataaatggatttaatgccattataatcggagtgggttagttatctctggaatgggcccctgataaaaaggatgaattcagccccatttttctctttgtctcgtgcacttgcttgccatgtggtgccttctgccgtagcatgacccttgcctgatgctggcaccgtttctgggccttcccagcctccagcactgtaagccatataaacttctattctttagaaattacccagtctgtggcattttgttacaacagcagaaaacgaactaagacactgggcttttcctgagtctgagaaaagtagctaaatccactcacattaaggtgacagtgataacgttttattcctctcaggagtaaaacattactcctgagaggaatgcctaggagacgatatttaatgcaaagtaattcatttccaagggcggtggggagggctgtcaggtaacaatgccagggagatgggagacagaatttggatcttggggctgggtcttcctggtgccccaacagtaaacctacagaagatgattatctgcttggcccaggcccagggctccccttgccggccgctggggttgtgatgtgctctcacagggaggactttctgccggggaatccaggcctgaaagagctgcttcttggtggtgggaaggaggaatcaaagcccctggggtgtgggctgcactatacgggcctggacaggcaggtcgaatactgtgaagctttattgtttctgagactctacctgggctcagggttcaaaatcaaaagcttcccgcaggtaagattagctaagtgaaaaccactgcactttctctaaagtagaatggcttaaaaaccaaagcagagggcgcggtgcctcacggctgtaatcccagcactttgggaggccaaggtgagtggatcacctaaggtcaggagtttgagaccagcctggccaacatggtaaaaccccttctttacgaaaaatacaaaaattacccaggtgtggcggtgggcacgtgtaatcccagctacttgggaggctgaggcaggagaattgcttgaacccgggaggcggaggttgcaatgagccgagatcacaccagtgcactccagcctgggtgacagagagagactccgtctcaaaaacaaacaaaacaaaaaaaaaatcaatgcagagaaaaatatcaccataagcaccattggcaagatagtccatttaaatagcgcaaatgggttttaattttatgtcaatgtgctaacaattcaacattgaaataattttttttttgtataagacaattatctgtgcaagacagaaacgcaggagtgcccttttgtctttctcctctttgccccctattttgaatccagcattgagtcgtgctgtgcttctagatagctctggaagctctccacttctcttcccagcagtcccactgcctccatcattgctataccggatattgcagcggcctcctccatgtcctctctgggcccctcagtatcaatccagtatttattgcagtatctccaagaatttgcacacaatatgatccattggcatgcaggcagaagccattagtattttgatttttatttatgttaaaattaagaaagcaagctttcctgacattcaatgactggcttgactgtggctccttgcccaattcttctgtcagccagtctaaagtcatgtttggttcaagaggtatctggggactccagaacaagagtgtgttttcagggagcccgcgtggttttgttcgctcttgttgtgttgcaatgaactgcagtttgtatcttctccaggagaatgctgttcgtggattacattaagtacttccaattaaacgaacttccaaaaacatagacaagcaacctaaaaggattcctgcatcctttttgaagattaaagatacaattatgcactgtataataatgctttagtcaatgatggaccgcatttatgaccgtgacagtgacagtgtcccataaaactggctcatgtctgtaatcccagcactttgggaggccgaggtgggcagatcacctgaggtcaggagttcgagactagcctggccaaaatggcgaaaccctgtctctactaaaaatataaaagttagcagggtgtggtggcatgtgcctgtagtcccatctactcaggaggctgaggtaagagaattgcttgaaccagggaggcaggggttgcagtgagctgagattgtgccactgcactccagtctgggcaacagagtgggactctgtctcagaaaaaaaaaaaaaaaagccaaaaagcaaaaaaaaaaaaaaaaaaactataacggagctcaaaaattcctatcacctgatgaagtcattgctgttgtaatgtagtagtgcaacacattaccttttctgtgtttagatacatgaataccattgtgttgcaattgcttacagtgttcagcacagtagcctgctgtacaggttgtagcctaggagtaatacgttataccatatagcctaggtgtgcagtaggctagaatatctaggtgtatgtgagtatactctatgatgttcgatgacaaaatggccaaatgacacatttctcagaatgttaagcgtgactgtaatactacaggcaaggaaagggcaacaataagctaatcaaaaatacgggatgaaatgtggacaaatatctactattgttcattagcaacaactcttaccctaagtatatattgtccttggtgatattaactaatgataacatgcagtcataattttcaagacttaaatcatttcactagggaaatattcaaacacacataaaatagaaaatataatcacgaggctgggcatggtggctcatgcctgtaatcctaacactttaagaggtcgaagtgggaggattgcttggggccaagcatacaagaccagcctaggaaacatagcaagactctttctctacaaaaataaataaataaatagtaaataaaattagctgggtgtgatggcatgtgactgcagtcccagctgctcaggagactgaggtgggaggatcatttgagcccaagagatcaatgcagtgagttatatagtccagtctgggtgaaaccactgcactccagcctgggtgaaagaacaagatcctgtctcaaaaaaagtaattaattaaaaaaagaagatataattatgaccctcatgtgcctatcactcaacttcaacaattatcaacacattgtcaagacttcaaaaactattttttgttagctccctttaaaaaaatttctatatttgtatgttttataatgtacataaactataccatatgtgtgtgtgtgtgtgtgtgtgtgtgtgtatatgtgtatatatatatatatatacatacatttacataaaccaaaggtgtgtactcaaaacttcatcacttgtgagggtgtgtagtcaaatggttagagaagtctgctccatgctgccgtcaggagacatttccagtgtgcaaatttgatcacgttgctctgtcttgcatatcactcagtggcttcccattgcttctaagaaagttctgcaaggactcacctaagtctcttgcctcactccccaccttgctttctttgctctggccccaatgccagtttgcagggcaatatgtgccaaatgcacatattggcgcacgtttcctcttgcccagggtctctgcacattcttccttctctgctttccttctcaatgacagtttcacttccttagggaatcctttgattccctctagtccagatctggtctcctgaatgtgagccattcttatggaactgagttattttccttcattacatttgtctcagtctgtcacaatagattcattttagtgatggctaatgtctcttcctctaatctccaagaagatgctacacatgaccttttctacctatccccagtgtctaatgatgtggccagcacatagtaggcattcaacaaattatggattaaatgaaagcttgtcattgttcaaggttaaaaaagtgtaaaggtcacatgtaatccctgtgaaccagttggtggatgaatcatcattgcataagttcaacactggaagagataaagaacaatacaagacaacaattcaagttcacgggcggtgtgtggttaattgccaaacaggcacagtggatgtcaaatgcactaggttcaaagagagaacactgtggggtgggctgggctgatttcagatggtattatcctttgaaatataaaagccacatgtgaacaaacacatattgatgtcctggaatctgaacttcttgcttgtaatacggaaagcatgatttaattttgatttacaagaggctctaatttgaccctgaagtcatcatgataatgtcatcttcccagctcattcccacgtgaatgaaatctgctgttttatcaggctctgcatccaccaagccttgaagatggggctgtggtttatcagcaataacatctttccttaggtcttgcaaaagtccctccaagtctgactcttgactgagctttcatattttttttgcggttttgtaataaagagatttgtttttatatgatctggtagagaaccaactcttggtattaatttagaaggttgcaggctgatttgtgaagctcggcctgacattcatatgatctgagcttcttttttcccaacagaagccctgtttacattggttttagtttcaacatacacttgtttatttttttttactggtttctaacttgtctccattctctagaatgtaagcttcatgaaagcaaggaccttaactgctgtgtccccattgtaacctcagcacctatgaaagggcctgacacagcaggtactcaatacatatttgttgaatgaatggctgactgtagggagaaggtctgaaggagagtggagtttatggttgcttttgaaagcacataggccagaagtctctgacttgctatttcaaaatctctcatgcttgtaacttgagggcaggggacatttttctccccatctttttatttccctacattgtttggcaccagatgcttgttcatagtaaatgctgagaggacatcaactaaagaaatcaaagagaattctggatcgtcctttggccatggcaatggagaaggaagagcaggtgggagaggactggttttaaaatgagcagacctagagtgaagtcccagttctcactcacagaacaacgttggcaaatcgctggacttctcaacctcagtgtattcatctgtataattggcatatcaacagcagaaggccttgtcccagggccactgcaaggactttatgctctttctgggaagcactctgtaaacagtgaaatgtctagaaatgagagtcgtggactttggccaaagcaatcgggaaaggctggggattcccatagggtggttggcgatgttcttggccttcagacggacattggactcagtcataggctgaaactgctgggtccagatttgcaggtcttttcctccataagctcctcttgtcaccaccttcctttgtcccctccctcccccacctccagtctccctttatgctggctcatcaggcctgtctgaattgccagatgaaatgcaactccatagcctgagttatctagaattacattccaaaaacatctctgcgtttcctcaggggaggaaggaaaacagagaccagggcataagagggcatagagtaccctctagccacattctaccttttcctttgtacaatttggcctatggtttcctaaagaatttcccccaacgattgccagccctgtagatggaatcaggagtctcctattgggtatgatctgaggggagttggacgaccctcccctaatctctcctattggcctgaaattctcagactacctgaacttttggttttgaagccaatatgtttccattgaaggtcacaattagccattatcatctgagcttcaattcaggttatctggaactccctgggcctgaaacacaaaagtggtaacttttgatagaaaagacagtagcagatgtggtggctcacgcctgaaatcccagcactttgggaggctgaggtgggcacatcacttgagactaggagttcaagaccagcctggccaacatggcaaaaccctgtctctactaaaaataaaaaaaattagccaggcatggtggcatgtgcctgtaatctcagcatcccagttactcaggaaaccaaggcacgagaatcgcttgaatcccagaggcaggggttgcagtgagccgagatcatgctagtgcactccagcccgggggacaaagtgagaatctatctcaaaaaaaaaaaaaaaaaaagaaaaagaaaagacagaatcaagacagtactgatcatgaagactataccttcagggatcgtttctatagctcgttacttgaaaagtttctctgaacatgtagatcactggcagaaactggaccccttccttacaccttatacaaaaattggctcaagatggattgaagacttgaatgtaaaaccccaaaccataaaaactctagaagaaaacctaggcaataccattcagtacataggcataggcaaagacttcatgactaaaacagcaaaaacaattgcaacaaaagcaaaaattgacaaatgggatctaatcaaactaaagagcttctgcacagcaatagaaactatcatcagagtgaacaggcaacctacagaatgggagaaaacttttgtaagctacccatctgacaaaggtctaatatccagaatctacaaggaacttaaaccaatttacaagaaaaaaacaaccccatcaaaaagtgggcaaaggatatgaactaacacttctcaaaagaaaacatttatgcagccaacaaacatgtgaaaacaagctcatcatcactggtcattagagaaatgcaaaccaaaaccacaattagataccatctcaatgccagttagaatggcaattattaaaatgtcaggaaacaacagatgctggcgaggctctggagaaataggaacatttttacactgttggtgggagtgtaaattagttcaaccattgtggaagacagagtggcagttccttgagaacctagaaccagaaataccacttgacccagcaatcccattactgggtatatgcccaggattataaatcattctactataaagacacatgcacacatatgtttattgcagcactatttacaatagcaaagacttggaatcaacccaaatgcccatcaatgatagactggataaagaaaatatggcacatatacaccatggaataccatgcagccataaaaaaggatgagttcatctcctttgcagggacatggatgaagccggaagacatcattctcagcaaactaacacgggaaaagaaaaccaaacactgcatgttctcactcagaagtgggagttgaacaatgagaacacatggaaacagggaggggaaacatcacacaccagggcctgtcaggggcatgaggggcaaagggagggagagcattaggacaaatacctaatgcatttggggcttaaaacctagatgacgagttgataggtgcagcaaaccaccatggcgcgtgtatacttatgtaacaaacctgcacattctgcacatgtatcccagagcttaaagtaaaattaaaaaaaaaaaaaggacatcatggaaggagatccagggtagctgagggtataagggacctcaagaactgagccaagggggaggatagaaacattgagctaggggagtgggagacaggagaggaggtacttataaactgactgcatcccagatctgcctagagtgactctggtctgccttttcaattttaagcctcaatgaactggttcattattaattaattgttattaattagcattagtggaagtatagtaacttttatttaaattttaaggtactctttattttttcaaaataaaatagtcctgttgatttgtcaggttctcataataatgtcattataattttatctactttcattataagacaatccagaggagactgtgatctcccagataaatagcctctgggctctgcctcatgttccctccccatgcgtgcagtcctgcccctgccctgttctttccttgggcttttcctctccctggactgctttcactctccagctgtacctgttggaatccttcagagctgagcccactctttatcagcccgggaaaattctcatgatttctgtgccacgtcctgaggtcctgagcagcacttactcatttgctttctcatgcaccctcatgtctgtcccgtggcacagagttaagggtaaactgtgtttttgttttgttttgttttgttttttttgagatagagtctgtctttgttgcctaggctggagtgcagtggcacaatctctcactgcaacttctgcctcccgggttcaagtgattctcctgcctcagcctcctgagtagctggaattataggcgtgcgccaacatacgctgctaatttttgtatttttagtagagatggggtttcaccatgttggccaggctggtcttgaactcctgacctcaggtgatctgcccatcttcgcctcccaaagtggtgggattacaggtatgagccaccatgcttgcttttttactccactcccaaccctctcctcctggatgagtgagatgcaagagaaactctcttccttatcattgtagaccccaattggtgcttaataatatctgtttcattaagttgtaggcaggggtgcataatggatttctatagtcactccagatgcctcagaaagaaaatacccacctccctgactgatgcctgaaacccccctcatcatctgtctaaggttttcattcatttcaaaggtgatgcttgccagaagtactataaggttgcagtctcctgggaatgtctgaattctaggtcaaacatcctaaccacagaaatccaaagtgttccatattgaaatagatgctatttacctaaaattacacattgtgttccatattccatacactacacgaagaggtcacatgatgtagtaaccaatcaagcttgggctctgaccagtttgcctgggttctgatttgaactgatttatttcctgattaaatggatgaatattcattaaatgtgtggagctgtactgggcatgtggttagtgctcagcaaggatggttgttattgtcagattattattgctcttatccatctaatctgaatacgactctatccctttgggcagccgcttctcttgctgtatacccactatgggaccaaattcagcactttactgtattcctccttaaatcaaattgaatgccaaaagttttcatgagaaatgcagactttactgaagatttcttaaggaaatctggagtagcagatttaacacggtgtcacacagcaaaactgacccaaaaaatcccttttaaggcatctctgttctttccccaaagttcctctgtcaacattagcaacctcatcactcctccctccccaaatattctcccaccccttttggtagtttctccagaaatccagacatatcttctctgggattcaccctccttggaaggtagggagaatagagtacaaataatcatttcccctctcacatttagaatgttaattaacagaaagtgctatttattatatatgtcaaaaa

SEQ ID NO: 609 - DNA, 20001 bp, Homo sapiens
agatcttgggtgaggaaaagttactagaagagctctgtctatcaaaatggagtgacccaccagtctttgaaaagagcagtactgggattcgccatgcagaatgtaaggttagctgagagaaaagacgagagagagacccaaggtcaggcaaggatgtttattaacctgccaggctgctccactacagtcagaggaggcagccctgagcttacaaaatgaggggtttatattggggaaagagaccctggggttgtttttcggttaactttaccacatagcatctcgtgaccggcttacaatatattatcttgtgaaaataggaatttacaagagggtgttacttaggtttatccacgtttctcgtgacctcccccgtgccagccggagggctgtaagcaagtctggtgaccttgctggagcacctagataagggttcaggaatgcagctgcagagtattcagcgtaggggtcagctgcactgagaggcaggggcaggtcctggggtagcttgtccctaacacagaagagatggacctgctgttggaaaactactacctattggctgacgatctcttcaatacagtttgggagcttagggtactgactgatgattcacgaagtatcattttcatcaatctggacagccaccgtaatgtgatgatgaggttgaatctactgctgaccatgggaatcttctctctttcactctttggactaatgggaattgcttttggaatgattttggaatcctccttgaagaggaccctagagtgttttggctgattacaggaattatgttcatgggaagtagcctcatctggaggcgcctgctttcattccttggacgacagccggaagctccgttgcctcctatgatggcctctttactgaaaaagatccttctggcagatagaagcatggaattgaaaaacagcctcagactagatggacctggatcaggctgaagcatcctcacaaaccattaggaacaaccccatggatactgacgttttgtcatggtagtcacaggaaacttctgatactcttttattattttcttggttagagtcagacacttgaaaaaaattaatgtccgatgacaaaaatattttggcaatcacaatactagaatgtgattgcatttccagaattctgagttaaagaaacagagtgtttgttttgtaaaaggccaaaattctatttcctacaaactttaaatgctgtttctataggcataaggggtggcaagacaagaacgacagttgtatacattttatttaatttatatatatcaagaaaagtgcaattttgtgctggatgaagcctaggaacttgacaaagccatagacagccatagttctttgtcagtataggaaattaagttcatgtgaatttcctgattctcaggtaactaaaaagctagcattccatgtattaaccttaaaacaaactctagaagtttgtggtttaaaaactaaactttgacataaccttattttcttgtatttgcacccctttttaatataaggtgaataaaaagcaaagataatttaaaaaaagaaaatgagcagaagacatgagcaaagctttcactgcagaagatgtacagatggtaaatatgcacataaaagatgtttaacatcattacattaggagaatacaatttaaaaccaaaaaaagagatatcctgggtatactgtactacatacagtttggcaacatgttaccactgggagaaaatgagtaaaaggtacacaggttttatctgcaccattacttacaattatacatggatctataattgtctggaaataaatagtatctttttaataaattaagtaaataaataatgccacagtcctgctccaaatttccaagtttttcccatcacacttggaataaatcccaagtactgatcatgtcttacaagtccaacaggctgtggcctctgcctctaatttcatctcagatgactctcctccacacttactcctttctcagcacactggctttcttgtgatttcttgaatttccaagcttattcctacctgatcagggcctttgaattttaagtttcttctactgggaaccctcttttcccaggtctttgcatggttctccttcatcactctggtctttgtatatttgtatattgcctgcctctctaagtggaccgtaggctcaatgtgggcggggtctttgcctacacggttcaccattgcacccgtcatgcgtggagtgtggtatgtgctcaataaatcttgttgaatgaatgaatgaatgaatattaaaatggcaggttgacttgggtcagtgtttgctttaccacattactctgtgctgagccttccttatgctccttacaaaacagatgtgcttaggcatggggaaatagtttcagaaatagtaagatctaggtttgagtcgcactcttaacactcttctgctcattgtccatttgaccaaatcacatcaactttttgagctctattttctcatctgaaatatgagttgccctaaggagcctggggatattaagatatcaatatctctcccctagacctgctcctcctcctggttattcccatttcaactcatggtgcctccatccacccccacacccaagccaagaacctggatgaatcagcctcagtgctttccttcttcattcaccccacacccaagcaattgccaagtcttgacaagtctactcctaaatctttttcatatatctcttccatatctctctgtcttccctgctcatcatctcttgcctaaccattgcaatatcctccttaattggtctttcccattcatcatccataatgctgatgaaataatctattatgcaaatttgattatgtcagtgccttgcctaaaacccttaaatcgttctgcaatggattccagatatagagcaaattccttcccttggcactgatctggctcctacccatctcttaatccctttattcactcctccctaacacttctcataagctgaacaagccatatgctggagcaagctgtcctcagccacaccccctgactttgcacatgttgttccatctgtctggatggcctccctcactgcctggcacctctaagacttccagagtccagcttagcatcacctggtgggcatccctgacttgccagtctgttcggtgcttctctctgtacttccatgataactcaggtccaagtctatcacagcacacagtagagcttagcacatagtaggcacttagacagttagcaaatcaatgatttgggccagacattagtaagagtattaaacctacaaatccttgtacatgctgcaatgagctatgaagggatgggcttttttttcttcttttctcttgcgctaaatgaagatgtctagttgtaatattctgctgataacctggcttcagccctgcccaggggcaaaaaaataaaatggacaagatgatcttggaaatcacccatcttcaaagttcttccagctcagtgtgtgatcttggctaacaaatgaagtctgaactcaaagagatgtgggtttgaatcccagctctgccacctagtagctgaatgaccttgagccttaagctctgtcaggaatataatggacctccacaaagggttgtcatgaggattcaatgaaatcatgcaggaaaggcacttagaatggtgcctggcattcatagtaagcgttcagtaagtatttatatatctccatctagtggtcttggcacaagaaaggaaggcaaaagaagaaaagaataaataaataacaggaaccaagaggcactccagattcgaggatagacagggaggggtggtgagctgagcctgactggaaaagctgtagctccttcaatgtagggcaaataaagtggacatagaaaggcagaaagggagcttgtggggagtgggcattgctgtttatagacaactagggcagctaaggtttagggacctgtgtgtatattctcagcctgcgaggcctgtgtataggcctaatgtagcctggcattttccagagttagagaaagtagaggcctaggtgtccctgccagcccttggtgttccagcctgaaggcgattttggggccttcattctgccaatgtattacaagcacctagtcaatgccaagtatgggctgtgccaaagggtgagccccagggtgagggctgcaactgaaatctctaatgaccaatctggttggtgttcagcaaagagcactaactttggagtccaagtggcctgggttacactctggctgagctcagtaccaactgtgtggcactggctgcttcatttagcttttctaatcttcaattttctcacctgtaaaatggaaataaactactaacctcaaaaaaattgtagagtactaattgagataagggagaaaattgcttagtacaaagtaggcagtctgactcgcagtaagggcccttttatccaacttgctcagttttcctttattgttatcacttctgggctagcattttatataatttacttgtttgctttatctcctgtttccgtcactaaaacttacacatcatgggtgcagggactctgtctaatgtcttgtttgctgctgaattctcagcacacagcactaactggtggtgttgaataaacaacaacaacaacaacaacaattctatttcatctctttcactagaatgtaaactccatgacaacaggattgcatcatttatctcttgctgcattacaactcaccccaaaacttagtggttctaaacaatggtcaaggcatctgtagatcaggagtttaggagcgggtcagttgggcagttctggctcagggtctctttgaggttgcacctcagatgctagcttgggctatagtcccctgaaggcttggcagatcctggaggatccaatttcaaggtggctcactcacatggctgactggtgctgcccaagggggcctttctactgaccctttgatggagctctacggactgctgtcctgatatggcagctggcactccttagagcaagcaatccaaaacaccgtgaagaaagctgaaactgccttgatgatctagtcttacgccacatggcaaaagtcatatatcgtcactccctccacatttgattggttactcaggctgatcctgattcagtaggaggaaaccatataagggcatgaataccaggaggcaaatattgctgggagccatttggaggttgggccacccaaggacagtttaccagtgtaacacaatgacagtgcctggcatgtggttggcattcaaaaagtatttgttgaaggcatgaattcaagtgctggggactgggtttcacatagtaagagacttgggctctgcctccaaggaaccagcattcgagtggaagagacaaatgcacaaagaggcatttatcattctgtgtcctgtagcagaacatggcctaaaaatccagatcagggaagagtgacatgtgggttgagttttgaagggtgagttaagtaagccaggtgaggaatgacaggaagggggttctgaaaaagagggaatggcacatgcaaagtttcaaggaaagagaaggggccatgagcttgtgagcgggggcggtggtgagaaggagatgacaacaggtagcatccgacgcctgtttagtttcccttttatataagtcagactttcatgagtgcctttagtatagtaattgttaaaatgatgaaacaagaattgaaagcaaatgctgagatgatgcgccactgagatttattttctcacaattgtttctgttcaacaagcatggagcacctaccagggccaggctcttgctaagtgcttggggatgcaaagatcaataacatatacaacctttcctcctgagcagctagggatatgagggggcagggaatgggctgaccacaagttatgatgatacaaatcacagtcataatgtaagtacctggagaaaggcacgtggccagaacccagagggccaaaagagggcactgtcgcaaccattcggacgaagaaccagctatgtatttgggcataagaaaatcaaagagaccaacttgatctgttgtcaataaagatacaattctttgcacaattcccttcccgcatgcccttatgacctactgtgaggggggtcctgccctatgaacctggaagcccaggtggagatgacctgggtgggagtgggagtggggatgtggcaggggtgcttcaaggtggtctgaacaccactccagcctgccgtcctccttcagcggtgtcaggcatgaggcctctctgagtccatgggttggaaggatgtgggagagaaaacagggagagaaggggagcagacagtaagcatcctgagcctcaccccgagatggctgggccttcaattatgatttaatattagtgctccttggtgtagcttctcctgcatccttattcctaaggaaatgaaagtacttcccaggcattctcccctggcacccatcaccaagtgagccgagtggaggagcaagtcatgctccattttcaaaggaaggaggaggaagccgggggacatggccaacttgcttacacagtgaattaaggagggaggcagggcagcagaccaccaaggatggtggggagaggcctctggtgatggactggaagctgagccccagaggagcagcctgagaagggtgcatgagggctgcactcctgctctgcaaggctgcaaggcattcgtgaagagccactggaatctgatactttccactgcatggtggaccagccctagtctcaccagacccctctgggaatatgaggaactgagaacccaaaggacagcagatggctcttccatttttcctgcgctctctgttgtcccagagaggctgctccccaggctctgagggcctctgttctccaagccatgctacaatccaacaacatcagtcagccaccaacacactcttttcttcactaagggacattaacgtcacacccaattattatcatccacaccactgagaaggagaaaccctttccaggtggcatgaagaaataaggccacagccacccacagagcactagcacaccaagaagaatcagatctggtccccaccctcacccacagtgacaaactaggtcataacgtggagtcccggccacagaaaagcctaaggaaggaagaggtcagtactccaaggggtggaggtgggaggcagtcagaaaaggcttcatggaagatgcaccttttcagctgaacctcgggagactgtctgccagacggactgcatggggaaggcttcttgggcaaagaaacaacttgaacaaagatacccacaggacatgggcatcctgaggctccacaaggctcaagcctagggggtcagggtggagcgcagagaggcagagcctgagtcacaaaggaccctgtaaccaaactaaaggtgtgcatttttccccaaaagtcaagatttgggggtcattgaagagtaacatttgagcgggcattcccttttaacagctatgggatcccagtcaagatatttaacctctctgggcctcagtttccatatctgtgaaatgggaatagtgagaatatctttttatagggtgcttagggagcttttaaaagatattatgtacatgtaaagaattcagcatagtgactaacatatagtaaatgctccacaagtcacagccgtaataacaaaaataaatcattaacattggtacattttagaaagctcactctagtttctaggtggagagtaaagaagagaacaagaataagcccagagggactgcgtaggaggctattgctccagtccaggtgtcaagtgatcatggtctcacagaggccctccctggagaggactgcatcaggagacactgagagcagagaaccacctggaatgtgtggctcttgggaagtgggagtggtgagggagagggagaaatgtgaatttgcctgctagtcactgaaatcagagtgacagcttgggagaccagaaaggggaatgatacagtggttattgacatgacaagttggagaatgtcaactgtccaggaggaagcagtgagatgtacatggctggagaagttggtcgggagtagaactgagaggcagcagcacagagctggcagcaaaagccatcagagaggacgagatggctcagggacggtgtgtagccttgaagacaggaagaatagaactgatatagtttggctgtgtctccacccaaatctcatcttgaattgtagctcccacaattctcatgtgttgagagagggacccagtgggaggtaattgaatcatggggctgggtctttcctgtgctattcttgtgatagtgaataagtctcacaagatctgatggttttataaagagttcccatgtacaagctctctcttgcctgctgccatgtaagaggtgccttttgctttccaccatgattgtgaggcctccccagccatgtggaactgagtccactgaacctctttttctttataaattacccaggctcgggtgtgtctttgtcagctgtgtgagaacagactaatacaagaaccttgtcaaaatatttgagagggtaggctgaggccttctctcactccacaaccagagtaggaaataaagagaaccctgaagttgttgactgtatccgccattaagaatgctaggttttctgtaaattaaactttattttccatactctaaaagtggttgaagataaaagtgaataatagactcttaatgtggacagttttctaaatagagatcttcatatcttgattaacaggactcatttgaaatatttgaaatttgaaacagagcattgtgccatcccatgattttaatcccatgccctctatgaacaggtcaaggtcatcagaaaagtgtgtccccactctctaagccagagcccaactgtctttccagacctgacacagataccacctcttccacgggctcttcttcacctgcctaaggcagctttggtgtatggaagtccttctaaatgatgttccatggcaaaagcaatgagacaggatttttggtaaaataaatgtcacaattctgcctgcacgttagaattaactatggagtttttattgttgttttctttaaagtccctgtctgggatcctctctagagctatcagaatccctggggggactggctgtgaggctgattaaggaaccagctttcctcacctgactaacctggtcatgggtcactggtcacttgggggaagacagcaccagagacgtgtgtggagaagtgcagcccccagctgcacaccagagcccccaggcccatggagaagacacttctctggcaggacctcaagcacagcagcccgctccagctcaggagtgagctgagccaggctggagggagccagccactgtgaacgttagtgctgtcttatctagacaaccgctgtctgcaattgcgtggaaaggccgtgagctgaagtcttggctccatgttatcccaggtcatccctccactgtgaaaacttcccaggaatcatcctcccagttaattttctgttcagggatcttggttggatgagactctggcacagtcaccttgtcacttttcttctgccttgcatgacagttttcatgtccatcaccattgatattttggattagatcatttgggggtggggggcaatgggtgggggtgctgtcctgtgtgttgtaggagacttagtagcatctctgacctctacctaatagatgccagtaatactcccctcttcccatctagttgtgacaacccaaaatgtctccacacattgccaaatgtcccctggttgaggacctctgctctataggaagaactaattgagggcagagttcaagtttagttcagctctttgttctcttctagtgctacgcagagtgcctggtgcattgtgggtgtccacccactgactgtgagagatgaactttctgtgtgatggctcgtgcacttctaaacgttggggaaagagagctttgtgagatggtaacctatgattgtcccctcccactcaaggacataggtagcaggctctgtgctgcttctctgcctctggggaggtttgtgacctgacttttatttccaaaaatccactgagatcaacaggatttaagaacaaaatgatttttctctgggttaagaagagatttccagagactggagtaagaattaagagagaggttggtgagtcccaggagtgttctgaggctgtggctggaaatgatgcatcaggaggtttggttctgggctgaggtctccaggtttagccaagacctggagtcccaagtgtagcaagaagctgcagggacctcctgggatgagctaatggacatctgagtggatggggggactgctaacaggtcggactctctggaaacctgggtattatgtaagatctcagatccctgacacaaactctggaggacccagggaagagaaattccaagaatgacggaggcagtatgaaggcttggagttgaaatcaagttgatttatagaaaatagagatgccagtatttctggcacacctgacttttggcttgggatttgtacaaagtacaaagtgccaaattaataatagctaataattattcagtgtgtattgtgtagtagacacctttttcagcttttagtgaattatctcttttaatctttgcaagattccttagtagtttccttgtaatccccaaactagaaataaagaactggaaacatattctagttagatgacttgctcaaggtctcacagcatctcagtggtggaggtggaatgataaaaatagcaaacacgtattctgcatcaagcacattttacagactttgcctctatttatttagtcttcacaacaaccgaatgaggtaggtattattgccactcccattatatggataaacaaatggagaaacggagatcaataatttgcccaagtctcccagctcgtagttggcagacctggaatttgaacttgggaagattgactgcaaagtctgtgcaatctaaccatgaagccatgctttggagactccaggacccacactcttaaccatgctctgccagatggacccctggatacttgcaaatgactaagtggtaaaacaagattttagtaggaacaaaaggacggttagaaccagaagggcttgcttatatctggaaaatgagaattaggcaaagctctgagttgatgtcccagatctgcatttaaaactaacactgagctcaagaccaacccacctgcctataaaggtattagctcactttatcctaaaatagaaacaccagtgctgatccaagctctgataactgaagatagcaactccttgtagtatgtctgaggcattcaccaactggagcatgttaagaagaggagaatgggaaggaagagaaaaattgtgtcataagagaaacaatggaaataattgagaatgtgaacttagagaagaaaagtctgaggtgccttcaacaaccctccagctctgaagatcaaaccatccttgggttagctggtgcttcttgtccttgacagtctgttttcagcttttggtgaaaaagctactttgggttcactttttgtcagttcatgccctgtggtaggttccccatatacaatgagtggctttgtttagaccttgatttaaactattggcaaaaacaggttttgggggcttttggatttttttttttttagatagaaaattctaaaattagactggatattggatgataataaaaacttaatgctatttttatcgttgagatactgaccttgcagttatataagaaaataccccttcttacccctcaccacttactttttttagaagatgtattttgttgcaggaagtcagggaccccaaacggagggaccggctgaagccatggcagaagaacgtggattgtgaagatttcatggacatttattagttccccaaattaatacttttataatttcttatgcctgtctttactgcaatctctaaacacaaactgtgaagatttcatggacacttaacacttccccaatcaatacccttgtgatttcctatgcctctctttaatctcttaatcctgtcatcttgtaagccgaggaggatgtatatcgcctcaggaccctgtgataattgtgttaactgcacaaattgtagagcatgtgtgtttgaacaatatgaaatctgggcaccttgaaaaaagaacaggataaaagcagtgttcagggaataagagagataaccttaaactctgaccaccggtgcgctgggcggaacagagccatatttctcttctttcaaaagcaaatgggagaaatatcactgaattcttcttctcagcaaggaacatccctgggaaagagaatacacccctgagggtgggtctctgagctggcccccttgggtgtggccatcttctatggtcgaaactgtagggatgaaataaaccccagtctcccatagcactcccaggcttattaggaagaggaaattcctgcctaataaattttggtcacactggttgctctcaaaaccctgtctcctgataagatgttatcaatgacaatggtgcccgaaacttcattagcaattttaattttgccccggtcctgtggtcctgtgatctcgccctgcctccatttgccttgtgatattctattaccttgtgaagtacgtgatctttgtgacccacaccctattcatacactccctccccttttgaaagtccctaataaaaacttgctggttatcggattgtgggaggcaggaggatcacttgagcctagaagttccaggttatagtgagctatgagtgcaccactgcactctagcttgggcagcagagtgaggccctgactcttaaacaaaaattggctgggcagggtgggatcatgcctctaatcccaggactttgggaggccaaggtaggcggatcattcgaggtcaggagttcgagaccagcctggccaacatggtgaatctccatcactaccaaaaaaaatacaaaaactaatcaaatgtgtatgtgtgcacctgtagtcttcaggtacttgggaggctgaggcatgagaatgtcttgaacccaggaggcggaggttgcagtaagccaatattgcaccactgcactccagcctggacaacagagtgagaccatgtctcaaaacaacaacaacaacaacaacaacaaaaacaacaacataaaaaaaaactagctatatactttcaaaaagagacgcatctaatacataaggacataaaaaagtttaacataaaaggatgggaaaagatacagagatatggccgggatgctggggaaaccaaaaggaagtaggagtcttcagcacagagaaagcgtgaccagcgtttaagaggatcagttaccaatcagctgcattttccagacagccataacaattctaaacttgcatgcacctaataaaacagaaaacataaactgtaaggagaaattgtgaaacccaccatgtatttgagaaatttcaacacacgtgtcgagtagacacagtgttactaaaaacttagaagatttgaacaacacaattaataaacttggttttaatggtcttctaaagaatcctcccccaaatcatgtattgaaacaaatctcaataaaattcaagaaatagtgggaaaaaaaaaaaaaacttgctggttttgcagcttgtggggcatcacggaacttactgacatgtgatgtctcccccggacgcccagctttaaaatttctcttttatactttgtccctttatttctcaaaccggccaacgcttagggaaaatagaaaagcacctacgtggctatcggggcaggttccccgatagtatttaagatagaaatgatctaatacatagaatttgccttaaaatacttcagagaaacaaaagttgggatagatgaaacaagtatggcaacatgttgatggttgttgaaacggcaatgattacatagttctttgcattctttacttttatgtttgaaaatctttataataaaaagtaacacatttatatgtaaaaataaatttatatttatatgtaaaaatttatatgtaaaattgacccatagatattttcataggaaatacagaggtcacatgcctaaaaatgactaaaaaatttaacaactcatttaatggaattcagtagctaatacaaagtgcaagggcagggtctaggtctaggtcactccactccatttctacacttgcttaatctttacctgaagcatctttaggaacacatcccaggcaagtcaaggaacattctctaaaggaactttctgtggtctcaagcaaattgcctcacctcagccatttctttaatcaagaacatcctcatttgtggatacatgaaagacttctcggcacatttatccccagaaacaagagcttcatcacaggtcagatttagggtagaccccaatcacatgggagaaatcagccataggatttgaaaccttgaaaatctgacattgagtcatagaaatgacctggtgtataagtgtttcttctccattgaagacttgactcttagtgcctaccacccagctttgcatatagtagccgttcggatacttcaattaatacagatagatagaaaccctagctcttaggcatacacactagtgtttatagtgtgcaagccttttcataagaaagggggtaatataatagacatataaacatgtaaatgcatattggcttatatttttgaaaagaaacaatggaaggataaatcccaaaactaaaggaaatgattattatagaggattggagggaacaggatggagagatggaatgtcaacttttttggacaatgtcagctattcaatatgttttacatggctgaaaaacaaaattaaactcaaatcaaattacctggggacatattttgactttggaacaacgtacatgttttacatttttaaaaagaaacagtctctaaaacctgaaaaccatggaaacaaatgaacctaactagacattaagttgatgatataatcatgcagggaaaagaatcatttcaaaacacgttaagactcagtattttgactgtatagtcataaagcagtggtcttttataataataatatttcagatagtaatatttgatatttcaaataataatatttgaataatgtaaaatatatttatctgttgtaagaattacagtatttatatatcgtaagatatatagtaagatcagtgatcttatttatcgtatataaatttattgtatatatattgtaagatcagtgattatgttaatgaatgccattgggattctagactttaagcataggagagatacagtatagaatcagagaaattgttaaaattctgtaatattaaaagttctgggtctggtgccttgtgatccttggcttctctctctctccatgggccatttcctcctgcaagacctctccggtgggttcacgggctgctcacagcatagtggtctcaggatatagacaaacttccttcattgtagccggcttccaagaggcagaaagcaaagccaccgggcccatgaaaggctctgcctgggagtagcacagcatcacttccagggcctgcccagcttcaggaggtggtgaaacagacaccacctcgtgatggaagagtggcaaggtcacagttcaggaagctatgcaggaggggacatactgttgtggccgacactggaaaataaaatcaaccacagtgaagtggtggataacggagcaggtcccagcctccccaccaatggctcaaacagggcttctgactccagaaacaacaaggaatggcaaattcccaacccactggccacctgacattagcttatcaacccttctagatcatcaagaggctttcagaactctcttgagtttctcctgatttacagacacactttcatttcccccgagggtggtatgagtgagtgggcagcatcaggtagctgagagggaaatttccagcaatgtctgcactaggaaagactgagcttgaggcccttgtgctccaggaagtgctgcctgcagctgctgctaagggagaagcatcaggggcaggaaaccatccctcagggccactccacttgctactccatcaccctgcagccagagtgggacaatgagacggaagcatcaggaagccgttgctccaggaactcagggaaggtgggggcacaggaaggacgctgggatggaggggcacaatttcaaaggaacaaatgttgcctgaatgcttcgtcatcctggcagcttctcaaacatgtggggacaagcagccttgtgggcacagcgcccatgctcagaaagttctagggatggattcgtgggtgaaggagagcgagttgggactttgaggcaggatcgtggtgggggaatggaaggcctgtggacaaggaggagggggctgcaggccaggacacacctacgagtagaagagtcctgctgttaggttagatttccctagttgctctgtgggcccacacactcacaaaggtggtgaaggtaaagaagacaggctgagactccattccgcgctgaccaacttggccagtgaggctggtgtaggaggtgactggcctctgccctcacctacctcccaccagcggtgacggacttcacttccaccctcctcgcttccagccaagcccggcttctccatttcagctctgtctcactccacactcagaggccagtggaggggccagatcaggctaaggatgccggtgggaggttcttttggagagaaggcaaagagaaagaggagtgggaggagaaagacgtttcgttctgagctttatctagcaggggcaggaccagaggcaggggtgcaccaggctcagactacacttagccgagttctgcagaagaaatgctgctttgtctccatgtggcctctaccctggcctgctctgggcctctgaactaacataaggacacttgcagagagatggcccaggttttagcaaaccttattaactactactgcgtagttccacccatctttactaagccttccagaccccgcgagcactgtggcccctgctggtggccagatgtctcggatgcctttcatttttgcttgccaagcctaccttccccttttgtctgacagcacctccctccatttcttgtgggaggaaaaagagggccacctctcatgtactttatgtggtcccagtcagatcccctatcgtgacgctccatgctgtgatgggcagatgtcccaggctagccaaagaactccatcccctgggcctaatgactgattcaggtgggtatcggatgtcaactgggccaattgggaacttttctaatcctttatatatggatgctagaggagattatgcgtgtcttcctggaaaatcagatgtggtaatgacttctataggcctaggtatactgatgaagcctgcctgagacccagagggcagcacagccaagagatgcagagacagagagagagaactcatgacaccatttgagtcctcaaggaagctccaaagaattagcaaaagctcagactttgtcctcaagccttcctcaagcaccgctatccagagctctctgtcaagtaacagacagcagcaaagatcaaatcaaggatgttgcctctcactcaagcctgtttcttcggatagactcaggacaattgcatttaaattgagacactggggctaagcagagcgtggacatcagtaaataaagtttttaggctaaaagcatgccaaaccagattttgtctttagttatttgtgcatgaactggaccggaagcaaatattcttaaagcctacgtgggtttcttagggaattttactgcccaggaaactctaagtctgacttgtcaaagccctggagccaggaggctgccgggggccccaaccatgcccctgagggaaggaactgtaaaagctctgcagcccctccccacccctcccagggccatcgcctaaatgtctgcttcagatggacaggggagaatcttctggaccatgtcagccaagggaggctctcctggaaagtacaaccagggttgccagatggactgacccagagattcgcctgctaacatagaaaaaagactttttagctcctgctcagcaagatttgagcattgatatggacctgagtaacttatacgtgttttcttatcttttttcagaatgggaaatgttattgcaattttcctatacagaaccactgttaagtatggggtaagggagagcttgggggtaacagagtgatccagcttctccaggagctcctcctggtcccaagtgcttttcctgcaggtgctcctgatctttgcatggaatcgaggcatttgggcctcgtctccctcagagagagggtagatgtgtctgtgaggaggacccacaaatatctggtggccaaaagcatggacagtggcagacactgttagatgtcacacagtgctagttcctccctccttttagactaaaaagacaccccatttttggtctgggcatgggcagcgttatttccagcctcccttgctgctgggtgtggccaagttcccagataaaaatgagcagaagagagagaggaaacttctgggtcacgcttgtcaaagaaaaaggcatttcttccgttccacttcctcttcccaccctgctgctggaattctgatgtgctcgtgtccatcttcaaccacacaggcaaggacagtctcaggaatggccagttctgtgtcaaaactcctgaacctataaactcagctgttctgaagtcctattttttttttttcctttgggggcttttgtaaattcagtgactctgtctgggaaagtatagcaattatatcctataaaaattactgtgatactggaaaggtataacactaataaccttgggaagctataacattaaacagtaacaattagaatgaagagaataaagacacaaatttaaattcatagtgtactgtattagcacttttatgactggttttagtagtgcaagtggctacagcttttcaggtggattatagcactggtgagaagagacctttcttgatcttattcttgtgttctcactcttgttctccttttcactgtaaaattcctgagagaattagccaaggatgcagaatatgatcagaaatctggggccataagaagctggagcagcaaaacacattcacagtgcagccagcccttggctcccagaattcccaaaacaagtgtgctcccttcagaaatacagtccttggagtaggaggctaacagagctaaggtactcatttccactatactataacctggttttgctatggaattgtatcatcatttcagaaagaatttatgccgacaactcatgcgcttaattgaaaatatgctcatagacctcctcgtactttttgagtcacaaaacatcagcaggctctctcatacagaaggaggagaaaacagagtgtgtatccttcacatgtgtgagcagtatcttctctctggctcttcagggtctcagcaagccatttccccatagtataataatttcggtaatcaaagtgacattctgtgcatgtattgtcacttcttaaggtgtttagagcatgccaacaaatctgatttattagattcatagttttaattatttgtttatctaagagcttgattacaaatttgtaatgaatgcttaaatgtctggggagatttaatgcgaagttttgtgcttttgctgattatgtgtaaatagtgaataaatatttggaattgttaaatgctaaatattagaagaagtgttgtttatagattaatgagttagcacattcataaaagacaggtaacagtgactttttctctctgcattaataaccactcagacattaatgggtgtcagtgtccttatccatgcggagaaggggttgaattcaatcattgctaagttttcatacatctctaaaatgctggatcataatgaaaattcagaaactctttcgctcatgttcacaccagattttt

SEQ ID NO: 610 - DNA, 65740 bp, Homo sapiens
ttaaagtacaatatatcagatcagaaatgtgagggataaaattatttgctttccagaaatgtgcggaaaaagacaaatagatgaaaacaaagtacattagactttggagattgagcttgatagatgttctgaatcattaataattgaaggaaataatgtatacattggtccatttccaaggcaaagtgccttgagttggtttaggtcagcaagctacagaaaaaataggatatactaggtccctgcttggatagccgacgcctgcttggatagccgacgcctgcttgtcagctctcctcccctcctgcttagttgcccttacccgaaccaaagaaatttagtctaagataaaagtttactagcctgcaaaatagcttgctttgtctgtgcttatcagcctacccagctatttaggtcataagtcaaatacttggagagcctgtgagctgagtaggattgcaatgcattgtgggctgcaacaaaatgtagcaagacaaccctaaaataaacacataaagcccctacccagcaactgataggtgacgtctacaaagactgtgaccccacagtactcagcctatgaggaatctggggagggacctgcacactaggggataaattgcttgttgtaaccgtgttgcatgtgcctgcccatcagacacccaatcttgcaagaccatcattaaaagtctcactttagctgttctctgagcccattggttttttgttagttagtttgtttgtttttatttatttttagatagagtcttgttctgtcacccaggctggagttcagtggtgcaatcttggctcactgcaacctctgcatcccgagttcaagcaattctcctgcctcagcctcctgagtagctgggattacagccatgtgccaccatgcccagctaatttttgtatttttagtagagacggggtttcaccatgttggtcaggctggtctcgaacctctgacctcgcgatctgcctgccttggcctcccaaagttctgggattacaggcatcagccaccaggcccggcctctgagtctattctttgggtttggatgggtgagtttgtttctcacaacctggtggccagtacggggaactctgtgccttcatgcagtgggactctggctgagaggggagactcgtcccatttgatttaggtggcctactctctccttgtgtcccggttccccacataagccagagacaaacctgagactgttattcaggagacaacagaattgacacagggagaaaagcaggcactgcagcaaccaggcaaccttgtgcatgagccaaggtaggaaaattggactgtaagcactgccttggtggttgggcattttcggaggtcaagtgtgtgtgactgagatgtatctaagatatgaagcgagtgcggagtcccaatccatggttccatactcctgcgagggaaatggctcgagatggatgaagtgattcttgggtgtgcaagagacctccagtggcatggcagtgaatatacagggaaacactcagacacagagactaactgaaaatgggaaataagaattctaggcctagggaacaaaggaaagagggaactaaagaaactccctctgaaattcccccaaatagtccactggggagaatgctacaggtttggagggataacccttgaaccagcgacaaggaaaaacaaaagatgataaagtatagctgttttaggtggcccaaagagctcattcatcagttttccgtcttttggcctaagtttggctcagatgaggattgagtgtgccaaactttaattctctctgtgaatgataaaaacccatcctcacaagaggagatgggttacagtctttgttggattggtgaattaactcccatgttcccccttaaagaagaggaagaaaaaaaaagagcatagtaaagagctgtcactcaatgaaaagccctgggatcccctaaaatgcttgaccccacccccatacatctcacaaagtagaagacatggagatcagggcacaacaggaagatgagaggaagaggaatctgggggtcatgaaggaggggagttacactaatttttttttctgtcttttttgtttgtttgtttgtttgttttcctttttctggagaatggggtctcgctatattgcccaggcaggtctcgaactcttgggctcaagctatcctccagcctcttgcctccctgagagctgggattacaggcgtgagccaccacgcccggccgaaggaggtaaacccaatgctctcttagattcctatccaaacttgaggaaagaattagaacaatgtaagaaggacattgagaatttccctatcccctctaaacagcagatgtctaacatgtaccctcttagagaagtccctatgggacaggaggagttggatttgtgagtgcgcctctaacaattactgaggttaggagtttttaaaaaggaaatgatgccactcttggaagatcccctagttttagcagagcagctagatcaattttttaggactcagtttttatacttgggctgagatgctgtcaatcataaatattctatttactgaggaagagaggggaatgattagaagggcaaccatgaacatttgggagagacagcatcctcccaggcaaggagtactgtcagctgagtagaaattccaaaatgcaaatcccagatgggataacaataatcccagagatcagacccaaatgcaggacctaagggaactaagggattaaaaagtccactcctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagtccactcctaggacacatcatgtctccaaagcatttgagatacaacaacaacaacaaaaggagtctccctttctgtttctgcagaggctcagggatcaaatgagaaaatattcaaggttagatccagagaacccagtacggcaaagccttttaaaggttaattttgtgactaaaagctgtcctgatattactaagacactgcaaaagattaatggatgaaataacggattaagggattactgagggaagctcaaaaggtttttgttaaaaaaagaaagaaagaaaagagaaactgggaaagggaggaaaagaaaaaagtaagaagggaaatcagaaagagaaagaagaggaaacagcaaaggtagagggccagagagagagagaaagaggaagaaacgagtgtgagggagaaagaaaatgagatgacagagagagagatagaagaagaaaataagcgagagagggactggggcagacggagatcaaagagagacacagaaggtgagtttgaaaagaaagataacgtaagaggaagaaaaagtaaagtacaagaagaagcgagggagagagagagagaccataaaagacgggagacaaagagacaaaagcgcaagtaagcagtagctgccacggccctgctggtagaggagagtcggaagctgaccttcggcagggccctggtagtaagcaccccacaatgggtcaggaatatattaaatcaaagagctgggagatggctgactgattcccggagtttaaaacatgaagccatattactagaaaaagataatttggttttaacaacagatacttgcttgaatccagccagtttcttatggacaggagaggagaatgaggaggcatcagaccataactatttagatatcatagaatgtcaaaccaaaggtagaccagaccttagaggaactccactatattatgggataaggctgcttgtggaggggtcatcccaagtgataaacggtaaaagacacgatggctttgctgtcactgatggaaacaaacaatccttatgtgaaaaaggtagattgcccaataactggccagcccaaacctgtgaattacatgctcttaactaggccctaaagctcctagaaggccaaaaaggcattatatatactgattccaaatatccctatggagtagtacacacctttggaaaaatctggacagagcagggcctaacaaatagcagggggaaagaattggtacatgggaaactagtcaaacaagttttggaaaacctcctgcttccagcagaggtagccatagttcatgtaaatggccatcagaaaggaaacagtatagaagctgcagaaaataggcttgcaaataaagctgctaaggaagtctccctggaggaaaaagttaaactgtttggaccaatcctagatatccctaaggtggtattaaaaccccaattttctaaggaggaggaggaagagctgggcaagataggggccactcaaactgaggatgggaggtgggtgctccctgatgggagagaaatgataaacaaacccataatgagaaaactaatgtccatactctataaggaaagtcattggggtcctcagctgatgtgtaatacaaagcttaagaattatgggtgtatagagatttatacacttgctaaacaagtgtgtgggggttatgtgagcagccagaaaacaaacaaaaaggtagttaaaaaacagactaccagaggaaaacctcctaggttaaggccatttcaaagcattcagatagattttacagaaacacccaaaatagggagacaaaagtatctactggcaatggtaaaccacctctctggctgccttctccctcccaaatgccaccccccggaatgtgataaaaataatcttagaacaaattatacccagatttggcctggtagaaaatattgattcagacaatgggagccactttacctcaagggtgctaaggggaattacggtaggttaacatattagatgggattaccacaccccttggtatccctcctcctctggaaaagtagaaagaatgaatcagattctcaaaaaacatattattaaactaatcttagaaactaaaatgccttggacctaatgtctcccaatagcacttcttaggattaggaccgccccaaggaaagatgtgggattgtctcgtgagttattatatggactcctatatttaggtaggactactgactttcctactatggaaacgaaagaccactttgtaagaaattatatactggccatatcctccaccctgtcatcccttaggttgaaaggacctctcgctcaaaccctgcctcttgagtccatggtttaccactttcagcttggagactaggtgctaattaagacttggaaagaagacaagctctgcccaagctgggaaggtccctactctgagacagctgtatgaacagctgaatgggggtggacgcattacactcagatcaagtgactgataaaagaacccctggaaggaagagaaatgggtgaatggaaagtgtatagatcacctaaagaacccttaaagctaactctaaggaaaacctagaaggaagctatgagcaggctctgtcattgggagtggatgtagttgggattaattctactaccaggggtaagagggttcacaattgttggatggagcccggtagaagaataatatccaatcaacgtaatagtcaacgtaactagaacccccatcccccagaccataaagttcaatgcctgccaattcttacatttcgggaatttagggaaccaaagacagctgtcacaaacaaacaaatatctatcctgaaacaggttgttactggggaaagccccattctagctggaatgaggtcttgtggaccactcaatttggagcctgggtgagccattcttcccaaaacaaacccttaaagaataaaatacatttgtataagggccccatgccacctaactgtagaaatttagaatgcaatcctatatcaattaccataaacaatccagctactctagaccaggaaccttggaggtatggattaggaataaatgtctcaggaagggatcccgtgggagagttggcttttaggctagtcaccaactccaccctgagcccacccagggttactataactcctggtcccactacttcctttaacccaccagacaatgaccctaagagagtaaaaataattaaggtaactgacttgaggcagattttagaaattgagactggactgggggacgtaaatgcctgggttgaatgggtcaaattttcagtactagctctgaataagagcgactgttatgcatgctccactgggcagcctcaggtcacaggtggttccatttcccctaggatgggataccaatcctgatggaacgcgttgcatgttggccctataccaggacagggatgcatggggaaatgaggcttgcaaaagtctattgttctttcccgtcttgcagagatcagaccctagagcaatccccttgttctccatagggaatataaaccactcctcttgtctctctaggcagggggcagagttcaataagcccatgggaggactctcaagttgtacccacatctgaaacattactggtgagtcaaaaaaaggcaactacttggctcttcatataccctgagctgatgtctggtggtattgtggaaagaggaacctccgtaacttgttactgtccaattgggctgggacttgtgccttagttcaattggccattccattcaccctggcattccataaaatccccaagaatccacatggccaccgaagtcggagagatctaacaaattattttaatcccaacatttatattgactcaatagaagtccctaaaggagtacctaataaatttaaggcctgaagccaaatagatgctggatttaaatcagcactcttctggtggtcgactattaataaaaatatgaattaaattaattacatcttttataatcaacaaagattcatcaactatactcaaaacgctctcaaaggggtggctagccagttaaatgccaccaaccaaatggcctgggagaacaaacttgcactaaacataatcttagcagagaaatgtggcatatgcatcatgctgggtggaaagtgttgcactttcattcctaacaatatggccccagatggaaacatcacaaagacattataaggattaacaactttagccaatgaattggtggaaaatgtcagaattgatgacccatttactgattgactagagagatggtttgggaaatggaaaggaatggtagcctccattttaacctcccttataatagtggctgaaatcctgacagctatagggtgttacattatcccctgtgttacagggttaaccccaaaattaattgaaacagccatcaacaaatgcccataatgtatcaacaattattagaaaccaaatcacatctactgtcttataatgaagaaagtcaacagttcttgaaacgatttgaggaccaaaggatgcaaaaataaatgtggaaatgggaccagaaggagtaaaaagaaaaagaggagggaattgaaggaaataatgtatacagtggtccatttccaagacaaagtgccttgaatcggtttaggtcagcaagataataaaaaataggatatactaggcccctgcttggatattcaatgcctgctttttaggcctcccccaccacctccccccccacccccttcacctcttagttgccctcacctgagccaaagaagttccatccaagatgaaagtttactagcctgcaaaatagctcactttgtctgttcttatcagcctgcccagatacttaggtcataagtcaaatacttgaaaaacccctgagctgactaggattgcagtgcattgtgggctgcaacaaaatgcagcaagacaaccctaaagaaagcacctacagcccctacctatctataggtgacatccaggaagactgtgacctcataggactcagcctaagaggaaccaggggagggaccagtgcactaggggataaattgcttgttgtaactgtgttacatgtgcctgcccgttagatccccgatcttgcaagaccgtcattgaaagtctcacttttgccatcctctgggctctgagttcattctttggtttggatgggtgagtttgtttctcataataatcaaaaacttaatttaagaaaattcttctgatatgaacttttccccttggtattcagattaaaagtgtctggtaaaaatcctggccaaagaatacctctaatttattgaattacaaagttatgtaataacttatataagtcttataataagcctcattatccaatatcaaaatgtattatgacatataataatcaagtggaatattgttacaagaatttatacatatgcctatagcaatgaaatataataaagaacccagaaaaagccatacaaaagcatgaaaatgtgatgcatgacagaggaagcattaaagccaatgggaaaagagtagactgttcaataatcctgcttgaataatttgttatccaaatataaaggtaatataataaatccacctcatatgatacacaaaaatataagtggattaaagtcttaatgtgtaaagtaaaacttcaaaaacgttcgaagataatattatgacctagagaaggaacaaatattttaaataagatgtcgccaagcccaaatcatgaaagaaaaattagatgtgctattttaaaattttctgcctctttgcagaaaatgacattatacaaatgacaagcagtagactgggagaagattttagtaacacaaaaaattgataaggcactttctatccagaataaaaaggagaataacttctactaatccataagaaaaaggcaaccaaaaagaaaaaaaaatgaataggtacatgtaaaagaaaaccttaatggccagtaaacaaatgaaaagatgttccacctccctagtaaccaaggaagtaaaaataggacccataatgagatacactttacatgcaacagactggtatagataaaaaattctgacaaaatcacattagcaaggatgtgaatggagttggaaactctaattgcttgtgggagtgtaaattgccgcagttgatttgggaaggacttggcaatatctagtaaagccgaagtctatgtgaagtcagatctattgcttagtaatttgactctgaggatttgatcctggagaacctttcacaaaaatatgtgaataagaatcttcacagacattttgcctgcagtaggaagttggaaagaacctgaaatgtccacttacaggagaataatcagattggttacaatctatttaataccacatttaaattatttaaataaaactgtacatatcaatatagtaatcacaataatatactattgaatgaaataagccagttgcgggatagcccatggaacatgtactattcataaagcttaagcaggcaaaacaatgtaatatatatttctaaactgtatacatagttataaactatatattatataaatatacatatataggaaggtatatatgtagtaacatttttaaaatgtagagacatttaaatatgtagtaacttttgtttaaatgcagggaaagataaatactaaattcgggatagaagttaatgttggtggctatagaaaaaccttgtcttcattaagctttatttcataagcttgggggatgggcacattggagatcttactgtttatattatttgtaagcacaagatacttaaaataataatacataagactgtgacactaataataccaatttacaatttcagattacttttacaaacattgtgaagtatgaataataggggatggcataatggtgaaagtgaaaaaaaatgtactgactctttaatagcttatattttacaaactaattgtagcctttttttgccactgataattagagaaatagagcttaaaaggtgcttttgaaaaacttggcaatttctctatgcataattacaaaaacaggacatataaactttccaaaactctgggaagatataagcaaattaaactttgtacttatagaaaatgacataaaagaacaacaaggcagaaaaacaagaaagcatgaaagagagtaatagaagaaatatcaatcatagcaattgatatagaaactaatttaactgaaatatccagtacctgacctgttttggataaaatattttttctagagtttggatatcttaacctcaaaatgtgttgtagtggatatggcatagaataaatttagaatctaaaaagaaaaacaaatttaaggtttcatgttaccaaatataatcttgctagttaatctgagaatgtgttaggtgtctgttattccttttcttttagattgaatgtagggcaaaaaatccaaaacaattttagttataaaagaacataaatgaagtttcttatcaattttgacaacaaaacagaacttcaaatgtgcactacttctcctaaaaaaggtaatttagcatctgacaataatattaaaatgttgtgttaaataaaaagtggtggaaaatcatttatcagagcaataatttgacaggcagtaaaacatagtgtttaagctcataaactccagagctaatctgtttttgaatctcagctctgatatttactcagagctggtatttataaccttggacaagctacttaactattctgtgtctagtttcttcatctgtaaaaaagggaataaaaatagatctccgatataatattcaacatactcagccactggtatagtaatataaattattacttaaataaatacatatattaaaatatatttttttttattttctaaatatatagacagggtacatagcaaagtggttactaaataatgtggttacagagaaaactccttatcaaatcattttattcgcaaatctcctgttaattttgaaaagtggtaattgcgattttaccccgatgagtcatggcttgacataggaactgcatcaaaatgtttcaacattcccatttaactcattatcattaggtccttggtgtctagtgctttattttagccagaaggtggcttgatgcctggtgttttgttgcagccagaaggtggctggacacattgcttataaggcagagccaagtattcatttagatgggaatacatactctattgcttgaaccttggttcatgctgacaatgctgctgtgaataccacctgtcctgccacctggacagatgcccctgccaatgctgggcttccaaggagcagccagtaggcaccgcagacactcttgccaccgcacagcctctctgtagccttagtttcctcaacagtcaccaaggtctttcttcctatgagccagcaccacccttagaccccatcacctgtctctgaccactgccaggtgacattatttggtgacttgtggtctcaataattaaagagttgctctttactgttagataatatgcaccagtattgccattttaatacacacattagaatagattttcttttattttctaaacatatacacagggtacatagcaaagtggttactaagtaatatgttacagaaaaacccagaagggttttggtatttctctgatggttatggcaatactgggtgcatactatctaatagtaaggagacttataggagcttttagtatctttgtgaggattacataagttgataaatgtaaaactcttagaacagtgcctcccacaaaacagccactcaatgttaactcattattattagctaaacctattataacgtcatttttggaagcccaaaaaggccacaacatattcttaatagaaaaaaaaaggatcccaagtgttaaactcttgctcttgctataatttgttggtcaaattttccttgcagtttgttcttcttgagtgtctctggttccgtctgatgtgatgtttatttttttaattgatgatattttcaatatatgaaagaaccaattgtagagtgattttgtctttccactgagctcggtagtagtgtctttgctttgtaatttagccattactacattgttaaaaatcacttgtaccctaagttataataagcactattctatcacttaaagtgtcagttaaaaggtagacttccgtatgataaaacaagtaaatgggttaattattttagtaaatgacaaatgcttggataaggtttaaaacacaaaatcaaatcacaaattgtttacaaaatacttaaaattataaataaaaaataacttgtaaatgacaggaaaatatttgacagacaaacagaaacacgaaaagggcagctaacactattttattagaaaagaaaaaacacaacaaaagccattacatttggtaagagataattattctctatttcttccacattctcccctctgcaaatacttctgccttcttacaggaactgcaagaagacacttctgtcttcttgttcaacattttacttgctcttctcctaaaaagaatgaatggtaattttgacttatccatgttataagtggggtctcagaaacagatttctctgactcaatttttccgtctctgtctctgtttctgtctctgtctctatgcctttgtgtttctttatttctttttcccctccccctctctctcaaggactatgttctttgggtcttgattccatacagttaactgcctctgctttgtgcacttaagcctgtaactaaaccaggaaggccctattgttttagctcatattttttcaatttagaaagaaaggaggagttactcaggcatgtacctagggtgtctactattttctataattcatctttattgggaaacactgcagttgtataacatctctttcatttgccataattcattcattcacttaataaattttgtattagatgtctgctgtattttaggtactcttctaggtccttaatatacattagtatacattactgctcttatcttatatctttgtgtttatagtcttggccaaaacccttgaaaagcaaaaaaaaaaaaaaaaaaaaaaaaaagtaagttgtaaaatttagtttgagagagaaaaaatacatatatatgcattatttcatgataaaaaacaaaaaatttcaacgatctataaataaaaggaaactttttcagactgattaagagtttagacatttttacagatattatcatatttaatggtggaagactaaatgtcttccctctaagatttgaagcaaggtggtatagattgagttgtgttcctccatcctccccaacccaaattcatatgctgaaagcgctgatcctcaatgtgatgagatactcagatgagatcttacaagacgattaagtttagataaggtcaacctggtagagcactcatggtgggactcttatgtcagaagaggaggagacaccagagctctctctctgacatgtgaagacatagtgagaaggtggccatcggtaagccaggaatagagctgtcactgaggagctgaatttgctggcacctggatttgagacttcccagtctccagaactataagaaataaatttatgtgtaaatccctcagtttaaggtattggttgtggcagcctgagaagactaatacacaaggcaaggatgtccactctcacagcttcaattcagtattaacttggaggttctaacgagtacaatgagacaaggaaaagaaacaaaatgcataaatattggaaaaatatgtatatttgtttttaaagatgatgtgattgtatacatacagtatgcaatggaatttgcaaaccactagaactaatcaataattatgtcaaaataattggttacaaaatctatataaacaaaaatcagccacacttctatatactagcaacagacatttggaaaacataataaagtatgtaaaatagcatcatatcaaatatttaataataaattaaatgaaagatgtttgtctgtactaaaaagtaacccctcaaatgctgaaataatatttaactaattagaaatacattatgtttatggatagaaggacaagttttttttttttttttttttgagacagagtctcgctttgtcacccaggctggagtgcagtggcgcgatctctgctcacgcaagctccacctcccaggttcacgccattctcctgcctcagcctcccgagtagctgggactacaggcgcctgccacaacgcccggctaattttttgtatttttagtagagacggggtttcaccgtgttagctaggatggtctcgatctcctgaccttgtgatccgcctaccttggcctcccaaagtgttgagattacaggcgtgagccactgcgcctggccaagacaaaatatttttaagatggtgtattagtcaattttgcattgctataaagaagtacctgaggttgggtaatttataaagaaaagtggtttatttggcttatggttctgcaggctgaagcatcatgccagcttctgcttttagtgagggcttcaagaagcttacagtcgtggcagaaggcaaaaggagccagtgtgtcacatagcgagagagggagtgagagggggagctagagccagagggaggaggtgtcaggctcttttaaataaccagatcttgcacggactcatagagtagaactgactcattactgccaggacagcaccaagccattcatgagggttcagccctcatgaccaaagcatctcccaccaggctccatttctttcgagaatcacatttcaacatgagatttggaagggacaaacatccaaattttatcagatgactattctttattgtaggattgaatgcaatcctacaagaattgtgatattaaagtcaaatgacaagaaacttaaaaagatatggacaagctgcttttaaagcagacatgatcatgctgataacctaaataatcttgaaaaagaacatagttggaaaacttaggctacctgacaatatcaaagggtaaaaaagaggttggggtacctaaactatcagattttaggactcactattatgctaccctaattaacactgcctgatattggcataaaaataaatacacatgaaaaaaagaagagccccaaagtagataatcacatatatgtttaattgattttcaacaaagtgccaaaggaattcaatgggagaaggggaggtctttctaacatgtggtgttgaagcaattggctagtcatattgaaaagtaaaatttaacctctttcttgcactatatgtaaaaattaactcaaattgggatacatatctaaatgtgaatgttaatcaagtttcttgaaaaaaatataaaatatttatttattgctttgataagttggacttaataaaattaaaatcttctcatcaaaatgcactattaagtatgtaaaaatacaagccacagccttgggaaagatatttgaaatacatatattttacaaataactcatctgcagaatatataaagaaccttcattaatcaaaaggaattagacaagcacctagttttaaaaaataaatggtgaataatttaaacagaaacctcaaaaaagaaaatatcagagtggccaataagcacatagaaagatacacaacatcattagtttttagagaactacaaattaaagcaaccataagatacctccccaacactacaagaatgactaaatttttaaagtccgacagcgttgtgccgggtgtccccaataccactcaggtttagtgattttctggaaggactcacagaactcagaaaagctatactttgctatacttatggttatggtttgttacagtgaagagatacaggttaaaatcaggtaaaagacacagaggtctcccaaagagagaccacaggcaaatttccagttgtctgctcctagtgaagctgtgtaaagaatgttcaattcttccagaaaacaatgtggaatattatcaagcagggaagctcacccaagctgttcgttgtctagagattctattaggcttcagttacagaagcatggattgcccatgtggccaaccttagttacttagcactcggcccctccggatgtcaaactgacagcatggtcaagttccccaccataaatcacatggttagcataaactatttggcatgatcgaaggccccacatttacaaactcactcttatcatgcaggatatttcaaggatttgaaggttatctctcaggagcagatcaagaaccagttggttctttggaacgtacagaatttgaattccctaaacctgtaggcttagaccttcactggagaaatatcagcgttgaagatgaaatagagcaactgaaattcttatacattgcttgtgggaatttatgatagcaaaaccactttggaaaactttttagacattgctaacaaaattcaagatatacctaccctgtgacgaagaaattacactcttaggtatacatcaaagagaaatgaatatatatatccataaaaataagtctataagatgacttatggcagctttattacttatataagaaaatggaaacagattaaatgtctctgaacagaagaataaacaaatttgtgtggtatattcatgcaataccatagaatattattcagaaattaaaaggaataaactactggtatacataacagtattgaatgagtgtttaaaacatgtgcttggtcaaaagaagacagacacaaaaaatacagagtatatagtttcatgaagatgaagttcaagaacaggtcaacataactactattatagaagtcacaataaggtcaagtagttgtgggaagatatgagcatgcctctaacccagtcttgaaagtctgctatttctgatatctctccagaaaactttctgagttgttggaaatactgtatactgatatggaaggtacacaggaacaaactttaaatattcattgagccaaatgattaatgtttgttaattatactgtatgcaattttttcttaaaattaaaaaaatcttaccatggtatttaaatttctcggaagtttttaccacatggtatgctctaaatcagtatatttgaatgaatgcacacataaatggatgcatatcttgatatccttactctgttatcatgctcatcaagccacattttttaaaaaatgactatctttgttaaattatctatagtaagagaatgcaatgagcagaaggctctggcaagtatttcattaattatttatttgtgttacagttgaatacattattattctagtatttatatgtcagtctcaaatgaatgtagtgacagaagccagtatctaagagccagattacccttaggtatatgaacagttttatttaaaatgaacttgaaaaattagatcttgaaatacagaaaccttcaaaagacttcatctactatgtatactagcctggatgatctgtcagcctttgtcaggcaaaaaaagcccttcggttttattaaagtctcaatcaagctgcatgatatatgaatttcttaaaaactcaaggtcattattgtgagcacctctgattgtattgtgtgatattattgtttgcagaataacagaatgttgtggctagaagagagcttagtagtcatctagtaaaatctctttattttaaagatggggaaattgaaactttcctttaaagctagcaattagagaactttgggttcctgatggttttgttgagctaattccaagttgtctgcctcatgacttcttttcacatgagacaaataaattcctgtgtatttattaaccaatttaataaagctttttatttgcctctcatagccaggttcatttctaactaatgcaaaaccacactctactaaagacttttcctttgacaaacacagaatttgaaagcccagataaattaattttttgaatgatacctatttttcaacatcaaagctttagcaatcattagtggattagtatcttcaaagtgttgaaaaaataattttggacttagaatttacattcaactaactaatcatctaaaaatgaagatacaatgataatattcctgtgcatgcaaagtttctcagacattttaccaaactaaagcctcttttaaaaagttcttgctggatataccctggcaggataaatctgagagttaatgataaagtacatgaaatataagtaagcaaactttttttggtaagctatattgtatgctaagtaaggaataatatataaacatatattttaataatgtagaaatttgagagcaatggtgggagatgagaatgctaagattcttgtctcgctttggggaaatatacatattactaaacttaggtattgagagagtaaactgaatttaattgtggatattactaaatcaagattcaatctctgtaatggaaggtagaaagaagaaggaaaaccaaaaattaaaaacagcttagtaatcataaaacaaaattaattggtaaaaataaaggatagtatttactcacatacatatatattatgtactgtgcatttaatataaaatcatttttaataaataaaagcaatttcataggaatgcttttatactgttgatgggagtgtaaattagtttaaccattgtggaagacggtgtggcaattcctcaaagatctagaaccagaaataccatttgactcagcaatcccattactgggtatatacccaaaggaatacaaatccttctattataaagatacatgcatgtgtatgctcattgaagcactgttgacaataacaaagacatggaatcaacctaaatgcccatcagtgatagactggataaagaaaatgtggtatatatatataccatggaataccatgcagccatataaaagaatgagatcatgtcgtttgcagggacatggatggaattggaagtcattatcttcagcaaacaacacaggaacagaaaaccaaataccgcacattctcacttataagtgagagctgaataatgagaacacattgacacggggtaacaggaacaacacatactggggcatgtctcggaggcagagggagggagagcatttaggaaaaatagctaacgcatgcagggcttaataccaaggtgatgggttgattggtgttgcaaaccaccatggcactcatttacctatgtaacaaacctgcatgtcctgcacgtgtatcctggaacttaggataaaattaaattaaattaaattaaaaaactatttcaactcattggtcaaaatagagcaatactcagattgtattacataacaatgacaaaaccagcagatgtaagaatcattctaaatggatatacaagagttaaaaacaaagttaatataaaaatgtaagacaagtgtacaccagaagaaatacagaatagcaattttagtagagcacaagatagattttatggcaaaagcataatcagtgacagaaatgctacttactgtgaaaaacagtaatagatctagaagatagaacaaccagccaaatatacgcatgtaactatatataagttcaaaatatattaaagcagaaaatgacgagattaatgtagcaattaatcttatagttggagattttaacacatcactctcagaaattgatagaacaagtagacaaaaataagcaagacatagagttgtatgtagtgataaatgactatcatccagagatacatagagaactttctgtaacaaataaaatagtcacaaaaatgtatcatgtactaggctacaaatgtagctttaagcaaatatcaacatagtaccattaaaaaaaagattcaacattgtaccatacagtttctcttggacacacaaaaatataaagttagaaatgaaactccaaaaaataggttgttaaattacttatggatttaagccaaaaaatgtacttatggaaaatgtctgtgttaaaaaacacatacagtaaatgacaaaatactttgaactaaatgacaatgaaagcaatgtataacaaaatatgtgtgaattaaacaattcttagagaagtatatatagcttttaatccactgatcagaaaaaaatagactgaaacatgagctaagcattcaacacaaatagctaggaaaaaagcaaaacactttatacttccaggaatatggcaatccaggtgttctaaaaatagctcagctgccttaaacatccacattctgaataatttacaacagatttattttaaatacattgctgagtgcattaacaaaatatatgggaaatcctcagcagagagagagaggtctgaaactatagagattataccctaggacctaagccactatcagaaactcagaatttgaggtattagtccaacgtgaaagaataggaataaggttttaagatcatgccaagtcaataggttgtttagaagtagatccaaaaataaaaattcttgtgcaggcatttaaggaagtactatcacaggaaactcataaaaccaataaaaagaggaggaagtaggaaagaaaggaaaggtgctgtgttagtctgtttttatgctgctgataaagtcatatccaagactgggaagaaaaatggactttaattggacttacagttccacatggctggggaggcctcagaatcatggtgggaggtgaaacacacttcttacgtggtggcagcaagagaaaaatgaggaagaagcaaaaggggtaaccctgataaacccatgaggtcttgtgaggcttattcaccatcacgagaatagcacaggaaagatcggccgccttgattcaattacctccccctggatccctcccacaacatgggggagttctgggagatacaagtcaagttgagatttgggtagggacacagccaaaccatatcagaagccaaccaaaggtataccttcagagaaaatcttgttaaagtgattatgacctgatctcacaggcagaatctaatgttgttatttagttattagtttattatcattatgaggtaatattacatatgttataaattatatattctattactaaaatattggtatgtaattattataatgatagattactataatattatatagtaatgttattctgctgttgggaacaggccccccaaaatctggccataaactggcccccaaactggccataaacaaaatctctgcagcactgtaacatgtttataatggccctaacacccaagctggaaggttgtgggtttatgggaatgagggcaaggaacacctagcccgcccagggtggaaaactgcttaaaggcattcttaagccacaaacaacagcatgagcgatctgtgccttaagaacatgctcctgctgcaattaactagcccaacctattcctttaatttggcccatcccttcatttcccacaagggatacttttagttaatttaatatctatagaaacaatgctaatgactggtttgctgttaataaataagtgggtaaatatctgttcagtgctctcagctctgaaggctgtgagacccctgatttcccacttcacgcttctatatttctgtgtgtgtgtctttaattcctctagcgctgctgggttagggtctccccgacctagctggtctcggcaagtggcatccattgtggggactgaatccaggtcaaagggtcacaggagcgatggttggaacagaaaactagctggaggacatctgagtactcttaaagcaatccctgtggtgagtaagaaggggagcttggaagcgtcagggtaacaatgggacaggtgtggggtctggttcatttcaccttggaactttttcacgctgatgttgaggaggaacaagagtatagcgaagtaacagaagaggttacagagcatgtttatttgccagctaaagctaaagcggcaaaggagtgagaggttcatccgtacctttctgcaccccctccttattatttggaagaaaatgaccctccagatctttcttttccagaggacactgggtgaaaagtagtggccccagtgacagttcgagcagtgcctcgagcgaccgctcttagttctactcaggcaggaattcagcaagctaaacaagagggtgatttagaggcttggcagttccctgttagaatacacccccagatcaaaaaggaagtattatagctacatttgagccttttccttttaaattactcaaagaatttaaacaagctattcatactaaaaaagaatgtagaaaaaagtcagcaagtcaggccgccagagaggggaaaaaagaaaattgttgagcctgaaatatgtccaaaatgtaaaaaaggaaaacattgggctaatcagtgtcactctaagtttgataaagaggggaacccgattttgggaaacgccatgaggggcccatcctgggccctgttctaaaccagggcatttccagctcaggccattccctcacccccatacaatgtctgtcccctgccacagccggtagtgccacagtagatttatgctgcacaaaagctgtgagccttctgcctggggaacccctgcaaaaggtctcaacaggagtctgtggactcttgccagcaggggcaataggattacttttaggaaagtctagtttaagtttaaaaggggtacaaatacatataggagtcattgattcagattacaatggggaaattcaaattgttatatctacttctgttccctggaaagcagagccaggagagcacatagcacggctcctgattgtgccgtgtgtggaaatgagaaaaagtgaaattaaatgaacaggaggatttggaagcacaaataaacaagacaaaacagcttattgggtaaatcaaattactgataaatatcctacctgtgaaataactattcaaggaaagaaatttaaaggtttggtagatataggagtggacatttcaatcatttctctacagcactggccatccatgtggccaattcaacccactcaatttaacatatttggcgttggtaaagcccctgaagtataccaaagtagttatattttgcattgtgaagggcccgatggacaacctgggactattcaaccaattataacttctgtacctataaatttatggggaagagatttattacaacaatggggagcacaagttctaattccagaacaattatatagccctcaaaatcaacatacggtgcatgaaatggggcatgtccctggtataggactagaaaaaaatttgcaaggtttgaaaaaaaccacttcaaacggaaaaacaaagttcctgccaacgattaggaaatagtttttgatggcagccattgttaagcctccagaacgtacacctttaaaatggttaacagataagccaatttggatagaacaatggccactaagtaaagagaaactggaggctttagagaaattagttactaaacaattaaaaaatgagcacatagctccaacattttccctttggaattctccagttttcgtaattaagaaaaaatcaggtaaatggagaatgttaactgacttaagagctatcaattcagttatacaacctacgggagcattacagccaggattaccttctcctgctataattccaaaaaattggcctttaatagtcatagatttaaaagactgtttctttactgtccctttagctgagcaagactgtgaacggtttgcatttacaattcctgcagtaaacaacctgcagcctgctaagcgttatcattggaaagtattgccatggggcatgttaaacagtccaacaatttcccagacgtatgtggggcaaccaattgaacctactcgtaaaaaattttcacaatgttacattattcactacatggatgatatagtttgtgctgccccctcttgagaaatattactccaatgttatgatcatttgcaaaattcgatttctcatgctggtttaattatagctcctgacaaaattcagactactactccttactcctacttggggagtaggacactacttactccccaactattactcctacttggggagtatgacactaccattgtgtcacagaaagtaaccatacatagggatcaactaaaaacattaaatgactttcagaaattactaggggacattacttggatacgacctgctctaggcattcctacctatgccatgagtaatctgttttctatctttagaggaaatcctagtcttactagccctcggcaattaacaaaggaggctgaggcagagttacaactgattgagaagcaagtccataaagctcaaataaatagaatagatccagagaagactctagatttgctaattttttcaactcagcattcacctactggtgttattgtccaagaacaggatttagtagagtggctttttcttccacatactaattcacagactctaactccttatttagatcaaatcgctactatgataggaattgggagaactcggattgttaaatcacttggatatgatcctggaaaaattattgtccctctcacgaaggtacaaatacagcaagctttataaatagtcttacttggcaaacccatttagctgactttgtgggtattctcagtaatcattttcctaaaatgaaactgtttcggtatttgaaattaactaattggattctccctaaaataactaaatttaaatcaattgaaggtactgagaatgtttttacagatgggtctagtaatgctaaagcttcttattttggatcaaaaggtaaagttttccagctgctctatacttcagttcaaaaagtggagcttgtagctgtaattgagatatcgactgcttttgatatgcctactaatgggatttctgattctgcatacctggttcattccacacagttaattgaaaatgctcagttacaatttcataccaatgaataactgatgactttatttacccaattgcaaacagcagttaggagtagaatgcaccctttttacatcacttagattagggctcatacacctcttccaggacctttgactgaaggaaatcaaatggcaatcgcctagttgctaatgcaatatctaatgctagacactttcagaatttaacccatgttaatgcgtctggtctcaaacgcagatacagcgttacctggaaagaagctaaagctattatcaagcaatgcccaacttgccaaatggtacattcctcatcttttacaggagttaatccttgaggattggaaactaactctctttggcaaatggatgtcacacatgttccctcatttgggagactagcttatgtacatgtatgtgtggacaccttttctcactttgtctgggctacatgccaatcaggagagtcttctgcctgtgttaaacatcatcttttgcagtgttttgtggtgatgggcattccagcttctattaaaacagataatgccccaggctatactagccaagctctggctacatttttctatatgtggaatattaaacacatcaccggtatcccatacaattctcaagtacaagccatagtggaaagaatgaatctctccctaaaatagcagttgcaaaagcagaaagggggagacagagaatatggaaccccacagatgcaactgaacctagcattattaacagtaaattttttgagcctgcccaaaggccacatgttatcagcagctgaacagcatctacagaaaccagctgcaaggacaaaaacagaacaactgatttggtggagagatccgataacacgaagttgggaaataggtaaaataataacttgggggagaggttatgcttgtgtttctccaggccaatatcaatagcctatttggataccatcaagacacctgaaaccttatcgtgagccagatgctgaggaatagactccgggaggatcctgagaaccccccagttgcagccatgttgagactgatgctgaggaggactccaactgtcacgagcacagccacccatctggggacagatcaagaagctgtcacagatggcagaagaaaacctgaggaaagcaggacaatcggtcacaatgagtaaatctgatggtagctatgatagcggttatcaccacagccatgagtattctttcagtaagggctgacacagagaacaattatacttattgggtatatttatcaatcttggctggcaataatgcctggatgcaatcactttatgacacagttacacatgctttctgatctcagtatttaccataatataattgaggcatactgccctcaaaaacctgtttgtaaacaggattggacccagttagaaaaaatgaacgtacttgtttaggaagattgcattgcataacaggcagaggtgctgcacaatgattcatatggaatcattattaatttgtcccctaaggggatgtttagctttaattgcacctctcagtctgcgtgccacggccacactatgttcagatgatctgaacaaaatggtcagatggtagaaatgataagaagtatggcaaaagttcctattatctggaaccatggcgttatagtggcacctcagcctcaaatgatatggcccgctctaggagcttaacgtaaggatttaaaattaaaagaacaaatatttaaagcatcccaggcacacctgaccttaatgccaggaactggagtacttgaaggagttacagacaaattagcagctagtaacccatgaaaatggataaaaacacttggaagctctgtgatttcaatgatgattgtgcttttaatctgtgttgtttgtctttgtatagtttgcagatgtggatcctgactcctgagagaagtagctcaccgtgatatagctgcctttgcttttatagatttgcaaatcagagaagggggacgtgttgggagcagtccccccaaaatctggccataaactgtccccaaaactgatcacaaacaaaatctctgcagcactgtaacatgttcataatggccccaacgcccaagctggaaggttgtgggtttgtgggaatgagggcaaggaacacctagcccgcctagagcggaaaactgcttaaaggcattcttaagccactaacaatagcatgaatgatctgtgccttaaggacatgctcctgctgcaattaaccagcccaacctattcctttaattcggcccattccttcattttccataagggacacttttagttaatttaatatctatagaaacaatgctaatgattggtttgttgttaataaatatgtgggtaaatctctgtttgggctctcagctgtgaaggctgtgagacccctgcttcacacttctatatttctgtgtgtgtgtctttaattcctctagcgccgctgggttagggtctcccttaccgagctggtctcggcattctgccctaaaaaaatcctgggttttcatacacctgcacctaatagtaattggctaagggtgtatgtggggaggttgaagggagaaactcctaggaacttctagtttctgtgcagatccagtacaatggctccagtagcttaagggaggccctctgaagaacatgtctagcttgaaatggattggagggcatctgtgtcatcactagcactgtctgctacagttggggagcagaagtggagtatcttaataaaactttggcattcaaagaaatacaacttctgtataagtgtgggcagaagaacagctagctgcctataaatggaagcaacagagagttcatttattcgctataccatggaaatactttcaacaataacaagaacatagtatttccatagaatttatggctatagcactattactgtggtaaactcaggtatacactcctcaagatcagctatggtggggccagtgtgaaatgaaactgtgagagcctttgtttacaaattattattaagaatttgtaaatggccacagcagagcattacaccaagcgtgatgcctttctgagttcaaggttctgtgtgcccacacaggtccggcacccataacgtctgcactgactgttctcttgttaggttatcaccaggttaaaacaaaagaaaaaaaggaaagttgttccatgtttgtggcatgtttgaaagaccaaacgtggcagaagcaaataaaaactcttatcttgagaaaagcaggctcaatttatgacccttcagattctcatagactacattgagccaattatgagcttacaatgaaaaaaacatttataaaaaaacacatggaaacaagaagagagaaagcagtagaaattgcaaacaagagttataccctcaaagacatcaggtatttgaatgatcatatacaaagtaaatgaaacagattatattacaaaatatacaaggaacaagagaatatttttcatgtgaccagaaaaaattgcaataaactaaatgaaaattttaaaagtgaaatatataaataatgcagtataaaacttagtgagtgaggcgttctgcttccatgtgacagagtcacttcatggtagatcaatccacctacagaaaacatctataaactctgaacaaaagttaaaaggcaactaccaaactcagactttggaggtaagctgaaactcggaagaagagatgggaatgggtgagttccctacctttgtagatttagcttgagggtgggccctagtcatgacattttgtaggtggctgaagcggcagtagaaaacatgtcatctttcttgcacaaggaagagaaaagctggggtcatgaccataaatgtccaacaatgagaaagcaatctgtgaagaaagagggacagagaaagtggaccccacttaggttgtatgtgtaaactttatccagtctctgtctgattactgaactacacataaataggatggaaagtaaataccttatctaagtaaaaaatctaaatcagttgcacagagatctgagctaatgcattttgtaggacagtgtatttaaccaagcaacaaacacatgactataacactcctttggggaaaaaagggtctttgattgcaaaggccccaaacataacattcaaagtgtaaaggaaagagtccaaaattacccaacacacaaagagaagcacaaaaatgtgatgtactagaaaagtacgatattataatgcttaatctcattagtaatcagagaagtaaaaattagaagtatagtttaaaatgttatactttgacaaaaaaggaaaatttaataatattaattgctgaagaagaccaagagaaagaaaatctcacgtgcttgtgttgagagtgtaaactgaagtaactgttaagacaaccatctggaagtttatttttaaatgaagaacaaatacatatccaagtcggtgatttcactcatgtatatgtcatagaaatttcaatacaggaacagaagagtacatgtacaagaatataatttcagcactgctttttgcaaaaaaccaaaacatcataggtattagccttacgggaaagtgtaagtgaattgtagtccatgcttaggtagaatactatgtattagcccactggatagaatattaaaatagtgatgctaaaagagaaagcagaatgtaatttgaagccaaataattacttaaattttaaatatgtacatgcatacataatactttattaatatatataaataaacataaatgaaaatatttacatactaaatatacaagactaggagcttatgaaagtgtgaattaagttcaggggataaggagaaaggcatgatgttaaatgtgaatttcagatgaacaccaaataatggttaattgtaaccaaataatattggattaaaaagactaccatttgagagggtcaccatttcaatcttgaccagcccaagaggatttacaaggaaaagcagcagtagttgttttgtttgtttgtttgcttgagtccaaaatattgcatggcatatacctatactaaatatgtggtcatatttacaaaatgttattaatctaaaattcaaatttaagtggccatcccatattttatctggaaactctaatgtgtagataaacaataacgtataaaagaaagaagaaaggaagaaggaaaaagaaagaaagaaggaaaaagggaaaaagaaagaagaaaaaagggaaaaagaaagaaggaaaaagagaaaaagaaagaaggaaataggaaaaaagaaagaaagaaggaaagaaagaaagagaaagcccaggcacagaccaacaatgattctgtgccagccatgtctgagaactactgccaactcaattctgacatggggatggaaataaattaatcagtgaataaataatcaaaatagataatttaggtacattattttagaaatataaatcatagtttgacatgataacctataaaaatgtgggaggaaataactctattatgtcaagaactttagaaagtacagaaaacatcttatttgtctctattttctgagaaggaataagcagcttcctgagatagtcatattctaccctaagctaataccctaagctaacaaaggcaaagttcttgagtacattcactcaatgttaaatacaaaggtaagtttggtctactagaaatataacctccttaaataagtaccatttcttattctacagaatgtgtatgttggggtggatagttatattagaatttaaagtgatttagaccaactgagatcttttcttctaagtagttatattctctatataattgttacataatgtgtaaaatacaaaaatgaagagttcttttattcattctgcataaggatggaccccaaaatttggttcagatgttgagaatgggtataccacatacacacctagcgggtgtgtaatatggtttggctgtgttctcacccaaatctcatcttgaattgtagctcctgtaattctcacatgttgggcgagggacctagtaggaggtaattgaataacaggggtggatccttcccatgctgttctcatgatagtgaataagtctcatgagatctgatggttttagaaaaagggaagttgccctacatacactctttttgcctgccaccacgtaagaagtgattttgttcctccttcaccttctgccatgattgtgagggcttcctggctgtgtggaactgggagtcaattaacctatttcccttataaattacccagtctcaggtatgtctttatcagcagtgtaagaacaggctaatacaccatgaaaggtttattccttacatattgaggctttctgaggatagcaaggcaggctcccaaacctcgtccaaaaatagcttgagaaagctggaaaagaggctggcttagggtgtttataatagttaaatgtggtaggagagggggttcctgtgcaccacaggctggggtttatgtgattttcagactggtgctaaaggagggagaattggatttcttgacagcttacccagatgtggggcagaaggcaagctgtcagcagtcaaacaacaaaatggagtcagactgtctactgcaagttctaataaaaggaacaaaagtctgctgactaaagaacatatgattgactagtattttataaattatcacagttgcaatgataagcaattgaaatatatgaagtaactcaatgagaaattagaaatgtaaatgatagcagagcaggcccatgttatgcataaaaggcctgttaatttttaataacattgctttatatagcatttagtggatacaatggccatctatcagaagattagatttttcttaaaatttaaactcaatatgttgcttaaaaaatctgacacaaccaatgccttttctttattaatgccattgcaaatttcactgaataaggatttcagacagaaaggaaaccataaataaaatcaagtctagatttgttttaactcctaccatttttagactacatcattcattctatagagattaacaaaactgtaaaataccagcagtctcagcatttagatggtattttagaatattttaaaacattgttattcagaattatccataaatcctaatttaacccgaactgaaaagtaggcttatattgacatctcttttttctcttccttccagaactgcagtgatttttaattattattgaaaacactgattgtaatggatactcagctgtgtagtttaaagaaacgttatggagcatcaggagacacccttcccactctccacacactgtatctcactgactgaatgtcactggagtaagatacctgctttcatttttcacccctaaggatttccctctgtaaaatgtgaagattctctctctctcctttcatacaaacaaattaactagtttttaaaagatgctaagagagtagattttaagtgttctcaccacacaaaaaaatagtaagtatgtgaggtattacatatgttaatttgctctatttagccattgcacaatatatacatatttcaaaacaacatgttatatgtgataaatatataaaatctgtatttgtcaactaagaaatttaaattgaaaaaaaaaaataagtagggcttcttccagttctgaaattctcaggtcttcaacccattgtgttagtttttctaattcaataagagggaattatgggcctgtctatcttattcttcttgttcacttcctaagcttcagtgctttatgaatgagcctcagagtgaataacccacatctcaattgttctgatttcttaaagtttatcatttcttctttatataaaaacaatgtctgtatattattaggttaactaaatatatttaagaaaagcaaactaactaaaaaatgaaataaaagtaaaatctgatagtgatagtgcaatgaagaagaataaagtagggtgagaagatacagataacaaggagaggaattccaaagatgatggtcatagaaggcctctccaaagtgatgacttttgagaatctctggaaagaagtgaggaagtaaactgtgagagtggaagaatggcatgcaaaactctcaacgacagacatcagccttggcatattagaacattgactggaaagccattgagctggagtgcactgagcaaggggactctagatgtggttctaagtctgatggcgagtgattggaggatgttcaacgggtccattctctgatctgactcatatatttaaaatattatgccattaattctgtccaaaatggtatcatggtggagtgaaagtgcaagcaggaaagccagttaggtggctcttgcaacagtcagggagagagaaaagaggagctgagcaagtagacaaaatcttttggttggattggatgtgcagtgtgagagaagaaggatcaatgatttttccaatgttctgggctatagatattaggtgcctggagtctttcgcagagatgagaaaaggcatagagtggcagatggatttgagagtttgctgagtttgagatacctcttaaagatacaactggaaatgttgagcaaacagacagaaattagagtctagatttcaagggaaggtagaagatggacctaaagttaggagtaataagcttattgaaataacaggtctggaagacttcatttagagagagggtttatatagagaaaaagcctatgtattggacctggacatctagagtttggaaagggaagacaagtctgatcaaagaatttcagggtagaaaaaaattattggtataaaagacaaaaccagtgtcaactttgaggatagaggtatttttaaaagcattttttctaagaaaggacaggaaacttaggactcagtaaaaagcaagtttcaaggtactgtgagaataaaaagatttccagcccaatgaaatattcttgggatagttcattctgagaacttttactatcataaatataaactgctcttcattgcccggtttccaactatcatatatatatcttcatttttcaaagcctctttatgtctcataccatcttattttcatagcaactcttacttaagagatataatacatttttcatagacgttttattgatgagaacgttgaggttcatggtgaagtggttcctccaaagtcataccactaatgaattatgcatcagctctgcaactttggtcttttgacttctacttctgtccactttgtatactacttatttaagcattttaaatttatactcataaaggttatttcttacaaagagcaattttacacagtcagttatacatacataaggaaaagaatgccaagaaaatattttcattattcatccattccatttaatcatccatgaatttatctgtacatctatcaattcaacaagtaatttctgggtaccctctacgtaggccagataccatgtttcatggacctacaaagatgagaaaggagcagaacttgttttcaagatggtcacatgtaagagggtatttttacacttttacttcttatagaataatgctaattcatagtacttctttgctgttggttagtattatgagaaatattttgagattttgaaatttcatcatgagttttaacttcttcagagtaataagttctagtttatggggattgcattttattttctcatttgaaactacatattataaattaataagatgttaggagagaccttgaatatcattaatccaacactttcatctgggacattaaagcccagagaagtgaaaagtggtttgaccaagccacagagctaatccattgcactgacattgaaagttacattgcttgttagagcagtttctcagagccctgagttttggccaaggatacttcctgattgccaaacgtttccaagaagtttatcttggaaattccatgagtttctcacccaagaattaattcaccaagccagatggcatccttggcaagaatggggtactacaatctaaattttgcaatcagagagggagtttgcatttcattacagaattcagatgaccagtgttcactgtgtgagtttcttatgcatttattctcatgcttgggagaataatgtattagtgtttccagacatcacccagatgttttcccttaatttaacttgatcatgaagccctttattaataatattagataaatcttgttaactgcttctgaaaaccgaataccaaacgaagctaactgtaatatatttgggagtttattatggtaatgtcagtgtcttaattcttacttgtgcaatgtctgcttcaggtttgggcccctctccagggtggctgtttttcatgctgtggctcagcatttcaaccccatatcaagccacactttcacaatcacttcaactgagtgggacgagctagaggtttaagtatcagcaaccagatgtttccatatggaaatgccacttaccacttttgcttacatttcattggccaaacagagtcatgctcagaccctgaggggaacaatagtaaagtctatcgtagctatcttttcctaacagaatggagatatcttttaaagggaataattgattaaaattgttgttctcattttttgccctcttaagaaaaatgcagcgatgaagaccgtaagtgcaaaatcaaagccacatagttaacctggagatagctgagcatttaccatatgccaggcattgtgcagagtttttcggatgttaccttatttaagttagatcacacaattaccttaaaagattgtgttattgttgccattatatacacaaataagctgagtttcaatgacttatctgaggttatatagctagcttaacaatgggtcaagactttctggtagcaaaaaggctaaaatgcctaacaaagaaactcaataataccattcttatcaattgaagcctattaaataataagtataatagccacacagaaataaatagagacttgccttttgctgcctgagaaaaagttcaccttcttttcaaagggccctccttcatgaccaggctatttagagaatttattgttgttactttcttttgataataactcctatattgccccaacaaatgtcttccattgttaccttaaattgttatttacaccactttgagagtaggaatcgtatctgcttttatcctgggttactatcaaaactgaacaaagtacctggcacattagcatgttcctcatgaatttattttttaagggattgtcacttcagctttgaagagaacagcagtatagaaaagagcattgtagacatataaaaatgactgctacgacccatctgatgattcttcctttgtttttgcattatgcacaccattacctagaattttaaatgttctctctcagcatgatgcttattatttaatcatggaagacatagagaaggagaatgggagttgaggaaaattttgccttgaaaatactcagtttgaatcactagtacttaattttcagcttggaggatgggagagcacccagattggaataatatttgagttgggtgtcaggcctgttagacagactggtgtaaatctcatttcacattgaaattcttcaagtacaatttagcagtctaaaaatttaggtacatgcagccaaaaacttcacaaaacctgcaggcttggaatgtcttcaaggaaggataaacaggagtgacaattaattttcttgaaggtcacagtctaagaatgatgcagtatcttcagaattttgacaacttggctgcctcataaaggccccgaaagaattcccaacaaatatttaatcatgcttctcagaatagagcttgctttaaaaaatttaataagatggatttctgtcttaaaatcatatgttggcagggcatggtggctcatgcctgtaatctctgcactttgggaggccaaggcggatggatcacctgaggtcaggagttcaagaccagcctggccaacatgatgaaaccgcgcctctactaaaagtacaaaaaattagccaggcgtagtggtgggcacttgtaatcccagctactcacgaggctgaggcaggataatcgctttaacctgggaggcagaggttgcagtgagccgagattgcgccactgtgctccagcctgggcaaaaagagtgacactctgtctcaaaaaaaaaaaaaatcgtatgctttttccctttttgattgacctaggtcatggacagccacttagagagttgaatatatttggagaaagcatgtcctggggttaagaggtcataaataaaatccatgataagaggaatctatcttaatttttctcatttccattttctgttcattcactcaggtcctaggcatgtcttaatttttttttccacatttttttctctttagttccaagtgtctacctctttctctataaaatgtagattgttcttcctcctttttgccttattaatttccattaatccatgagacttcaaccaatgcttggtgggaaatttctccacatccttgactgcagtattacccttgatattgcaggacagtctaattgacatgaatgttgcatttacttattctgaggcatgagtgattgacaaggcacagtacagaggcctcacagtcaggttttcttgtgagaggtaagataggtaagggagagaatccatactgagtatgtaatatacataagtagttttctatatattcatgtaaaataggtctcacaatgacactgtgaagtcaattctgtcaccctcccccaacctgtgtagttaagaacactggaactcaaataagtggcctaggtcaaaggaagcccaaatcccaggcaggagggaagttgtttttcaccagaagaagataaaattgtttctagtgtcaggaatggggagttaaagtttgttcctgctgtagaagagagattttgagtgaaaaacctattcaagcaatgagtgcaaatatgttcttctcctttgttactggatcaccctcactcgtgatgctgaagcccctggtttcaagtaaagcaataatcctgtgaaacagtgattttatggaataaaaaaatgtagtctagttggagacaattactatgcatttgctcattgtcaagttcttgagggaatttcagtttcaagttaaaaccaaggtaggaaactttgatctgtggatatgggcccccctgagacagggctgtagtggccatgtaaggagtgccagagatcagggtatagttatggcaaaggtggcaacttcctacttttcccaaaatgtctcacctatttagtcatagctatctttcactcaggaaacccattcaggtttatgctcagatttcactttcaccaaaaattgctgggacttaggcaaagcaaaaatagtagctcccatttgactgatgagaaaaatgatgtcaaaagaattttaaaggcttcctaaaggaataaaaatttgcaactgtgacccaaatccagaagttttggccagaaatgtattgtggtttttatgttatgcaaaagggaataatgataaaagaaggctttaaattgaatttaattaaaaattatataaatttgatataaaaaaggcaaatgtgaatctatctttaaaaatattaacattaaatatgaatggactaaacaatttattcaaaaggcaaatatgtaagattgaaaataagaggttttttttaattatactttaagttctgggatacaagtgcagaacgtgcaggtttgttacataggtatacatgtgccttggtggtttgctgcacttatcaacctgtcatctacattaggtatttctcctaatgctattcctcccttaacctcctacccccggacaggccctggtgtatgatggtcccctccctgcgtccatgtgttctcattgctcagctcccacttatgagtgagaacatgcagtttttggttttctgttcctgtgttagtttgctgagaatgatgatttccagcttcatccatgtccctgcaaaggacatgaactcatccttttttatggctgcaaagtattccatgatgtttatgttccacattttctttatccagtatataattgacaggcatttgggttggttccaagtctttgctattgtaaacagtgctgcaataaacataagtttacatgtgtctttatagtagaatgacttataatcctttgggtatatacccagtaatgggattgctgggtcaaatggtatttctggttctagatccttgaggaattgccacactgtcttccacaatggttgaactaatttacactcccatcaacagtgttaaagcattcctatttctccacatcctctccagcatctgttgttccctgactttttaataatcgacattctaactggagtgagatggtatctcattgtggttttgatttgcatttccctaatgaccagtgatgatgagctttttttcatatgtttgttggacccataaatgtcttcttttgagaagtgtctgttcatatcctttgcccacttttcaatggggtgttttttttcttgtaaatttgtttaagttctttgtagattctgaatattagtcctttgtcagatggatagattgcaaaaattttctcccattctttaggttgccttttcactatgataatggtttcttttgctgtgcagaagctctttagtttaattagatcccatttgtcaattttggcttttgttgccattgcttttggtgtttcagtcatgaggtctttgcccatgactatgtcctgaatggtattgcctatgttttcttgtagggtttttatggttttaggtcttacgtttaagtctctaatccatcttgagttaatttttatgtaaggtgtcaggaaggggtccagtttcagttttttgcatatggttagtgagttttcccaacaccatttacttaatagggaatcttttccccattgcttgtttttgtcaggtttattaaagatcagatggctgtagatgtgtggtgttaagtctgaggcctctgttctgttccattggtctacatatctgttttggccacataaatgtctgatttatttatttaactggtttattcatggctgcataaataaaccagtaccatgctgttttggttactgtagccttgtagaatagtttgaagtcaggtagcatgatgcctccagcttttttctttttgcttaggattgtcttggctatacgggctcttttttagttccatatgaaattaaagtagttttttctaattctgtgaagaaagtcgctggtagcttgatggggatagcattgaatctatgaatttctttgggcggtatggccattttcatgacagtgattcttcctatccatgagcatggaatgttttgccatttgtttatgttttctcttatttcattgagcagtggtttgtagttctccttgaagaggtccttcacatttcttgtaagttgtagtcttaggtattttattctctttgtagcaagaggcaattaaatcttgtccaaaggaaatatgctttattcaaacatacaaaagactgaaaacaaaaaacattaagatgctatagtacacaaatagcaaccagagaaagcctgaaaggactacattaatatcagacaaaaattgttttcaaatctaaaaaaagtaaaagaaaaaaatttgttaagaggaatattttataagactaaaataataaattaatcagaaagatatgatcagtgtaaaaatacatgtactaacaacaaagtccctaaaactcaaagcaaaaaattaatagaaattaaaaaaataaatatacaattaaacaatagtagttacagatttcaatacctgacttcaataatggatagaacaaacagattaacaaggatatggaagacttgaacaacactgtgaaccaactagacttaacagaggtttctagatcacttcattcaatagcagtagaatatacattttctccaagcacacacaaagcattttctaagatagactatattctagattataaaacaagcctcaataaatttacaagagttgaaataaaataaaatgttctctcagaccacaataaatgaaattaaaaatcaacagaaggaaatctgggacactgacaagtatctggaaataacacactactaaataagcaatgggtccaagaggaatttacaaaagaaactagaaagtattttgaggtagatgtggcatgccaaaacttagagcatgccgaaaaagtagtgtttcaagggaaatttatagctgtaaacagctagacagaaaaaggagagagagctcaaattaataacctaatcttccaccttaagaaactagtaaaagaaaagtaaaataaatctatgaacagaagatggaaaaaaataatgaacagagtgggaattaattaatagagaagagaatagcaatagagaaacaatgaaaccagaaattcattctttcaaaagatgaacagaattgaaagacttcagctagattgatcatcataaacaaagaagactcaaactactaaaatcataaataaaaaagggatattactactgacctcacagaaatttctttgcatataagaaaatattataaaccattgtatacaaactaattagataagttatatgaaatgtatacattcatagaaagacacaaattacaaaaatggactcataaaaaataagacaatctgattacacttataacaagtaaagacattaaattagtaacgataaaactttttatgcagaaaagcccaaggtcaaagagcctcactggtgaatttcaccaaacatgtaaagaaaaattactaccaatccttcactaatgcttcaaaaatagaagagagaacacttcctaattcattctatgagaaatattatccaggtatcaaaatcagacaagacattacaagaaaagaaaactacacgtccatgttaattattaatataaatgctaaaattctcaacaaaactagcaaatcaaatccagcaacatacaaaaatggtcatacattatgaccaaataggacttatcccagaatgcaagcttagtttaacatctgaaaatcaatgtagtatatcacatcaacagaattaaggacacacacaaaaaatacacgattgtctcaactgaaacaataaaaaatcttttcacaaaattcaacatcttttcatgataaatgcagttaacaaaatagtaataaaaggaacttcctgagtctcataaagggcatttattaaaaacctatagctaacattacacttaatagtgaaagactggatgctttttccctaagattcagaacaagacagacatgtctactttcatcacttgtattcaacattgtactaaaagttctagccagtgcaattaggtatgaaaaagaaataaaagtaatctatgttagaaagtaaaaagtaaaacaacctttatttgcacatgaaatgatcttgtatagagaaaaattctaaaaattacatctaatctattatagtttaacaggtactttatcaagattataacaagattaacatataaaaatgtattccatttctaaacactagcaattcataatccaaaaatgaaatttgaaaacaattccataacatcaaaaggagtaaaatatttatgatgaacattaacaaaagagaataaagtacttagaattaaattaacaaaagaaatgcaagacttgtacacagaaaactaccaaacatcactaaaaaaagaaaagatctaataactggagaaacattccatatccttgggccagaacatttagtattgtaaaaatggcaatactctttaacttgatttacacattcaatgcaagtactattaatcatcacagctgattgtgtgtgtgtgtgtgtgtgtgtgtgtgtgtgtgtagcaattgacaaaatttatatgaaaagtcaagggacccagaataaccaaaacaatcttgaaaaaagaaagtaggaagactcaaaatttccatttcaaaaacttaactacaaatctatagttatcaagataatgtgatactggcataaggctagacataaagatccatggaatagatttgagaatgcactgataaacatttaatttaatgtcaagcgatttttgacaggaatgccaagacaatctaacgtgaaatgaatagtctgctcaacaaatagtattgaagcaactggatagatgtatccaaaagaatgaattggatccctactttacacaatgtaaaaaaataaattcaaaatggattatagaacttaatgtaagggcttataaaactctaagaagaaaacatagaagtaaatcttcatgatcttggagctagataatggctccttacatttaaaacctaaaatataagcaataagaaaatagataagttggactgaattaaaattaaaaacttttgagtgtaaaagaatacattaagagaatattacagcaatccatagaatgggaaaaaattgcaaatcacatatgtgataacaggattgtatctggaatacataaagatacaagtatcttacaacttgtatctttatctacaaggatcttataactcaacaacaaaaagacaacctaaataaaatatgggcaacaattttgaatagatatttctctaatgaagatacacaaatgaccaacagcatatgaaaagatggctcatatcaacagtcttcacaaggaagtcttcacccccactaaggtgactagaatcaaaataacaagcaataacaagcatctctgcattggcaaggatgcagagaaattagaacccatgtatatataaaaagtggttcatccgatttgaaaattgtttgtcagtttatcaaaatgttaaacctagaaatgctgtatgttccagcaatgctacacctaaatacataaccacacaaaatgaaaatatatgtgcacacaaatcatgtacatgaatgttcataggagcattattcacaatagccaaaaagtacaactcaaatgtccatcaactgaggaatgaatgaataaaatgtggtatagtcttacaatggaatattatttgacaataggaaggaatgatgctctgatacatgccataagatggatgatccttgaaaattttatgctaaataaaagaattaagtcatgaaatacctcaaattgtatgattttattttatgtaagggcaagaataggcaaatctgtagatacagaaagtagattggtggttgcctgtggtgaggtatgtggggctgtagtgggggtaagttgaatagaactttcttcagtgatggaactgtttatatctgtgctgtcgactatactagctgctagccacatgtgactaatatgcatttgaaatgtggctagtacacctgaggacctaatatttaattatttaatatttaatgatctccttgcttatgccccatggcaaggtataccaaaatttgagaattttcttcttcagcaaaagaacacttttttttttttttttttggaattcagagttctgaaagggagcgagtcaattttcccaaggattccacatcaaggagaaggactaagtccctaaaccattctctgagagatccaaatttagggaagccgacaatggaactcaccaaaagtcatggagaagtaaaatgttaatgaatgaaattatcacgaagaaataaagaaatgaatgccaagaactgaccacttccatgaatcagtgaaaagaacctgggaatgaagtttctgaggtttaagttagtttctacagatcccatcccagctctcctaggggcaacctgaggaagcctgttgactaatcaaataagctttaaccttatacagcaatcttgaccagtgttgtgtaaaactcttaattggccatgtatggtatcatctgctctggaatactactggagcagttacatgctcttgggccttagcttgagttatatttctttgaacaagccctgaacaagtcttcactccagactgagatttctcaatcttggtactgctgatacttaggactagataattcttcattgtggaggctgacatgtgctttgtaggacatttaacaatatccctggtctctgcttagtagatgtcaataggaccacctgtcatgataatcaaaatgtctgatttggtcactccacaatgtgtgcatatattgaaacaccacattgtatcccataaatatatataattattatttgtcaattaaaaataaaaataaacaaagaaacaaaaatgtctccagatgttatcaaatttcccctgggggagcaaaatgactccggttgataaccactgctctagatagtgctccttccccaaggagagttggggccaaaatgccaaagccttataaaggtatccagctcagtgtgggctgacaaatattttgacagaggaaaaacaagaatttggaacaccaaagaaacagaaatgtaagtaaccaattagaaaacatgtggaagtgttataacagcatgaacaagctcaccatagaatcacagagctaggagtgattgattctgccttgagggagaggtaggcatagaaacagcttagcagggaacgtgaaatttgatttggaccaagaaggctgagtggataaagaggagaaaggcactgtcggctggaggacaaagaaatgagtaagggagtggagtcttgtggattgcaggcagaagggtgtagatgccggagaaggaaaatggtggcaaataaagaagctgagggggcctattattattatttgcagtctttattttagttcttccttatacatagctcaaagtttgtctcaggccttgtttattcatttttcctcatttcctagtgaatgaaaaaagtatatcaaaaccagaagggacccttaaagtccatttgacaaaatcaagaaggatccagaaaaagagatcaatgtgagagaagagggggtttctgtttgaatttctgcccaatagcagaaataatttttctttttacctcctttctttctgtcttcctgatcccttgagaaattcagaccctcttgagcaaatgcttgctagggcctaggaaaaagtaatctgaattggctctttagaatctatatttgtaggaaagggtatgaaagttcttcacccatttaaatctgaaggaatttttaatttgggtaattatttaagagaattgttataaaagcacaaaaaagctatttcctgcttttaggaaagaatcacatctgtagttacttcaatgtagaaaaaataaggatgggctttcaaaattttcacagtctgggtgtaggcaaaacctcatttcatttgacaacacatgtcttttaccttttaagtgaggacagcgataatttgaggtatagcatttgttgtatcaagttctgcactttgatgtttgtaatctatgcattgcatgttcattaataatgtttggtgaacagtactacatactgcacttttctgcattgtggagtacacagaaaaaaaaaacaagatatggctcttaatgtttagaaacccacaatatttgatttttggataataatgctgtatactgtatgattgcacccattttgtaacagaagataggtcagataaatttaaatatttaaaaatattcaactatatttagggacagaaaagaggcagtgtagagcaggtattaaaatcactttaaaagccagattcaatcttggcttctctgcttatacaatttgtaactcattgcttaaccttgtcaaacctcagtgcccacatttacaatgtgaggatgttaataccatttatctcctgagactatggtcagaataaattgacataatccatgtaatgtgtttaaatgaatactatcttgtttatttgtcatacctagtacggcagctccaatttgagtcactacttggttaagcttacaataatccactgtctttcttcaagatgcatctgtcttctctacaagtcacaaaagggagttgaaaggagatgtggtgggaatcaccatccctgcatcttccaagtctttgatggcgggactaatgtctgcaatttctctaggaatgccatatttcttttgagttactaatttcctagggggaggcagttctaatggcttgtacttggcctattccaccataatagccctcactccacagttcagggaaccaatgtggcaattatatgagttgatgcacatctggaactggtgaaacaaccacaagatgagtttggggactctgtgcgtccactgtgagtcagatctgagcttaaacttcactgatcatctgacctacgtactctcaatattactctgattggagggccacagtgatgttttgggttttctggaacaagtgtcagtacagagccactgtccagtagtccctgaaaggtctgatggtttttcccaatgcacaattaccctggaagaaggctgggagaaacataaacagtatacattttttggtagtgtactgggtttctttttcgaggggatgcaggctccctttcattcaaagggttctgggactgtaaagtacctcaagtctggaaattaattcagcgggcgtgactgttttttactactcaaattagattcttgttcacttgtactaaaacttttctgcctatacgtgtcaggtagtaacctaatagacttactatctatttcacttctcagaataccatgattaaccggctgatgccacaggtctatatgagtcagactctgattgctgctttgactctgttgtccattagagaaacgacacccaccttgtctttggcaattcggtgctatcacttagctgctaccaccccaggatcagattgctcccattgcatttggcttttccaatcaaatggctgggattcccatggaaagacctggccttcaaagaagaatgattgctgtgttcttaaaggatactgaggctctctatacaaatttattttgcaaagtattaattaggggtattcagtgcagagaattttgcatttctataaacagtttactccatgaactatcagtgttcttttaactaatggaaatagccatttggtatgtcttatggcctctcctggtgtaggtatttattaaatgacaaatctactctaacattccagtctctttaagcctttgaatcccttccttaaaattaagccaaagaaggtcaggcgtttccaatttgcttatggtgggacaccttttgattcatgttttagccaaccaaccaaccaaactgttagagccctttctaactttgtgagatacaacattaaatgcagactttctgcttagtgagcccacatcaatattttcaaactgatcgaactttctattctttccataattatcccacaaccttaatatccattcccatacatgttccttgattttctacttatgtaaattaaataactcaagtagttcttttggactttgtacctcacctttgggggtctgctgggatttgagtctagttataagtctagaagcaaagacaggtgctgggagtgggtcgggggggggggaaatcagcatgtcttgcatggtaactgcttcaggtatggctataactataaatatttccttaggcaatgcaggtttagttccctaacatggaggtgaaaaggccaataccactgtgggtggggagggcactatccaccaggggtggggaatgccactgctgtgtcagagaagactcatcagaatgtaggagataatgttcccagcttcatcagtgtcttcacacatgtcctcctcctaacttatattatcccattctttctcaattaatgcccttactttaatagcagacaccttgtgagactgaaagctcaactttaaatttcaattcagccaattgcaggatgaggttctgtgtttcattttctgcaatttcagccctgcagctacagtagataaggcttttcctcaggacacatttagaaattctaaggtcatttgtgcagtgctcgagctgaaaatttgaatgcccgagctcacttttttctttcaccactttgtccagcaatattagaagcaagcaaccaatgtcattacatttttgttttccaaaaatgttcaaaagtatcatatacagagtcacttgccttctcacttcttataagtgattaattaggggtattcagtgcagagaattttgcatttctataaacagtttactccatgaactatcagtgctcttttaactaatggaaatagccatttgtgtctttaaagagtttagaaagacaattgcagaaatttcagaaccaattctgaaaattctcatccttaaaattttgttactctagaacctctaaaactactcttggtaccatcatctgtattagtcagagttctccagaggaatgaaacaaataggagagatagatagatggatagatagatagatagatgtagatgataattatagataaatatagatgatgatgatgatgatgaagatagatagatagatagatagtagtataatagggaacttattagggaaattggctcatataattattgaagctgagccattccatgatctgccatctataagatgaagaaccaggaaaaccgatgatgtaattcagactgagcctgaaggcctgagaaccaggggtgctgacatttgagggtcagagaagatggatgtcccagatcaaacagagagagcaaattcatccactctccattttatggttctttctgggccctcccttgactgattgcataacaccttcccacattggtgagggtaatattgtttactcagttggctcattcaaatgttaatgccttctggaaacaacctcatagacacaaccagacataatgtttaccacttatgtgggcatcccttaactcagtcaagttgacacataaaattaatcatcatactaacataaagtgaatttaaaagaagctgtaatcacttttgaggatgggtttggtgaaggcctggagttttcttgcttgaccttttacaaaaggtatctttcaagtgcaataagcattaaagggatcaagttcataagaagctgggaacctacttacacttatataagatggtaatgatatttatcattgcctaggcagttatttaccctggagataatatttttagggaactgatatgagttaatcctatgtgcaaaagctggcaggtagggtgagtatggctacctgtgtggagggaagtaatgtgggtgacactggatgagtggttgaaatatttgatattaaaaatccaccatatgctatagaaactttacttctgctacctcattgtttttcagtcctgtgggagggtttcatgcatttggagcacatcttaaaatgcaaatatctatgtacactatgccaggtactggtggatagatatgtaagttcaccatcaccgacaagaccatttaactaagtttaacttgattctgtttagctctgcttagttataaatatatttacaagacagattcattcttaggactattcattaatttgtataacatattctgttagcacctaccgtattgtgtattgggttatggatacatacaaatgaacaatgcattgtgttttagaagcaaccatgatttgaacatataacagattaattaaggttctggaataggagtttaaagagaatactatgggagtggaaggctgtgacagaaggtagagggaaaatatgaaattgaacacaacatggtttctgtcctagaaaggaaataaagaatcttagcagagggacaagcacagcatatccctatcccaaatgttccatggcctacctaaagtaactttacgtaactatgagatccctactatgtgccggctttaaagtattcctgattaactaagaccctaagactgagaacttctcctcaagaaactcattatctagatttgaataggaactttcaatgatgatatccaaggatcttgcatttgtcttaaaccactcttattagctttgcttaaagccaacttgaaatctgaaaagctagagtgaccttgggcaagttatttaatcgctccaagactccagatctgagaaatagaaatgatagcacctttgttggggtttgttaggattaaattacctaatacacaggagggatagcacaatgcctagtataaaataaacactcaatatagtggctctgctactgattttcacataattggacttttgttctttcccaaatattgcccaatagttttcaaatttccaaataactttgaattttccaaataactttgctcatcttattcctctttcacagtgaagtccattacttatatctgccaaacttgtacttaccctttaaagaccacaatgggctctcagatatggtaaacaaaatttaatgtacctctgccaataagaaatgaatatttattcttaaagcagctctaagataactttgaagaagctatcttgcttatttgttattaagatgtgacatcgacatctactcaggagaaaagggagaatttaccaaatgtttgaggtgtcccaataatgtaggggcactcaagaagacacaaccaaaatacctgatgctctaagaagtttcaattatacatactctatcaagatatcagctagttatgttatgaaatagaaattagggattaagtaaaatgatatttttgctagtattctctctcaaagaccaaacttttcttttgcaaaaagaaggccttctgtagaagtgagatgatgcttaggaatagtggctttggttgaatattaggattacaagaaactggagaaatggagagattaatgggtgaactaacatttattgattgactatgaagtgtcatgcataatttcactaaattctcagccttaaaacatggaaattatcatctctggtttcatatatttagaaactgaagttaatagaatataaaggtctgccaaggcttgttgtcagatctaggaatgagaagatttgaacctgtgtcagtaagactctgaacccatactttttgtactatctcatttcttcctcttgttttcaacaactcagaaatgaagaatcaatttctattctctgtccttatactatattttctttgtaccttcagagtaaaatgggatgtggctcagaggagggaaagaggaggtttaagtggcactgtgtgggtcagaagcactctcaaggtgtccttatcctttttgcatttcccccaatcttttcattggaatgtgatttgaaaggaattagagtagtcctcctgtactaatttttattgctcactgcagggctacagggatgtttactctacacagtatgcctcttccctgatgcccttcatatctttttttttttttttgagatggagttttgctcttgttgcccaggctggagtgcaatggcaccgtcttggctcaccacaaactctgcctcctgggttcaagcaattctcctgcctcagcctcctgactagcttggactacaggcatgtgccaccacacccagctaatttttgtatttttagtagagatggtgattcaccatgttggccagtgtggtcttgatgtcttgacctcgtgatccacacacctcgacctcccaaagtgctgggatcacaggtgtgagccactgttcctggcctcttcatctcttttttttttcttttttttttttttgagacagggtctcactctgtcactcaggctggagtgcagtggcatgatcatggcttactacagcctcgacctcctgggctcaagtgatcctcctgcctcagcatcttgagtagctgggactacagatgcatgctaccatgcctggcaaatttttgtagatttttgtagagatgggggtctcactctgttgcccaggcttgtcttgaactcctgggctcagcgatttgctcacctcatgacatggtttttctgtgtcctcacccaaatttcatcttgaattgtaactcccacaattcccatgtgtcatgggaggaacctggtgggaggtgattgaatcgtgggggcgggtctttcctgtgctgttctcgtgttggtgggtgagtgccacgagatctgatggtttcaaaaaggggagtttccctgcacaagctctccctttgcctgctgccctccttgtaagatgtgacttactcctccttgctttctgccataattgtgaggcttcctcagccaagtggaactgtaagtccatttaacctctttcttgtgtaaattgcccagtctcaggtatgtctttatcagcagtgtgaaaatggactaatagagtaaattggtaccaggagcagggcactgctgaaaagatacctgaaaatgtgaaagcagctttggaacagggtaacaggcagaggttggaacagtttggagggttcagaagaagacaggaaaatgtgggaaagtttggaactttctagagacttattgaatagctttgcccaaaaagctgatagtgagtgatgtgaacaataaagtccaagctgaggtgttctcagatggaaatgaggaacttgttaggaactggagcaaaggtgacccttgttatgttttagcaaagagactggtggcattttgcccctgccctagagatttgtggaaatttgaacttgagagagatgatgtgaggtatctgatggaagaaatttctaagcagcaaagcattcaaggggtgacttgggtgttgttaaaggcattcagttttaaaaggataacagagcatacaagttcagaaaatttgcagcctgacaatgcgatagacaagtaaatcccattttctgaagagaaattcaagccagctgcagaaatttgtataagtaacgaggagctgaatgttaatctccaagacacccagggtccccatgctgtatgcagcctagagactttgtgccctgtgtcacaccgactccagccatggctgacagggactaatgtagagcttagaccgtggcttcaaagggtgcaagcctcaagccttggcagcttccacatgatgttcagcctgccactgcatagaaatcaataattggggtttggaaacatctgcctagatttcagaggatgtatggaaatgcctggatgtccagatagaagtttgctgcaggggcagggccctcatgcggaacctctgctagggcagtgtggaaaggaaatgtggggccagatcccccacacagagttcctactgggacactgcctagtggagctgtgagaagagagccaccatcctccagaccctagaatggtagatccaccaacagcttgcaccatgcacctgggaaagccacagacactcaatgccagcctgtgaaagcagccgggagggaggctctactttgcaatgccacagaggcagagctgccaaagaccatgggaacccccctcttgaatcagcatgacctggatgtgagacatggagtcaaaggagaacattttggcactttaaggtttgactgtcctgctggattttggacttgcatgggcctgtagcccctttgttttatccaatttctcccatttggaatggccgtattcacctaatacctgtacccccatcatatctgggaagtaattaacttgcttttgattttacaggctcattgatggaagggacttgccttgtctcaaatgagaccttggactatggacttctgagttaatgctgaaatgagttaagactttgcgggactgttgggaaggcatgattggttttgaaatgtgaggataagagatttgggaggatccagtggcagaatgatatggtttggctgtgtccctgcccaaatctcaccttgaattgtaactatcacaattcccatgtgtcgtgggaggaacctgatgggaggtgactgaatcatgggagtgagtttttcccatgctgttcttgtgatggtaggtgagtctcacgagatctgatggttttaaaaacagagtttccctgctcaagctctctctgcctgctgccattcatgtaagacatgacttgttcctccttgccttccaccatgatggtgaggcttccccagccacttggaactgtaagtccattaaacctctttcttttgtaaattgctcagtcttgggtatgtctttatcagccgcatgaaacagactaatacacctcggcataccgaaatactgagattacaggcataagccaccacgcctggcctcttttcttaaatagaagtttcaataggccaggttgcaggaaattgaccaggttacatttgttggagtgcaagatcattgtgggctaagatgtaacatatccttacctagctctctctttcttccttttgtcttaatatgttgaacaggcctctgttataggtgtccagtcaaaatgtaataaggtcctagtatttgcattttccttggagggtggagtaatcaatgatcctatttattgtgtgaacctaagtgaaatgttctaaagcagctttacaagagctctgatttttaataactgtatatgggcccagctattaagaagaagtggtatgggttctcatttgtcaattcttcttgagtaagtacccctaaataaacttgggcactagatgttggatggttgatgggataatacccaagaattccagacacccctcaatctctgctctctgagattccacttttgggaaacccattgtctggactgatatgacactgagcaaaaacatcactgggagaaaaacaccagggccttgaagggagctcagtaggggggtaagaaaattggtctggtaactgattctccttccagggttctcaaaatgtccttagtttgtgggaaagggctggttctggcataccaagccaacctagaaaatgatttctgagcatatgactatgaatagacagattcaaacttgaagtttgggaattggcaggtatttaaacaagtagagacatacagtagtggtgaacaagtgtccagcagaatgggtaagacaagtgttcaaaagagattcatgtggccacaataaaataatagtgctgatggggtaggagggctttataatgctttcttttccatctggagtttgagaagaagggctacacttatttgggttgagtgaacccttgacttctttggataatgtatatttgtaaagagaggcatgtgagaattcaaccaattagtggaaatcataaaaaatgtggtttcatctatatcttaagttggtagagcaggtcaggcaggttactttgaatctatagtacctgtaaagcagctaagtaaagatattgaggaggaaatagcataaatgagaatgtccagagagagattaaaattgaaaatagagacttaagaggcttattctcttcctatttgcatgtcttttatttctttctcttgcctcattgctctggtattttttttttctcttgcctgattgctcatagatctccgagggctatgctgaaaaggagtcataagagtgagcaaccttgtcttgttctagttatcaagagaaatgcttccagtttttcccattcagtatgatgtggttgtgggtttgtcatagatggctcttattatcttaagatatattcctttgatatttagtttcctgtgggttttcatcatgaaatgatgttgggttttattgaaagctttctttgtgtccattgggatgatcatatgatttttggttttaattctgtttatgtagtgagtcacatttattgatatgtgttttgttgaaccaaacttataatcaaggatgaagccaacttgatcgtggtgaattaactttttgatgtactactggattcagtttgctagtattttgttggagatttttatgtctttgttcgtaagggatattgacttttaattttctttttttgttgtgtctttctaggttttggtactagggtgatgctggctacacagaatgagctaggaatgagtcccatccccttgattttttgaaatagtttcagtataactggtgctggttcttttttgtacatccggtagaatacggctgtgaaaccatctggtttagaacttttttggttggtaggttttttattactgattcaatttcagaacttgatattgatctgttcacaatttcaatttcttcctgattcaatcttgggagatcatgtgtctccaataacgtatccatttcctctagattttctagtttgtgtgcatagagatgttcatgataatctcagaggaacttttgttatttctatgggattggttataatgtcacctttgttgttttttactgtgcatatcgaatcatctcttttttttgctaatctagctagaattcattgatcttgtatattctttcaaaaatcaaacttttggttttattggttctttgtatggatttttggtctaatttcatttagttctcctctgattttaattatttattttattctgctacctttggggttcgtttgctcttgtttttctagttcctctaagtgtgatgttaggtcattaatttgagatctttccaactttttgagataggcatttagtactacaaacttgactcttgcttttgtgctacaaacttgttcttttgctttagcacttcttttgttcagtgctataaacttgatgattttttatttatcccagaggttttgaaatgttatatctctgttttaattttatttcaaagaattatttgatttttgccttaattttattgtttacttaaaagtcttgtgggagaaagttgtttttttccatataattatgtggttttgagagctgttcttggtattaatttctattttttactctgctgtattctgagagtatggctggtatgattcagttttttttaaatttattgagacttgctttatggctgcatatgtggtcaatcttggactatattatgtgtacacattcgaagaatgcatagtctgtagttcatgggtgtagtagtctgtagatgtttattgggaacaattggtcaagtgtcgggtttaagtccagaatatctttgttttatgactcagtgatctgtctaatgctcagtgagattctgagatataccactgttattgtgtggttgtctacatcttttcatagatgtagaggtacttgttttataaatctgggtattccaatattgagtgcatatatatttaggatagttaagccttctggttgaatttaatactttatcattacataatgtcattgtttgtccctttttactgtagttggtttatagtctgttttatctgatataagaatagtaacctctgctcttttttgttttccatttctgtggtacagtttttattccaaccctttactttgagcctatgggtatcattacatgtgagatgagtctcttgaagacggtacacaggtgtatctgtatttttttttttatctgacttgccactctgtgacttttaagttggacatttagaccatttacattccaggtaaatattgatatgtcagtctttgatcctatcataaagttgttagctggttgctttgtacctttcattgtgtggttgctttatagagtctgtgggctatgtacctacgtgcatttttgtggcaacagttactgttctttcatttccatgtttaaaactcccttaaggatctcttgcaaggctgctctagtggtaacaaattcccttagtactagcttgtctggaaaagattttatttctcttttgcttctgaagcttagtttggcaggacatgatattcttggttggaattttttctttaagaatgctgaaaataggcccccaatatctccaggcttataaggtttctgctgagttcactgttagccttgtgaggttctgtttatatgtgatatcacatgcttttctagtgcctttaagattttttctttattgttgatctcagatagtctggtgagcatagccttggtgatattaattttgtgtagtatctcatagatgttctctggatttcttgtatatggatatctacttctctagcaaatttccttgaattatttcctcaaatatgttttcctgattatttacttattttcctgctctcttaggaatgccaataatttgtaggtttggtcactttaatcatcccatatttctcaaagacttgtttattttatacaattctctcttctttgtttttgattgagtgggttagctcaaacaaaccgtcttcaagtgagaaattctttcctctgtttggtccaatctatagataaatgtttctattctattttgaaattcctcaagtgagcttttcattccagaagctgattgatttctttttaaggtgtttatctcttccttaatttttggattgctttagaagtttctctgtgttaaaacttttcaacctcatgttggatctcattgagctttctttcaatttgtgcttttatttcctatttgttttgactgagtttccattttcattaggaaccattgctggagagctggtgtaattctttggtggtgtcactacattcagatttatcatggtgccagaattcttgcccctattccttctcatctggaaatgctggcatttctaatttctagaattactttcgtgcaggtaggattcttttttctttcttttcctatgatagtattgcttttttttctttcctttcttccctccctaggaatgtgactgtatagagtgcttggtagggtcttttggcttagcttctatagccctatgcacttctttcagtagattttacattgtgctatacagttcaatctacaagttgatagaggaaatttatagggaagagctggccagaacagctgggtatgtacttgatccttgtttactggcagaaactctctgctgcctcttgcaataagctgattcatggaatacacagtggtctgagttcctgctccgccccagggtagcaggggccacaatggatagggccagacaaagcaggtctgcctacaagtcccccagtggctggcacaagtgccaagggagaattcattgtgtggccaccaatcacccagaagtgtctctaggcatggagctggaaaactttctcagccccaagttttctatttgggtaaggggttcacctaaaccaatccaggacagtgggtgacttagatttctggatatctgcctgagcatggagtagggaggcacccccacccctgcaccaagatctcttcacaagaggattgggcaattcaggctgctgagccagtcaagcaggtattctgaatgcctggagatctacctgggaatatagcagagaggcccctgtgccccccaccccagaatctttgcacaggaagggtggagtggctcaggctgctgatccgggcaagctggtactctgaatgcctggagatctgcctgggcatggagaagagaagggctcgctgcaccataatctatgtccagaaagggcagaatggctcaggctactgaaccagatgagggagtactctgaattcttggaaatctccctgagtatgaaggaaaaagggcctccttgcattaggatcaatacacaggaagggttgggtgggtcaggatgctgatctaggtgagcaggtactccaaatatctggaagtcagcttgaacatggagccccaccctgacccgccccaccctgcatcaccctgcatcaagatctcttcacagaagaggtgtggtgactcaggctgctgaaccaattaagcaggtactctgaatgcctagtgatctgcataagcctgtagcagaaaggcccccttacccctgcaccaggatctctgcacaggaatggtagggcagctcaggctgctgatccaagcaagctcatgctccaaatgcctgaagatttgcttggccatggaatggaaagggcctcactgcaccacaatctatgtctaggaagggtggggccgctcaggctgctagttgaggtaagtgggtgctctaaatgcctggattttcacctgggagtgaaagggtggatcagagagggccctgctgcaccctgatctcaggggagaagagtggggcacccagccatggcacacacagacaggtttcaaatcaccaaactggctctggctgtaagtctctctgtccagaagaaactgcagctgtagcggctctcttatcattccagacttgcagcagggagagcacaattctagcatcgactgctaagtcgttttccacagttctggctgcccaggcccccaccctactccagagcaggtgctccaatctctggcccaagactaaaatgcctgcatggccacaccgctaggtggtcaagaatggctgactttgcccatttgggttaaaaatgatgccctgctgtatttccagatctgggaaaattgccagatctgagaaaagcaatgtcttcagcttttcccattgtctttccttcacagtatctccaagcctctccccaggttagctctggggctcaggagaaaaaaaaagtgctctcccttggcctggctttctttgatccccagtggaaatgtgagtcacagagggaggctctctgcttctctcacgtataggagattcactcacttttatcatcctgatgccatcatgagggttgtttgctggcattctccttgccaggatctggagagtccttcatgtttctgtggattcccattttctttcttgaagtaaagctaacagagttgatctttattcactcttgctatttccaagtggctgctgcacttagaaacatccaatctactaccctgaaaaaatgaaaacacttttctaacatattatctctgcacctttcacttacctgcgccaatacatgcttttgttgcttacatcagttggtgttggggttttggtttatttgaatccaaaagagcttagagctcttttgtcaatgggattttcacatagactttgataactctcagattgtggcatccttagatatccttggtctagggagctggatggctgttgttgtagaatggataaggtaagttgcacttgtagctgtctcatatgtcatttactaataagtaccaccgtctttgatacagtacaacttttataagtcaagataccttaaccacaatagtaaatttctaaatagatgcattgttaattaatgtcatagatggtctttctccatgtatatatcagttcacttaagactataaacttgagaccagatcggatgaaactataactgttcttccatgcaaatctctgtggcttctctgtaaaggaatgccttttacaactgtacactgggtgaaataactgtatggaatcttactcaggcttcaaatggttctcactaagtgttctctaccttcttacaaaactttaagtaataacaatcttcaaaacgctaatataaacctctagatgccttctgatctcttaggagctgtgagcaaatgttatgctaacatgctctgttacagctgagaaaatacatcaaatttgctagtgaaccacgttattgacagagctctgggaattcaaccccatgagcctcagaagttagaaagcagagcaaagcttatgctagaaaaataaagtcctttgactatggccttgattttttaattataataccctaaaagttacaattttattcggcctactcaccaggcatttaaaaaacaggattgctgcatcttgcttttaaagagcatgtctgcatgaaaacatagtatgcctccacctcctgtggaactatctagtaattcaaaggcatatttcatctgagttgtctagactgtcattgccattggaaaattaaaaataaaaatgttcagttcttactgtgctgcggaatgcaggaatgaggatactcagagagcccataactttaaaagtacaggccacaattccactctgaaaacaaaacaagcccaagagtgtttgctatgactttataaaggagctttaaaagatttagagttaaaataaaacaactcttccagaactggaggtatgggacccataaccagtgtgtgcgctatctatcttgtcttccggggagagttgctaggcaggcaaggtcacataaaatcccattggaataaacttcttgatatgtccaaactgtttgattgtaatagaatttggggacaattattgtgctgctagaaatcacatttgaaaaactgttagggccggagatgaaatagaacttatccatcttttctgtagttaaatcagtgggagaagaatcttgagcctaattcattcggggaaataacatgcccagccaacctgggaatgactccagctttggaattaaaaagacctgggctcatatcttagctctgtcaatttccattaggttatttaaactctctggaacttacttttctcatagataaaatagtgatacctatcttagaatatagtaataatggttaaattgaatcatgtatttaaagccaatatcctggtaacagatactaacaaatgcatataaatgatagttatggaacacgggcatgacaacaagcatagtactttccagattcttttctatcttttagcttcaattattcaggagggaaatagaccattttgtttaactttaaatttgggatttggggaggattttgcttagaagatagaggtggggaagatagaggaagttttagaggtaattgctttcaacttttgctctgattttgaattcaggacaatagctttattcacttatattaaaaaatacttataatgtgattcctatttgccagattctgtcttagtcctgaggacacagaaattaacaagctggataccatcttcggccctgtacaacttgctgtaaatcatgggacatggatgttaacaaagtaattgcacaaataattgtgcacaactgtatcaattgctatcaagggaaaatattatgtgttcggagagtatttaatgaggaaatctaatgaaaagcataggtttctatttcctgaagtaagattcatccccaggggaaatgtgaaggttgaagagtttttcctcaaaatgctttccaaaaccatgtggttctcttcctagttgagggaactagtttcttgtagtcctttgacaatgactctgtattacttatctttgcattcccagaacttaagaaaggtgctggttatatcatctttggatatatccaaagagtggaatgggaaagtgactaatgattgtccatcttatttatttataatacacagaaattaaggacatttccatttctatgtaatacaaccctccagctgggcactgaccgctacccaaactgtcttatctccatcccctcacccaaggaagaggagttcctcagccacccctgtgttgcctctttctgactcattcctttgaacttccacctgttagataggcctagagttctcttatcagggcactacgcatgcttaaaccttttctaaatttgccaaactaaatatcctatagctgattgaggacgcttggtcctcactaggaatggtgaaccatgatgaggatgaggaataatggtagagtacaaggaaaaagagagaaaagctctatgatatatgtaattttgatcttggtaattcctgtttaatactgcatttcccttccaccaaaatcattgctggtaaatttattgagcaaagtaaaataaattatagagcattagagttggaaggaaccttgaagtttgtatcaattaggtttctgataagtggcagaaaacatttcagaaaacataccttaccaataaggtactgtattagttgactcaagtgttaaaaaagaaaacagtctggaggtcctgtctagtactacattgcctgatcaaagttttagaatctggcttctatctcttagccacattgtgaaattgtggaagatactacagatttacctgctcaatattcatgcatgtttttctaggatgtcttccgtatttcaaactatgtaaaactccaaactgcatttctagtcttccttctggctgtgagtagatacgatttgagttgtgccaaaccatggcattttcatgggacacagatttgaaactggatgaggggtggataaggttgatatgttaggcatccatttttatggcttctattatggctgaggcaatgtggtccatcagtagacaattcctgagtcagtgattttctgtggtgggggtggaagctttcctgatcacggtagatgcagcccaggtctgtggtcagtagattcttaatttagtacttttcccacattggtaatggaagttctcacaattacagcagagataatgtgattctgaatgctaggaagttttctgggaagtccagcctatatctagctcttcacctacctcacatttggtaggcttcgatggaactctccttctgcttaaactagttatagtagtttatattgtctgcaactgacccttatctgatctgactttattcttaccttctgtgtaggaagaggagggctgtaacaaacacaagccatatattagccaagattcaatttcataggaaaaacacacgcttgcctgagtctcattctgtccctctcaaaaattacaactaaagttttatttgaactgattgcctccaaatgggtcatgtgcccaatttaaagaaattactgggaacccaggacagcattaccaccttgagtcacatgttcatcattggtgatgagacagagtgtattccacgtggcaaaacactgagggattaggagtctgttttcatcaaaggcatgccataaatcagcaggtcctagaacacaatgctactatcactttccaatcactcagtctttgcaagttgatagtgtacaaagctgactt

SEQ ID NO: 611 - DNA, 81044 bp, Homo sapiens
ataaatggcagagagaagatttgagctcagacttgtttgagtctaaaggtggtgacccaccctgctccttccaaccacatggcgggacctactttcttgctgcttccccctgaactggcaatgcatggggtaattttggagaaaaaagttatataagcaacgtaacatatttcagatgcacaatatgtctttgcagcctgagattattttaaaccaactatgggaatgtgtattagtgaacacatatttgagctgacagatgggcgtgggcacctttgtcactcataaatagagcactttgaccagttgtggaggaaactcaagtgctggaacgtacaactcatacttatttccggcctatacaaccttttctgagcccctaagagtttctctctctctctctctcacacacacacacacacacacaccccacacacgtgccattagcaagtttgcttatttgtgtaagaaggattaatataaaataattgttaaaattcaggcacaaagcgacttcccagagctaacgtggtgctttggtttttttattgcattccttttcacttaacctgaagctgaaagttcacatctgtgtggcgggtctttcttcagggtatttctgtctagatgttttgcaaagtatctaacacctggaaatgcgatgcacatttctgtttgctcctatggtacttcgtgcttacgtcttcagtagcacgaactataacataattcaacctgtttctcccttcctgtatctagaatgtaaacttctccagataagacattgtttcaattgtcacctgtgttcctagtccatatcgcagcatctggcacttaagcacatttaaaacaagtgaacaaaggaaattcctggtatggagtgattgttggattctttgcctgtggttggatacaggctccctccaaagacctgaaaaggccacatgcagatgagttagaactccctggtagaagtagagttgaggccaaaggcaagcggttccataataatataaggaaggcatttctagctgaaaatatttcaaaaggaagcaaactgttgcctaaggaaatggacaccccattcctgcagattttaagcaggaattgaatggcccgatatcttgtctagggggcttaaagcagaattaagcatccaaagcagttcattcagataattttaaagttctagctatctttgtacattgaaaattatatatataattgatatatgtagtacttgttcctaggttataagccctgtttttcctattcctccacattctccgttttatcatgtcttaggatctgcaaccaggcttcatggactagctgtcctttgtttcgtaactacaatcataagcttcaggactcaaattatatgtcatttcttttaaattcaagtcctgctgttttatgaaattgaaacatcctcatttcatttttttacttgtatagttctaatcacaaatttaatcaagcaattactttttcttatttaaaatatatctgttcccacttaacatatgtgctgtgtcaggactaccctgttctcaggtctcactgcagtttgtcttgtgtagagttaagtattcagtaagtagttactgagcgaatgactgggtgaataaattgatgtttaaaaacacttctctttctattactagatgtgattttcattcagatttttttccgtttgtcttcagaggaattgcaaattctttatagcaaagaacatccaagaagcttcttgaaagtgccaaataatgagtgttcttcgatagcattcagggatcttgatggcttctttgggcagacaaggactttgggacacaataattccctgaggctcactctctagggaaaggaaaaggaggtctgggaagcaggacattaacaaaggagggggaaccagtgggcccgcaacacagggtccctcacaaagactgggaggggctccatctccttccagggtttgtcctattgagcatttagtaggtccagatttggcccccagccagacgcagctctgtgaagtctgaagggaagaaagaatacccctttttaaaattccttttgtgttttcctttcgttccacattttctgcacgtatcagtcttcattttggcaggagagaaaaaataactttcttattggcctttttttctgactcatgattttattggaatcaaaaatataagctgattcaaagattacacagccaagcaaattgacctcctggattctaagacagtgcaactgaaaacgttgagaagtccttgaggcccagctgagaccatgccttaaaatgtcaaagaaagtcaagtcatgttgacttgaaagaaagttatgttgggtttcagtgccacaagaatccagtgttgagctccctgtctacacagggtgatgcagaggaggttagggtcagcacagtgtaaaccagggtgcagcagactttttctgaaagggttagatagataacattaaatagtttgggctttagtggggcttaactattaaatagtttaggctttcgtgtcaccattattcctctctactactgtagggcaaacacagccacagactttacctaaacaagtgagagtggctatgttcccataggaaattatgcacaaagatgggatttggctcatggccaaagcttgctcatttctgatttggaggaaagaatggtaatgcatagtatgatctcgcagaaccctgaattttctgtgctgcaattatcttatttatttaatataaaactgaaataattctcaattacttatacaaaacatacacttaggcatttatagtaaatgatttaatcttcagtgtacccttgagggattgatatgatttttgttgtatggatgtggaaacttgtagaaggtaagaaacttactacccaatcatgtagcaggtgggtggcagagctggaacccaaattagatttctaaattaatatgatgccaaaatatatgagtacctctgctgctataatcaaacaagaaactttattttcagcacgtcttgtaaatttccttggaattctttatgtcttcttttatttatactttccacatattttatttttctttttgtgaagtagtttatattcatatatagtcacttatgtgtttttatatacatatatattcacttatatgcatatatgtgtgtgtttagatgcatatatatgaagtttgtatagtgttaagcacggtatatgcatgtgttagtgtatgccatacgcacattattactagaaagtagagtcagaaacaggatgtgtactgatctagcctaggagacaagagacatgcatgacatgggaccccaagaactaattcattcctccagacagatgcagaaaaaacagggtgagaataccaatactaatatgtgcaaaaccaaatctgcaatatgtgcaaaaccaaatatgtgcaaaaccaaatttgctggggatgaggaggaggatgctatgaatctgagagactatatttgtaaggatgctaagtcaaccaagctcaactaattgcacttggctttgggggcagtaccaccatggagatgagatatacaagaaggaaggagacctatgaaagagaagaaaatcaaagccaataaaagttgagtgacaaattctggtagtatataggtctatctatctatctatctgtatatgtatattaaattaggattagatcacccatgtggacaaatgggcaagagtttggatttaaaagaagatactatgaaattttcatatatacttaatcctaaaatgtatagcatgaattgaaaactctagtagaatatgaagtagtataatataatgaacctggtaatatagtataatcatcattactataataagcaatgtagtataatttactatacgtgtgacttaagttctccaagcctcagattcctcttttattgcagagggataatgacagttttctaataatggttattcatggttcaagaaatattggctgctgtcaattattattatccaaaagatctgtgcatgtaggcaaccagaaagtccactggaaaatctggcagtatggctggcaaaggtcttatcacagtaggggattgcctgttccctaaagaaggatggagacactagaggtccatttaaaactctccctattcatcctattcatgggacaggagcctctttaaatgcataatcaccctgtttaggttcagagttaaagatgaagcaaactgtcatgactgactggtcaattggaatcggataggaaatggggctaggcctgattgagatcattgatgcgtacgagaaatgttagactgctcttgtgtgggtaaaaggcatgaggtaagaaatgtgcatttattacatcattaagagcatggcactgtgctccatgttttcactgaaactgtctcatctaggaggcaaccctgaggatagtgaagcaaattgacttgactcaatcccacagaagctagtgttgggctggatgtggtggctcatgcctgtaatcccagcactttggaaggccaaggtgggtagattacttgagtcgaggagttcaagactagcctgggcaacgtggcaaaaccccgtctctactaaaaatacaaaaagttagccgggtgtgatggcaagtatgtgtagtcccagccagcaggaggctgaggtgggagaatcacctgagattgggggattcaaggctgtagtgagaaaaaaaaaaaattgccattgcacttcagcctggacaatcagagtgagaccctgtctcaaaaaaacaaaacaaacaaacaaacaagtcagtgttgatattcaattatgtgcctgacaataaaactcacacctttcctccaaatcatccaatctattatattttacatttttgtgattatatacatataagcatatattttcatatttatatacttatagacagatattatacattgaaagttcacagtatgtgtccatacatatataaatatacatacttagttctcctataatttttgtttctaggatataagttccacagaggctgttttcttcactgctgaatccccagcagtgagaagagggcctgactcacaaagtatccaccacaagcatttgctaggcatatgcacaaatatgcaggtcactgcatcggaacttctttgaagagggcaggaattaattgcacactttatcttatttagtttacagatctctgttttataagaagttcttggtttaaagaaggggaaagtgaggctgcaagaagctaagtgattttcctaagtatatatttccaataaacagagctgtcaggattcaatatctggctaccaacattttagctttctttatctcattgccttctggcatacaggggctcagcagctacagcggtcttgtttctgcatctaggagggcatccagcacctcaatgcccacttcttgagcaggagaagttgagggagaaaaagaaaatgcattttccagtgtttgtagtgacactttatgcacctggattttatgtactgctacatcttgtggttcatttcctcttggatgttaccagagatgtttctattgacagaaagattctggcacaaatactgagcactaatggcttcaggtcatctgcacctgcaggacagtgtctattgaggacaatagtgaatttacacaacagactgggatggcctccttctcaggaaggccatagcagcctcagatactggccccagggaacggatattcccaaagctattcatctattcagaaaatattcagaagaatttttctgtcttatgtgtgtcaggaataatatggcgtgtaaatatgggcacaagcatgctgggatctcagcaatgagaaccaggtgaagagctggcatttatttgaagaattcagggaactattaacacagcctctctgtaggagaaactctttgtgttcatcaatgcatcatgggccctgggtttgtttatctatccatgcagcattgatggagaaactgtggtaccaaaaggcaggaggaactgatggttaagagtgtagtctctggagcacactgcctagaaccttgtttatctctacctcaccttagtaatagcaccttgggcattttccttaacctctctgagctgtattttcctcctctgtaaaatgatgataaaaaagaatatttatgtgccttgaatgagttaatgtatactgcttttaagcattcaatgaagattagtaactactgttaaccaatctgaagccagtcactgatgagggtactgaagaaaaaaaaatcaagtgtgtgaatattgacagtaaaatgtagtaaggtagcagaaaacaacagccccattcatccaaaaacctttcaatttatcactggattgcagagagtgtctgggcacataaaaaaaaaatgattctggtcctcccatttgctctccccttccccatcatttattactatatgaccttggagtcctatagcatatatgttttgatatatttttcccatttaaaattaggaggtatatagtttcatgtcattgaccttttctttcttgtggattcaagatcaacagatgcacagaaattagttataagccttgatatattactccctcttcattggtccattcaaggccgtctttactccattctttattaataataaacactattagacttaataccctatgtaaaaacttaaatccctttctgtgatcctctttcatcgtcttttcctcttttcctgacccagaataactgctattctgaattgtgtgttcatcatgcccttgctttgaattttaaattatttcatcacatccatatgtactgtattcaaaaaagtatatttgagtatttggttgtctttctaacattatttttgaaagatctcatactgtatgcaatgttttaggtactcccatcttattaaaattatgtttttatggtaggtagccaggcagacatgagtggggcaggagagggccccctcacctcctaccaggaatgtcaggaagccatcaggtggttgttaaattgcctccctaaaatagtaattggtcacagccagcgcaagggaaaaacagtctcccaatagataaaaacatcttaagttagtgttcagcagcttcccagtaagatcttaggggttaggtgactgcgtattcaagcatccaaactaagagacaaaatggcagaattgaactggtatatgaccttcttctagaaacactcaactggtaagggaaaaatgcctcaagtgagcatgtgcacaattttggtaaatacactgtgcgtgtggcccctccgaagtgctggtaggccactgtgcatgtggtcatcccaccccaagggaagaattatgggagaagggatgcaagacccaggaagtatgacaacatataaaaccccaagtcaaaggtcaaacagtgcacttgctctctcaagtcacctgcttggccctcttccaagtgtactttagttccttttgttcctgctctaaacctttttaacaaactctcattcctattctaaaacttgccttggtctctcattctgccttatgccccttggtagaattctttcttctgaggaggcaagagttgaggttgctacagacctgtacggtttcactgccagtaactatgcgctaagttttatccatgctgttgaatggagctgcaattcattcaatagttacggcactatactcaatgtacattaagtcatttactcatttttatgtcagagggaatttgagttatttcccaatgtttacattgctttcttttgcatttttgaagtactctattgatgcacaaactttcttaccgctggaatttttacctctaaacttttgccacttgaatggatgaggaatggtgtctcatgatctttattcatctttccctgaataatactcagagaaagacaatgttatatgtttacatgtatctgctggccagtaaccacgtgttgagtaatttccttaatattacaaagatgcagggctggtattaaaacctaaatcagtcagattttaaaaccatgccctttcttccagtatgctgcaatgatgacaacattggaaacagacattattagtattgatgtagctgtggactctgagagttttttaaactcttgtaaatttttaaatgtcacatttgaagctcattttattgacaggagatctgtgccatcacaatgagatatctataaacaatacttcaaattagattctttggaaagggagaagagatctttgagtaagtttatggaatgaaaaagaaactgaccaaactttctttgtcatatttatagaatttcagatttggaagaaacctagaaatgtagaagtgcagcctctttcagctctctgcctgctatattattttatagtcaacaaacaaacaaaaactgggaactacaatgtaaagtggcttcctcaatgtcatgatttgctgataaaggagctgtaaccaaaactcagtatgcaaatgtatcagttatctattgctgcctgagaaaccactgaaaatattcagtgcctttaacccaccttcatttaatttacttataatttggtaggttagcagtttaggctggcttcagcaggatagttttcctgttagtttcacctggagtaacttgtggtcacaatcagctggtggctgggttggtctaggagccctacgctaggatgacttatctctgtttcatctgttttatgtgttctcatttttttctttctttctgttttcttttattttttatttttttatttttatttttattttttgatatagggtcttgctgtgttgcctaggctggagtgcagtggcatgaaggtgactcactgcagccacaacttcctgggctcaagtgatcctcccacctcaggcttctgagcagctggggccacaagcacatgctaccacgcccagctaatttttggatttttttcttttgcagagatgggtttagctatattgcccaggctggcctcgaactcctaagctccagaaatcctcccacctcagcctcccaaagtactggggttacaggcatgagccactgtgcttgaccttacgtgttctcattctttacaaaactaccttggtcttctcttggtggctaagcggttcctgtggtagagaagacaatccccagtgcacaagcacatttcaattaacacttattaaaatgctattagctgagacacatcacatgattatacacaggtttaatggataaagaggtagactttaactgtgatgaaagaaaaagcaaagtcaatttttcttcaaaagtaaacttatcttttaatgaactttatttcttagagcaatttccatttcatgggaaaatcaaatagaaagtagggtttccatacactcactctcccccaggccttgctcatggcttcctctatagtgatatattgcattagtgtggtatgtgtgtggttacaattgatgaaccaatattgatatctcattatcaaatacagtgcatatctttcattagagttaactttatttgttgtctagttctttgggtttggtcaaatgcataatgtcatgtattcactattatagtattacaaaaaaatagtcttactgtcctaaaaatcctccgtgctctgcctatacattcttttctcttcattaatcactggaaaccactgatattttcactttctccatagttttacagatcttttcttttccagatgtcacatagctggaatcatatagtatgcaattattttagactgacttctttcatttagcaataaaattttaagcttcctctgtgtcttttcatgagtagagaactcactgtttttactgtggaatgatattccattcagtagatgcattatggcttgtttctccattcaccttttgaaggacttcttggttgtttccaatttttgacaaagatgaataaagctgctataaatgttcctatgcgggattttgtgtgagcattacctttttcaacttattgggtaaatacttaggagcacagttgcaggattttataataagactatgtttatcttgtaagaaactgacaacctgtattccaaagtggctataccatttatactcataccaggcataaatgagatccctgttgctccacatccccattcgtatttggtgttgccagtattttgcattttaaacattccagcaggtatgtaatggcacctcattgttttaatttgcaattccctgaagacaaatgatgttgaggatcttttcacatgtttagttgccctctgtaaacttcagcctattaattataattatattgaattcccattctaataattcccagatctttgtcatatttgaatctgattctgacatttggtttttttttttacttgatactgtagttttgcttgtagcatatcctgttttttttttttttttaagtcagacatgatgtattgggtaaaatgaattgaggtagtcaagcctttagagcaaagttctatgtttatccagcttggagttagactgtgcctagtgtttggtagagcggtgttgtcagaagctaaaattacctctgtgtccttgtttttttctcctttgttgtctttggattttcctagagattccttacatgaagtctgcgacttgcagttctgttatctgcaatcctctgctatacaggagccaaactgatgtggtggcaaggtgtatgtgagggaagggaggcattctgtcatcatcagatgaggtctcagtcttttagtgagtctgagttggatattttccttccccctgtcaaaggctgaagggtgctggagctggatatttctgtttattcaagttgaatgctagaatgggctggagttgggtattttcattctcccagtttggataggctttggaaaaatcacagacaggctttaataaagtagttttcttcttgaaagcaggtcttgttatggaaaatagcaagctctggacatatttcaaaatggttattttcttctcccagtgctggaagcataataaaatttttctctaattttagtaatgagtacctggttagattcctggaggtcaaacgtaaaagtatggggtccatctgcattgtgcccctttagggtttttatttcataagttggtaaacattctgcctccagcaatgaccctaacaacagtggctccagctgtggactcttgctcctgacaagctgtgatgctccgcatccaactgtccctccagttttggagacagcagtttgcccactgacatcaatccttaaagaatataagaatagttgttgattgtcagtttgtgcagtttttttctgtgaagacgggggtgacaacttccaagctctgcatgtcatatcaggaactgaatgtctcacaaactcacattttgaaagcatgtgcataaaagagtgggaggcatttgtagccattttttttttgcaatttgccacaaaaatacatgtttcagcgctttcagtgacattaatatatctcttctcattgtaaaaatggctgcgtgaatttatataagtaacaattacctaacatttttaatttcttacttatgcgccaggaagtggtatatattattgtattaatcttccctcaagcatctaatgttaggaattgagatccttatttcaaagcaaaataaattaaagtttaaatagatgtgtggtccctatagtactgtctgctttcatatatactcctggtccttttgttgttttaattggtaacatcaggccatatttcccaaaaagctatgtcagctatctcccaggaagtttggccaatggaggcactagaaatctgtcaaaagtcaggaggaaagaaaaggaaagacacttctccttctccttttgtgccctgagcacaaggtatattgtatgttttgtatacttagctgctgcattatgagatagcctcagtgtctatggtgagggttcatctctcagcagacatatccaccttgatttcgactttcaggttagtgcatagactctaataacaatagctccttcctttgccccaccaggagataatagaggcaccttttcttgctaatactttagttgcctcattttacattgctcaacctctcagcctctttcatcacctatgaatctaattccgtttgtatagtccatctattttatttatggctaatatcttatttcctttggttgaactcttattaagcagcagctttccaaatttccataccttgttagaactatagacgaaatatagacccagatcaaattcttaatcctgccaatctctgttgcctcttatgtgaaatatttaaatttcatatagaatgaaacttctaaaaaatgattgatgttcccagaaagattagagcagatattgcctctaaaaaaatgagaacaatgtcatttgaaatagaaataaatatcaatgcaatacaagtgtatgaagccaaatgcaaaggaaagcccccaagaagtaaaacgaaaagtcaaagacatggatacttggagataaaacatttatagtttagctggaaagaagattttagaaacaatgtaatagacttacatcttcttgtaatggtggagtgatttgggtaatttgccttgctcacaaataacatttataaaacatggacaaaatgttaacaacaacaaagtgactaaaagtaggaagcaactggagaaaggtatcatttgtaccaaagatatttgatagtttgtgtcttcctttttttttgcataagattattactcaatcagaacatgctgtttgggtggtaaaaagtcatagtcttactagcttgaggtgtacagacaacagttaggagccaggagaatagatgaaagctgaagtgagaaaactctggaacagaaggaaacacatagaagatgtgcacaaataacgtatacataaaccctaacctctatgcatgagagttcttcagagatccacaagatccagtgaacaaacagaagctaaaatctgaaataattgaacagatttcagctggtgttcattgatagagagagagagtgagagaaagggagagtgcactgtatttgtaggatccacccaagtgaactgcctgctgaatggtgggcacgagtttggaaaatatttcgggggaatatagtagaatctaggggattaataacatattattcacagtgttgtacaaaaaactaaaagttgctaaacagagagagaaaatgtaaaatatgagccatgcctaaggaaagaaaaaaattgacagacattgagatgacctagcacacgcactaaccttaaggcagctgctgtaaatattttcaagtattaaacaaaaatatactttaacaaatagatgaaagattaaccactgtatgaattgtagacactagaagttaaaccaaatagaaattctagagctgaaaagtacaataaataagataaaaagcacactagctaggcttgttgatgggatacaatagaatgtaaaactctttatttacaggtgacttaaaggtaaccaatagaaattaacacagttacaagaacaaagaaaaatggatgagaaaaaaatgagcaaagcctgagaggcttacctaacaatatcaatcagttcaacatagtagtaatcttatcatcaaaagtagttgggggggaggagttggaaaacaaaagaaagaatggccaagacattccaaatttagaaaaaaacatttgtctttcggatccaagaagcacagcaaatgccactgatgataaatacaaacagaactacagctagccacatcatattcaaactgcagaaaggtaatgttaagcagaaactgtgaaggctcacattacaaaaaggggaacatagatacaagtaacaactgatttctcactagaagcaatggaagacagaagaaaattgaatggaatctgtcaagtgctgaaaaagactgtttacatcaactactgtatctagcaaaatatttttttaacagtgatgaaataaaggcatttttaggtaaagcataattgagaaaatgggttgcccataaccttcactaaaataaatgcttacgggaagttcaagctgaaggaaatgacacagatactaactcagatttgcaggaattaatgacaagaaacagacatggtaaatgtggaaaaatgtacaagtttatatctatatgttatttactctcttatttttgttaatggaatgttataacactgattataaagtatataatgtacttaggtatgctatatatgataataacataaatggcacaaaagtgttgaggtgcaactgcactgtttcaggtttccagattctacatgatataatccaatattcactcaaaagaaattctaattaaatttaaaagaaaaacctctaaaattaatgcaaagggttatacttaaaggacaaaaagtccttaaaatgtaatactgaaaatattttaatttagcaaagatcatagaaaagatttagagaaatataaaatggacaagaaaaatagaaaataaatagtaaaacagtagacataaattcatatagacatatatgaatattccaatggaaaataagtttgttagacttaataaaaccaaaatagccaacaatatatctattgagatgcactttaaaaatcataagtagactgagagtaaattatcagtgagcaaaaaaaagcagagtggcaatattaatatcagaaagcctagatttcaggaaaagacatattactacatatgaaggacagtttgtaataataaaagctgcagtacatgaggaagatataaaaatttaaatgtgtatcttcctgaaatccaaatcatctcagtaaatgcggcaaaagcatattacaaatttagcattcattcaagatgaaaatctctcagtatacaaggaatgaaaggaaatttcttaacctaataaaggtcatctggaaagatatcgctagcatcatatttattggtgaaatagtagattatttccaccaagactgaaaaatattcaagaactcgtacttcaccacttcaattcatctttgtactagaagtcctatacaatactgagaaaaataagtaaaaggcatatagattttaaaggaaaaagtagaactattttttcacagatgacatgctcatggatagagaaaataaggaggactatatcttggagtaaattagtaaagttagcatgattgcaaagtataagctcaatatacagtaatcaatgatgtatttaggtactgagagtcgaaatttgaaattgaaattatttaagtccatttatggtaacatgataaaatataaaatatttagagattaatttaacaaatgtgcaatacatctgcatgagaattataaaatattgctgagagaaatataataacatacttcaataaatatatttaatgcaaacagtcataatctcagcaggaatttttatagaagttggcaacttaattctaaatttatatgtaaattcaaagaaccttaaatagccaaggtataatatataatgtttgtacatatttttggagtacatatttttatacaatgtgtaataattgaattagggtaattggaatatccgtcacctcaaacatttatttttttctttgtgttgggaacattacaattctcctctactagctattttgaaatatacaataaattatcattaactataattttcctactgtactatcaaatactagaactcatttcttctatctaactgtagttctgtatccattaaccagcttctcttcatcctccccacccaccaacttccttttccagcctctggtgaccaccattctactctctttctccatgagatccactttttcagctcccacatatgagtgagaaattatgatttctgtacttggttcatttcacttaacataataacctccagttccatccattttgctgcaagtgacaggattttatttttacatgcctaagtaatattctgttgtatatatataccatattatctttatccattaatccattgcttgacatttgtgttgatttcatatcttggctatcctgagtagtagtgctgcagtagacattggagtgcagacgtctctttgatatactgacttccttttttgtgaatatacaccaagaagtggaactaccatatcatatcttagtttgacttttagttttttgatgaaccttcctactattgagatgcactttaaaaaatcatatgcagactgagagtagattatcagtgagcaaaaaaaaaagcagagtggcaatattaatatcagaaagcctagtgagttcatttgaaacaagttcaatgaaacaaggagttctttcaactaaaaataaataacctaaccttggagaaatgtgtaaactctttgtgagtacagtctttttctctcagttcaaaacttgttctctcagttcaaaacagttcaaaaaatgttttaaaatacataagaatagggttataatgttattgcaaggaagctgaagcaactgtaaggaaattgaagacaagcaatccaacacaagaatggtcaaaaagcttcacagaggaataagttaccaatgtatacataaaaagctgctaaatatcattacttgtgaggaaaatgtgaattaaaactacaagttactgatataatctcactcaaatgctagaattaaaaacaacaggccagtgaggtggctcatgcctgcaattgccgcactttgagaggatgaggcaggaggatcacttgggcccaggaatttgagaccagcctgggcaatacagtgagacgccatagctacaaaaaataaaataaagtaaaagttagccagtcatgctggtgtgtaaatatttccagctactagagagtctgaggtgggaggattacttgagcctggaaagttgaggctgcaaggggctgtgatggcactactgcactccagcctgggcaacagagcaagaccctgtataaaaacaaacaaaaaaaaaaaacaaaacataaaaaccttaacagcaccaaaagttggagaggatgtgtaggaactacaccacttttatattactggtggggataccaaatgatctaattattttagggaaagtttgaagtttcttgtgttgttacgcagtcacataataatttcagtccaacttacctaggagatatttaaacatatatccatagaatgacttcaacaagaacattcacaacagctttattcgtaaaaccaaacaagaaatactaatacccattaacaaaagaaaggatgtagagtttgtattgttgtcatgtaaagaaataatatatctgttaataaaaagtaacaaactagtaaattcccaacaataaggattaaacttacaggcaaaccaaacacaaaagactacattatgtatgattccattaatgtgaagactaaacagttaagacttatacattttactgtattgaaagtttacttcaaaaaccctatatgtgcacaatagtgtagaattacatttcaataaccaatacaaacaccatactaagaaaatatcatcaacattacctgattccaattataacacttgaatatgataagaaaaacaaagactttaaaaatttgtcaattattaatccctaaaaggtgccaaacccaaactgatttataagcaatttctatccattgttaaaaatattttgttatcctatattacatagactttgctagaacagagaaaatgattaaaaagttcccatacacattttacaaggcctgtaaaacttcaatgccaaaactgaaatgaaatagaagaaatataagctaaagtcacatatattgaaattcataaatttcaataaaaaatcagaggccttcatgatctgagtctaaatgaggaaatgctattaatttgcaatgcttttaaaacaaaatggacttcatgtctaaaataccaaaagcaatggcaacaaaagacaaaattgacaaatgggatctaattaaactaaagagcttctgcacagcaaaagaaactaccatcagagtgaacagacaacctacaaaatgggagaaaatttttgcaacttactcatctgacaaagggctaatatccagaatctgcaatgaactcaaacaaatttacaagaaaaaaaaaacaaccccatcaaaaagtgggcgaaggacatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactacttcaaccatagtggaagtcagtgtggcggttcctcagggatctagaactagaaataccatttgacccagccatcccattactgggtatataccgaaaggactataaatcatgctgctatgaagacacatgcacacgtatgtttattgctgcactattcacaatagcaaagacttggaaccaacccaaatgtccaacaatgatagattggattaagaaaatgtggcacatatacaccacggaatactatgcagccataaaaaatgatgagttcatgtcctttgtagggacatggatgaaattggaaatcatcattctcagtaaactatcacaaggacaaaaaacaaaacaccgcatgttctcactcatagatgggaattgaacaatgagaacacatggacacaggaaggggaacatcacactctggggacttttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttaaagtataataattaaaaaaaaaaaaaaaaggaaacagaaatctccctccattagttgactcacttataagaccctctgtgtgttcctctgtatggttacagaatttgggtaatacatggaaattttaataaacaccctaaaatgctaaaaaaaaacaaaaacaacaacaaaaaaaacaaaaaaaatggccaacattttagagaagattataaagaaaggtttatttaggtttaaatttgacaaaatgcaattaaatttatgaacataatttgatgtcatatttaacaaaattcaggttatgattgcgctgttgccattgttaggcatattagacattagaactccaagatattcattattgctgttattattgttgttttcctaaagccacgacatgccagaattccactactttctctttagtcaacatttgcatgctgcaaattatcacgcgggcagggcacttttacaaaacagttttgagaatttcatcactttcttcaaaaaccttttaatcttttcacatttaaatacacatcttaccttagttatttcttgtctttgatttttttatctggttgaaatatgaaaatgttttttaatttttttgtgatatccctgaacatcctgtctaaattcactcctcttcctaccttcacgctctgttctcctactctgctttgtatttggtcttgtagtttcttgtcatatttgtcactaactggcactttgtttttcttttataatttgtttatctgtgtcttctaatagaatgtaatatctataacatgtagagattttattcatttggtttcactgttatatccccaacaaataaaatcattcctgacacacagtagttgattcactaatatttattgaatgaattaattactttcacgttcaaccgttaattttactaactcctaaatttctacatcttctgtgatatatatgatcttactgtgcagtctgtttatattatatttgtaaaataaccagagtttctgacaatcagagatagacttaaggtttatagcatgagctgtgatagacacccaatgttaaacagagagggacatttgagtggagatcaatataatttaccagataaataaaattattttttggtcatttctaggaaacttacaatgccaactcacattatgaatacttagatactgggggtccctgcattaataatacaatctagcaatatatcaaaaatattaagcccaaactaaaatattttaattttaaaaattcaaagataattcaatattataaatgtgtcaatgcattttatctctttaaatattatagaagaaaaacaaaataagcttatctaactggacattcaaaaaagtatgcccaaataaatgaataaatcttagttcaaggatgataaaaatcaatattgtaaagacctacttcctcccccaaggtgttctatacattcaatagaatggcaacgctattcaattcaaggccatgctattcaaatccctacaggagtttttgtagagtttgacaaagtatttctaaaatttgaggaagagaaaattagtattgaaaggaagatgatattgatataaattacaaactggccattagaacagaagagagtccatgtgcatttggaaattcagttaatgataaagttgacatttcagagggagacaacggctatacagccctgagttgtgcagtccatattgaggtccttgtgaatagtgcccctttgtgaggtgggccatacattacctgcaaggtcacgcagggaagctggcttttacgtccttagaaaaagagtaagccaaccaatgaataatttgtgaacattaagccatatctttggagaacaaatgaaattgattgaaactttaaacgtttgcacaaataaataaaaggtggatcaaagcactcagtcttaaataaggacttcaaaaaatgtttaaaaatacataagaatatggttataatgttactgtaaggaagctgtcttcaaaaagacaccaaaaatcaaaatcaataaagaaaagatttgaaaaattcaagcgactcgcccttaccttcatttatggagaaaatgatcttgtaaacacatattaaaagatacacaaaatgctgagaaaaatatgtgctgggatatattaaattgtagaaaatatgtgcagaacatcttcaaatatgtttgaaaaacatacaacttaaaaaatcccacagtttaaacatgctttaaagaagggaaaatacgacttgtaaagcaaagaaaaaaaaaaagatacttaacaaaactactaatcaagaacatttaaattatgaattaatgtctaaacataaaatagattggtatatttttttaaattaatgatgtcagtctggacaagttgataaaacatctatatatctatactttcgtataaaataatagtggatttgaaatttgataaagcatcattttatatttgtactaaaagcacaagatttaaattagctatcatgagtccatattaaaaacaaaaacaaaactgtagaatgtgaattatagctctgtgtgctacccagaaaaaaattcaagtcttaatgtacttcaaagcaaatattatacgattaaaatgaaatacattgatccatgattattttatatatattcattctttggtttggtaggtgaaggtatacaagatatgcaagagaggcacttatatctataccatttaaagtgctttatatcaaaatgtattctcaagccacttatgtaatttaaaatacagacagtcctctgcttaatagtggttctgcttatgacttttttgtattttcagatggtgcaaaagtgatatgcattcattagaaacggtactttgagtacgcatacagccattctgtttttcactttcagtaaagtattcaataaattatttaaaatattcaacactttattataaaataggctttctgttagatgatttttccccaactataggctaatataagtgttctgaacatgtttatggtacactaggctaagctatgatgtttggtaggttagatgtgttacatggattttcgaattaggatattttcaattttcaatggtttaatgggacataaccccatcataagtccaggagcatccacatatgaaactgtaaaattaaattatgtaattactgtgtgaaataccttttaaatcaatttaatttaatttatttaactttagagttttattttactttttgttttctccaataaattactttttaaatcaatttaattcttcattaatatttttttctgcctttcaataggcaaagtctgtgcaggcaggccaccagcactgccttggagctggtgtttctatttaatctggaatgaagaggcctgggctagtctcttcctgccagtgtcgtaacaatggtgctcccaccctcatggctttgcacagcgcactgtgccatctggtactaagaagaaggcttgtgaattaagtatctattataagaacagtactttgaatcattttgaaaaattgcttttgtaagtttgattcgagctcttctaaactgtgcttattttgtgtttaaaagaaattgcatatttgccattttgcgctttctcacgttaccttcaagtacctatgaaactcattttagaatctgccttttacatgccatgtggttcctgacatgaaataaaatattaatgccttatatcttacactgtaaataattgatattgttgtcccatgcactctaagtgtgataagccttcaactatggctgttctttaattcaagccatgtctcttctccttgcatttgagaatatttcaacatgaaaataaaagaggaaatgtgataaaagctatgtgtttatttgaatattcatattctgctgcagatgtatgtgtacctggctgctgagttgcttgaaacttaaccatagttagtgtcccctgtctaaaattgccacaatttaatatcgattttttgtttctgaagcctcttgtcctcagtagcaaaacttcagacaaaatgtacctattttccagaatgaggatcctggctgaaccaattcttttctctcaggttaaatatacaatctctcaacagtgccttattttgcttggtttcatacatttaatgtctggcctacagtatgagaagtagaagaagaggaaagaggctagaccaacaaagaccagagagggaagagagagaccacgaaacatttttgcaacaaaattccaaataaattttagctgtcaagcaaacttaactgtgaaaaatttagccattttttaaagaatttcaaaagatcaaatgaaaagcttacactattacattgcttgctccacagccatctactcactgcatacatcctcatgtctctacccagcactgcacgttcagacacaggtaccagctcccactgacaaaattacattgcacactgacataccacacatactctcagcacagacacatttctcttcactcatcatcaatgcatatgtatatatctgcagactcactgaacctcatttcatattcccgcaaacaccctcacatacacacacacacacacaccccataccgcctattgttctgaaccaactgtgactccagtggtcctgccgaattttatcaggtaaagaccaaaggaaagactgcagtatgaacttgacaaaggatgacagaatgaagagaataagtagaagcttttcttgctttcagtttttctcatctcctgatcattccccagtctatgctatctagatgtaatggcagtgcagagagtgtttccatcaggtttaattgtgtggccatgtatgttttctcaacccttgtgagaaaaggaggcattcttagctctgagctgttgctgttcacattcctgagtctgtaatgtcagaggccaattaagaagctatgggatctggaagccaagtttgcactcttaatcacagcactgcactgtttttcaagcaaaactacttctatcacacacttctttctcaaagcttaccttgactcacaatttagtttcctgggactcattaacatgtattgttttgtggcagtcctaaaattcaccactgttttctcctccatttagcagaggaatcttcagctttggattgaattaccaggtaaaatataacacacatctaaatctgaattctaaataaataattaatatttatgtagtataagtgtagctcccaaaataagtggaacaagcttattctaaacatagttatttattttaaattcaaatttaattgagcagagtgcatttttatttgctaagtctcacaaccttaactctgaataagaaatgagataatttaacaacaaaataataattaaaattaacattaattcaaaaatgcaaaaaggagtcaaagagaaaaaatattaatctacaattaggattaaaatgggaaacatatcgagctcccagatcttggtttctaataccattctccaaccaaaggaaccagaactccttggagaaatgacttactctatgaccggagcataaacaaaaaaagataagcctgtagcatcttgcagtactcgagtaaaaagtgctgaaacaaaaaacaaatagaaaacaaaacccacaatgaagagaaatttcaaaggaacacaaaaaccaattaaagagctcccagtgatcaaaaccagaacaatttgagctacaagataaatgaattagttttatattataatgtgagatataaaataaatatcaataaattcatactgatataaatatatgaatgaatggatgaatgaatgaatacataagaaaagacaaattatccatgtagaaatccaaataatttatatagatgctacacccacaaaggagtagaatgtaactccacatgccttaagcgtaagtggcatatagtgacttccttccaaataatatagtattattataacagagaaaataaacagtaactttacagtgaaggagcctgtaaaattgtcattcagccaggtgatcaaggtcagcaacagtgataaactatgttgatactatgtacacttgatacgatctgaagagaatggcattatcttaatagaggattattccacaaaatactgactggtcctcctcaaagttcacaaggtcatttaaaacaagaaaaatatgggaagctgtcataacagcccagaggagcctaaggaggcatgaaaactaaatgtaatgtgacatcatggttgggatcctaaaacaggaaaagaatattagggggaaaaagtcaaagaactctgaataaagtacggactttatataaaaatgaggtaccaatattggtgagtgtaacactatcattgattatagctaacataacaaatatgtcatacatagaggaaacagggtgtagggtttgtgggtatttcctgtataatcttcataatttttgtgtaaactactctaaaaattaaagtttactaaaacgttaaattgctagtaggcagtcaagaaagacctaatcacaaatctcttccacctaaaaaaggctttttagaataactgaaaaagtcaccccaacaacacttaatgtgtttgagagggagctttgcatgggattctgccaacaacaaggaaagaaggaaatctctgatctgcacttactaacactagggctttgacctgcccaaatgggaagagaaatgatcgatatccttcatgctctgtctctgccctatgtcttgaacaaatatggtatggatcatggatgagtttcagtaattgtgatataattatggccagggaacaggaaatgccaaagcaataggctccttttaatggagtttcagtagaggctaaacatagaaagaccaacaaagaagaatcaaagtgcttctttcttgaaagatgcacacatcctcaaatcatgatgtagagctttcataaagtgatttgtgtgatacattgtgcgcttctgatctgaccacccatttctcctatcagtctaagacatgtgaattttctcatcctcttggtcatcagatgaagaaaggaagtagaggaggaaatgaacacaaaatcattatgcttcagagagactgaagtcttagctcaaccagctatatggctgctgagaactaagaagatcctgagaagtggtggagacagaggcagagtgtctacactctctctttaaggcccaatagccatgcctactactaaacacaatccagtgagtgtttcagacttagaccaatccaattagaaacttctcccctcgaggtgacctatgaggaagtgggcagaagttggcctaagatggagagagcctagaaattctcttcctatcataaaaggatagaaaaagactatactcacaaagagtttacacatttctccgaggttagattatttatttttagttgaaagaacccttgtttctgtattagagaactctaggatctcagaaatagaaagaattctgaatacctccactgggtgaggcaatgaattatagttaggtcatagatttttgaaatgggaagagtcacaagtcagtacctggagagaggtgtaatcaatcaaaacagacactgcactttcaatgacgtatttgtttgatagtgctaacatatctgatggagtcaatcaaaacagacattttggcaatgcatccacttacgagaaggcacagagtaaataacaataattctgtgttaggacaagtcttctgtatggaacattgggtgaatatgttctaaccttgttgttcccatatatcaggcatacaatcattttactcttttgatccttatttatataaggagcaggccatatttgttgacgccttttagctctaaataaagtattccatgagacacttaaactataaaattgtatggatcaaagtaccaaacatttttttgagtgagtattagatccaatataaatgcagacagtaaggattgctggatcacttaatgtaactcaagtacaaaagagagtacactgtggaacatcacatagtactcactgagggatggatgctagtgtaccagctcaccaggggtccaaaagaatataaccagcctgcctctgagattgtatcactcagcatgcaagtaaggtgataactgaataaatgtggcttaagcaacacaggttatcattattactttttttttgtcagacagagagaagtccagatacttggttcacaactcaaaagtgccacgaagttcccagtcattccgattcttcttcttcttcttcttcttcttcttcttcttcttcttcttcttcttcttcttcttcttcttcttcttcttcttcttcttcttcttcttcttctttttcttcttcttcttcttcctcttcttcttcttcttcttcttcttttttagtgtacctcttttatctctcagcaatgtctcaccacatgattgtaagatggctatggcagttccacaaattaggtcctcatacaataatgcctctaagaggaagataggaacacactctcctctggcacctcttttaattgggaagaaacctattgcccagaagcccccaccctgttctaggagacttctcatgtgtctctaattggccaatagctagtacccaataaatgaagaaggaataacaaaattagaatatgactactttgcaaatgaattaatggacctagctaataatcattaatatctgtgaacatcactgaaagacaagcaattagatatcctatacctcctgccagatgaaggggtcttgctaaagagattacaattgctcatgcttctagatttaattaccactttttatagaatgcatagaacagtgaaacatgataaactatacaacaagaacgcaatcagtaaaatttgtatcctggaaaagtttatcagagaaataaccaaatttctttggcaaaaaatatacaaaaatcaaaattaaagagaaaggagaagaaatctatagactaaaatatacctatgcgatacaacaacaacaacaaaaatgtgtgaaatttatttgaattctgattaaaacaacccttaagatttcaaaaaaagcatttttgccaattttagactctcttttagggatcatttctgcaagcaagaaaagtggggcaagaatcaatgtttgctcagagtctaatgatccatcttactgaaatggcctagaaaatgtttatgttgccatacaataagaaaagttatttccaaacagacatattttaaggttaaatgatattttcacagacactgtttatctgcttcctgtgttccatttcccactgggattcatttcagcaaagacaactgttatagaagtatttttggtccagagctattcaaggaagtgttcagaatctcttgagagagttcgttctcaagaagcaggcagcacaaactttatgggtctcacagacacaaaatggagtaatgcaccttcatttttggaatttactcacacccctccacattggctgagttgagctacttcactaattaataaacagatgatctagatagcatttcatatgttataaagacttttacaaactttttttttcaatctgaactccccaaacactacataaaagatgtaattgagaagactagagaattataactaattgaacactttctagattctaggcaatttcttaatatttattttctcaatttgtaaacaacccttgctaatacctttctcttcattttacagattgggcaaattgaaattctaagagataatgagaatagaccaaagccttgtgataattaagtgctcaacctcaaaggacataatgtgatgcacagatgctgagttaagtgctttatacattatgtaaatatgaatcaagtgatatagggctcagtactgtatcaagatagcaacatgtggaatttcaggagtgaacttcatttatagtgaaacaaaaagcaaaataaagtacatgatctttttaataatcagaagtgaattcactttccactgccaggtggctgtgcgccgtgagcaagtcatctttgttaatacctgatttccttattgtaaaatgtgcataattatatcttccaagtatgactagatatacactctgccctttggcctttatagtttgtgctccctaacctctactttactgacttatttctctttgttaactgggagctacatgagggcaagtgctatatcataacaagtattggattcttgttccttgtgcagctcagacacatagttagcaactgtccaaaaatatttatataatgtaagaaagaatttctatctaatttttcacaaatcaaaatctctcttatctttagattttttaaaaaatagagataacagtaatcaaatgtatataaaaatatgttaactacaaataatagcaatattaggtaataattacaaaataatttttgtacataaagcaagttcttgaaagtgcaaccagaagactccaatagcagcaggtcttttctagaatattcccttaacatacccgtaacatccactagcttctattcaattcaaccctgacttacatgtttagtctctcaacattatgcatgatgttagctgtgtgtttactgtaggtattcattttcagattgagaagaactcttctatctttactttcaagagtttttattgggaattgacattagatggtatccaatgtgttttctactttcctgaaatgattacatgttttctttttttagtttgctaagtgtcatatgttcaattatagtaactagatttggaatgtttaatgtacctagcatacatgtttgggatcaagtgcacttggagttatgaggcattatattgtctatatattggtgaattctatttcctaaaattttttttaaactttcatcaatattcatgaaaaatatttgcgtattctctttttattcactatatctttttctgcttttgttttagaataattctgatttcatagagtgagtttggaaatattccctccacttcaattttctgaaaaagtttgtgtagaattagtattatatttgttttaatgtttagtaggacacaaaaataaaatcatgtgtgctaggaattttttctgaggggaggattgtgactttagggtcagtgatattatcctttgttctttgatgagtttttatagtttgtgtgtctcaaaaatatgtctatatcctctaaaaatttattgacagaaaattgttggtgatattatcataccactcttatgatgtatgtagactatgtagttacattacctctctggtctctaatattggtcatttatggtcttcctttattttttcctgatcattgtggttaaagttatatcatttatatttattaacttatatacaaaaatcaccttttggcttgcttttatttattcactttgtattttatgttttattgatttctgatctgctatttagtgttctttttcttcttttaactttcatatttgtttatgcttattttgttagtttctttaggaggaagctgagatcattgactaggtatttcttcctttctaacatagttataaatctttctctaaatactcttttagccacatctcccaaattttatttttttaaatttttgattcagttcaaaatactttttattttttcttttgattttccattgacccatggatatttttaaaagtttatttaaatttcaaatgtttagaatatttacaggaatattttcaccttactgatttgcaatttagttctattgtggtcagaaaacatatttcatttaatttgaatcattttacacttacaaagacattttataactgataaaacagcatttcttgtgtttctatatatatagaatttctagatatacatttctacatatatagaaatactacatacatatagaaatttcttgtgtgtatctatatagatacatacatatatacatatatagttttggggtttttttgatttttattttaggttcagggatacatgtacaggtttatcatataggtgaatttcatgtcacaggggattggtgtacagattatttcatcacccaggtaataagcctaatacatgataagcagctttttgatcctcaccctcctcccacctcccacccttaagtaggcccttatgtgtgttcccttctttgtttccacacgtattcaatgtttagctcccatttataagtaagagcatgtggtatttagttttctgttcctgagttagttggctcaggataatgacctccagctccatccatgttgctgcaaattacatgctttcatcatttttatggctacatagtattccataggtgtatatcacattttctttatccagccttccgtcgatgggcatttaggttgattctatgttttttcttttgtgaatagtgctgtgatgaacatagatgtgcatgtgtctttatggtagaatgatttatattcctttgggtatatatccaacaatcggattgctatgtcaaatggtagttctcttttaagttctttgagaaatcaccaaattcctttccaaaagactgaaataatttacatttccaccagcagtgcacaagcattcccttttctccgcaacctcaccagcgtctgttttttttttttttttttttttttttttttttttttttttgacttttgaatcatagctattctgactggtgtgagatggtatctcattgtggttttggtttgcatttctctaatgattagtgacattgagcatttttttatgtttgttggccacatgtatgtcctcttttgaaaaatatctcttcatgtcctttgcttactttttgatggggttgtttgttttttgctttcaaacttgtttaagctccttatagattctggatattagacctttgccagctgaagagtttgcaaatattttctcccattctgtagtttgcctgtttactctgttgatagtttcttttgctgtgcagaagctctttggtttaattaggtcgcatttgtcaatttttgtttttattgaaatcacttttcacatctttgtcaaaaagtatttcctatgtcttacatccagaatggtacttcttaggttatgtttcagggtttgtatagcttttggttttagatttaagtcattaaaacatcttgaattgatttttatatatggtgtaaggaagggatccagttttagtcttctgcatatggctagacaactatctcaagaccatttattgatagggagtcctttccctatcacttgttgttgtcaattttgtcaaagatcagatggttgtaggtaggcagcattattcctgggatctatattctgttccattggtctgtgtgtctgtttttatacgaataccatgctgttttggttactgtagacttgtagtatgatttgaactcaggtaatgtgatgcctctatgtttgttcttttcgcttaggaataccttggttattcaggcttcttttgtgcgggaggggttcacatgaattttaaaatagtttttcttctaattctgtgaagaatgtcattggtagtttgataggaatagcatgaaacctgtaaatttctttgggcagtacaaccattttggcaatattgattcttcccaatcatgaacatgaaatgcttgtccatttgtttgtgtcatctctgttctcattgagcagcgttttgtaattttcagagaggtcttttacctccgtggttagctgtattgctaggtattttttggtgtggctattgtgaatgagattgtgttcttgatttggctctcagcttgaatagtgtgggtgtagagaaatgctactgatttttgtagattgattttctatcctgaaattttgctgaagtggtgtacaaggagcttttgggcagagactacgtggttttgtagttagaatcatattatctgtaaatagacatagtctactttctttcttcctatttggatgccttttatttctttatcttgcctgattgctgtggctaggacttccagtactgttcaataggagtggtgaaagagggcatccttatcttgttctggtgttatacttggaaagcatttttactctgctatctttctttggagtgtcttataaatataaattagatcatattgatatagatagtattgttctagtcttctatatcattagtaatttcctcccacttgctatatcaattattgagaaaggagcattaatatttctaactgtaattgttggttggtttatattttcttgcagttctaacagtttttgctttatatattttgttttgagtaatacaagcatttaaatttgttgcagtcactggatgtattgacccttttaataccataaaattattgcctttttctttggtagtatttacttctctgcaaactagtttttatgatattaacatcacctcaacaattttcttttgatcatcttatcttttttatttttgcagttttaacagatttatatatttatactgaaaatatgtttcttataggcggtgaatggtttggccttgtttttaaaaattcaatctgacaatctctgccttttcactaggtgtttcgattatttacattttctatgattattggtatggacaagtttaagtcagtattcttgctatttgttttccattttgtcccatatatccttgttaatcaaatgaaaaaattgggtctttttttatattttctgcccctcactttcttcggcaaatccagtttcatgtatattaagttttcctgaagttttactatagctcactgctcatattgtcatttttaaaattgattattccttctagcctgccttttaggtagtctgaatttctgtgacttcaatttcactaatattttctcctgcaatgtctagtctgctgttaatcctatccagtgtatatttcatctcagatattgtagtcaccttctatagaagtttgataataaaatttaaaaaagaagtttgatttggatcatatatatgtacacacacacacacagacacacacaacactccttaattctacttaactgtttgaacataaggaatatagagctaattattttaatgtctttatctgataattctaacatttgtgtcgtgattaactatgttttaactgagtttatcttcttataggttgaactttctagattgattttgagggaagcctggtaatattttattaggttccagatattctgggcattatctcgatgggtgatacatatttttgtattcctacaaatattctttatcttggatcttggatatagtcagttaccagaaagtagtttgattctgtttgatcttaatcatgatatttcttatacaatactacagctgtgtttagtctaaggttaatatcccattgctttggtaagactctgttgagtattctgcccaatatccataaattatgagattttcctttctgtcctatgggatcaagtactattcccagcctggaattcccagagcactactcccatgaattctttctgtggtgtttcttacagccttaggcagcttttttcacatgaatgttctgatcagtgttgagctgaatacattgaggaggatgttcttcatatttctcaactatccttccctccagtacactactctgtaaatgccattcaccttgatctccagcacaagtcattgtactttcatagccccacttgtttgtaggtggctagagacagagacaaaggtctggcaagttccagtttgtcttcaaatgtttctactctaagtccagggttccttctcaaatcccagacctactgagaggaaacagccaaatgtgtttttctaagctcagagaagcaatagcaatgtaaatttctaccttaacccgtgggagttccactccagaaactggatatgtgtagcttcctgcagtcttcaatttgttcatccattcctgggctgtttagtaatatttgaaactatttaatgacctttaatttcccaagtatttccaacagttgtatatttaatttttatattaacaatttgttttatataacaaaaccgtttattattcagctgctgtgagtggtccctaaataattgttattttttaatagctcagaactgtttccagtgcaacataatttacatataagaatctggaattaagtctccaattttattatatttagaggccctgatgtccatattgccagtgataaagggacattgatagttcatagcatatagaattcagtatagactttggaattacagtcagaatattatgcttcattgtttagatatgtgaagtatgagagaatggttacataaattatctcctctgaaatgaccaagtgcttgtagaaggcaagcttttggttggccaaggatttgcccatagaatattttaggcagaataaggtaacaataatggagttattaatggcttcttggttgcagaataccttggagtaagttaagtgtttagctcagctatttaaattccaacttcaccacctgatttagagaccagagagtttcttggacttccctgaaggaaactttatctcttataaccacaggaatcagcttttctgaactcaaaacccaaagtcttattttttggatgagtggcagctgaattacaacacagattgaattcacaacctcatatatcaaagtgagggaattgtttgcaaaaatagtacaaaaccccgtaagtcaacatggacagattctgaagatactttaacgttaaattttcctaagcctctttaccaatagaaataagtactttttcttgttttatgagtttgatctcttcttgcttaaaaaacctgtaatagattcttccaagatggaagtctggcagggaattgctaattctccacagcacctgctcctgtcacccctcacttctcatttctcaattctagatctaccccagagggtgaggtacaaaagctgagagacactcacaccaaaagcagtacatgatcttgtcagtatatattgaaagacaagaaagatcatataggagaatgaattctaaatgtgttgtgtcaggagcaaagagtagaatattgatcgggctaatttattgatacaggtgcactgagcaggattactggattccatgtgttcatttgagtactgggagtgactcttagagttggcttatttcctttctggactgaaacctaaaccctaatttggtccacacaaaataaaattcaaatgccagaactttcttgattgctgtataaaaaggtatctaaaggtttgggaaattagaagcaagaatagatttattatataaaggctgtttacccctactgtgactataaagccaaggaggacacagccagcctacttcattaatatgcctttcaaagctcttcacaaggattatagagagacatcatgataagatttttaaaatgtatctctattaatttatttttttcttggaagtaaacaggaagtttctaaaccagattcagtccatttttaaattatggaatgtttatcttgtgttggttctccatgctcaagttctttcttgaggtaatgctaggaagggggatatgacattgcatgtatagattggttctataggaaagaaaccttgaaattatgaaacttggagtttacataggaactgctgcacatctaccccaccttacctccagagagaggaagaaagacctttgttctttaatgtactcaagtcctttctggagagtacaagacagtccatagctcagaatgtaagtatttagctctggagattataagaaagtctttattactttgggatgagagcacatggctataccaaaaaggagacaaatgtcttcatatctattacccttacaatgagaaggacaaatggttctggggaaataaggaagcattctctatcttcataacatgccaacttttgttgctcagaaggacatgacatgcaaaaatataaaaatattcatattgtttttgacacattgatgagggaagcacacattttttaacagttttgtagttattctcagcaggctagttataacagcaaggaatgttttcttcaacccaggcattctagattcaatggaaatggtaagattaaacaggggccaaacggtgctcttagtagccacagaagcatggacatggttattgcaataggcagaagaaatgatatgataaggtaattagaatggcttgactagtagaggtctttaatattgactagttgatcattacatccctaggtaaaatttagtagacagccaattaaagttttctttaaattgggtaagtggaacagctctaggtccagtgaacaggttgctcattttttcctcaggagaaatggctagaggtgtggatctacactgatttgtaatctgtagctaatagttgggctgaatctcatggacttagaaagaatataattggaaaactgataatatgaatttaagagaaagaaatatttatgtaaacttttctgaatatgaataaaatgtaaaaatatttgtgtgccaatgaatgatctcagaagaattttagtcatcagtggacaagttgatccatctgtggatatctgtcaactttttttcagctacacctgtccttacacttgtctacaatgggcttatggacaaaatgaaaacagcaacaggagtggaggttatgcatgaggtcagcagcatagttttccactcatcaaggctgatctggctacagccactggtgagtgggcaacctgctaatgacatagaccagtactattcagcagagggatcactcagtgtgagggtaggttgtttatattctatcttgtccatcctggatgaagcaatagattattctcactggaatggtcacttattccgctcaaaatgctttgcccaaaccatgatcttttgacatagagaatgtcctatttattatgatggtgttccacttagaattctttatggccaagtaattcattttaccgaatatgaagtgcaatgatggacttttgctcataaaattcacatgttttttaacgtcacccatcacatgaaagctgagagaaaaattgaatgttctttctggaggttcaattacagtgccagctgagtgaccatgatttacggggcaatgcaatattctataggatgcctatgtgctccaaactagctagaagaatatggaattatagctcctctagctagaacctatgagtctaaaatcaaggagagaaatggtagtggcctctttcactattaactttaatgatccattagtaaaatttttgcctcttatccccacaactttggcttctggtttgaacatctttgtttcttgaaaggaaagttctttagcaggaaacagcaacagtctgttaaactggaaagtgaagatgtcatttgaccactttctgcttctcaggtccatgaatcaaacaggaaagaatgacattattaccttgtctagggtattgatcttgagttttgttgctatgctcaagaagaataaggaagattatgtcttaaatgcaggaaatctccttggatgtatctgaatattttcaaatccagagataaaagttaatgaaaactcacatcgcagtacacttgggactgctaatagcctagactcttcagaaacaaaggtttagataactccactagttgagaaaccaaaaacagctaagatgtttgctaagagaaaaggaaatatgtaatagtggatgtagagagaagttatgactattaatactgcaaacatacgaccagatgcagaaagaaacactatattgagtatttatttttaattttaaaatgaatacatttgttaatattttaacaattttttattctcctatctgctaattgtatatatattaatagaaattaatgttgtatcttagtactgatgttactggacataaaatggtatgtgatcaagtacaaaaagcaataagtacatcatcgaaaggtgaataagatgacacatgagacttgatattgtctttggggaaatggttagcatagttttgtttacaggaaggatatttgcatcttgttgggtagaagcaaaattttgtcagtattttcatttgaaagttatgtcagttaacagagatatataaggacggaaagaggacaagactgggttgtggtggttttgtgctgtgttaacttggctaagctataattaactttcctaggatttctctggccacaagaaaaaaaatctgtggtatttgggttgcagaaatgaaacacccagcctttgaaatctgaaggttgtctttataattgttgaaacctggaagcaatgaagatgccttttcatagttgaatgaataaacaaactatggtacatccatacaatgtaatattatccagcaataaaagaaaatgagatattatatcataaaaagatatgaaggaaacaaattcatactgtcaagtgaaataaaccagtttggaaggctttgtaattccaactacaagacattctggaaaaggtaaatctatagagatggcaaaagaaaaaagaaaaaaaaatctggtcattgccaggaagttgggagagagagggatgagtaggtggaacatgggagcttttgagggcagtgaagttgttctgcgtgacattgtgatattggatacactgcattatgccttcatcaaattcacacgactctacggcataaggagtgattcccaatgtaaactatggaatttagttaataaaataatcaatactggttcattaattacagcacttctgccacactaagcaagatgctaataaaaactgtgggcaggaaatgaatatatggaaagtgtactttctgctcaatttttctctaaacctaaaactgttgtaaaaataatctattaattaaaaacaaatctgaaggttgtagttatttagaaaaggtgaaagacagagtggtctccttctttactttagctctgctggtcaaagcatctccaggcccgccactgcatgctttaccgtgaattcactgaggtcagaaccatgaagatcaggatccgcacatccacttctatacctgctcatcatggttacaatccggcagctgcattctgaaaagcatgactggctcatccatgccagggctggctgggactcttttctgatcctttctataattttacctccccagcttcaccatcaattgtatgaagtctaattcctgatataaagtctctatctcataatacacggcctctgcttccctaatcgaaccttaactgaatcacaaattttaaaatatcctctctattctattctaaagattatttagtgaaagcagggctatcgtgtttgtgattgtaaagtgaaattaaaagaccattaggaaaaaaaaagaggacatttctattgcttcattctctggtcataggccttcaatatttgtttctcatttgtgggtctatgaatgtagactttatctgaaattgcaatgtgtatttaaagtgacttgcttttaagcttcttgcagaattggtaacatgctcctctacaagctacttaatttgtataccttatccaagcacacgttttgcataataaataaacagtaactcactgtcctgcttgataagtgactacacattgtatattttaagcaagtagaccacatctaattcaaactgcttttaatagcttatatttttctcccaacagctgctccatgcagtagagataactctgacctaaaccacaagtgtttatgtaaaaactctagcacagggtatattatctgacataattacatctttgaaagatgcaaatgtgcaacctgaaaccctgaacaatctgtgagatgtattctaatgtactaattctctgtgtttcttggccattgttacaggtaccattttatggttaatcagcctgtagaaagtgtgtgtgtgtgtgtgtgtgtgtgtggtgtgtgtgtgtgtgtgtgtgtgtgtattcacgttgtgatgttttggctatggcactatttctgttagctgctcttacgagtatctcctaggagacaggcaaaaatacaattatatgtcttccactcttcctgtccattccatttgaatgagaagcttgtagtcactctaagaaaaaacgaacaatagtattctcaagaggatgtttttgtagtatttggcctaagaggattctcagcataacgcagaagaatcctcattatttgactccagtcggcctcactagcctcatctttgtctattctctttctttgtaacataacctcagggcattccacactacttttggttctctgaaactaccatgttttgctcaccttctgggctttggtttgtgcggttatagatgtctaaaatgatttctcaaatgcctaatttttttatccatttaatttctatttattcccaatgatgtgcacccaacttcctttagggcttttcacattgaagtggcacatggtaaatattggttactgatggacatcttggggttccatttagagctatttgaagttttaatttgtgttctgttaacacttctattttcatgtagcaccatgccttgattagtgatcctccagcaatgtatgtgtgatttttcaaacccactgagggcagactgttctggcttattctactcttatttcctgaacacagtctgttgttactccgtggttatcaattgttatcaattctatcagtgcattctggttcagtgaaaatgactgaccagccttctcttcaaaccttccctaactcatggtttgagcctttgggatagagaagtcaagcaacaccatcagaaaagaaatggcccaattaggcatcacaagcaaaagttaactcactgatgtcttgttactcatctgggagagatattatgtcctcatttagaatatctatttgattaatgtacaaaatggtaggaatttgtatttactaataaaatagcaatatcaagaacttctagaacgtattcaacacttaaataatgttgatacagtcttaagcacttgatgtgtattaactcataatcctcattaaaaatgtaagaattagttactatgactaatcccacttcatggggtaggaaatcaaggtatagaatcagagtgtgttttattttagtaatcaagaacataaaactaaggctttacttaagttaaaatttttaaaaaaagagtaatagaattgaatttatatattttatgagctccaagataagacctttatgtgagtgacctcacaatgcagttcattaagtaagtagctaattcttactgatctttctcccaagtgtagtttatatgagacttcctgagagagattcttctctagtcattctccattctttttatatcatacctttttatacatgcctcttatttttcttaacaacacttatcaaaatctgtgcttaggtacttacttccatgatttattccatgttttccctctatatccctgtgccagaaaagtctttaagaacagagaccagatgttcaccagtggactggactccagggcctggctcagcatctgtcccgtatgtgctattcttaaatatttgttgaagatatgtatagaatatacatagatatgtttacataccaactctgttagaatgtacacattataatacattaatatatattagaatatacacatatatgtacatatatataatttacatatctacatatatttttatatatattccacacatatattccaactctattagaagcatttgatattaatttaaatgtttatttctgcaaaattttggggacaggttgttgatacgagatattcatggttgtatgaattaagagttttaaatcagaaggttcttcaatctggacatctacttagaatttcatgatcaagccaatgatatagttttagagtataataaaaagatagtaattaaattttaatcaacatgtgtttattgatgacagacctgggtcatgctctgtactaaatcctcagatgcaaaaacgaataatatggggcccctgcctccagttaattcatagtgggataaaggaaaagtgaaaactttgataaaggatccaagtcactctccatctatgtccaggtgagcaaagaggtgaaattaaatagcaccttatctattgcctcgtgaagcaggatttttattggccccttagtcagattcctgacaagggagagcatttacttggcccacagccctcaacccctcacatgcaggagggagcacatgagcaagcaagtgcaggacccggtaggccaccctgggcatcgacacgggagcaaattccatgcggaacccatggccagaccaggcacaagtgagaaaatatgggacccagccagtagctccaggcaccagtgggagcaagctccatggggtgacatccaggttgtggggggtaggttcctgcgaccccaaagctcaagagggcatgttacagtgcttttagctctattgtccgtggacagcagtatgttatcagctcagatgggccctttcttcatcacgtggggtgaatgccctctgctggtgagggtaaagggccagtgtgacagccttttttgtgtacccgtagaggtcgcatggacacttaaaggatggtgaaggtggagaattttattaagcaatggaaatggctctcagcagagaggggagctgaaaaggggatgggatgggcaggtagtcttctctgaagtctggccagctcttccctgaactcaagccatccctccaaagtcaagctgccttgctgaaaacaagctgccttgctcccctctactgactgagcctggggtctttataggcacaggatgggggatggggcaggccataggtagttttggaaaagacaacattcgactggcaagaaggcattattcagaaagaaccaacttggagagaactggtagacaggaatagaagctctcactttgggctgtgggtttcaggtttttctacttgaaggtgaggtttcactggggacctgcaccatctgcctcctgcctctatcacttgtattccccataacctaaaagatcaacatggatcagattggagaaatcagctggtttgctaagaggaaggtacagaaataataacagagattgagatgttggccttatcagatcctgagatttccatcaattctgtgagacttttgtactttcacaaaggaacttctcagagaagcaatagatgcagacattaaggctataactcaacaatcagatgaatcctcatgatgcgttctacacaagaagaaacagaacttccttagagaacatcatccttttacaaaatctgaaaagctgatattctgtggcacagaagcaatctcatagaaaatacatattcagtacttctcatttattaagccatttaaaggcctgaaaatttccctcattttaactcaaaattcaacagttcaggcattttctatgagagccctcacttaatctgtttatttgttcttctatctgtacattatcttttgttcatttaagactgtttattaattattttctctgtgttagacactggttaaggcagtgggaatacagaagtgaatacaacagacaacaaacaaaacaaaatgaaaataccttacttcatggagcttacattccagtggaaatacttgagtcccagagtaataatgacagagttatctgtaacatacaaatgagacatttgtcccaagcacctcattgacttttgaaaggctgaaacaggagaatccaaatgaaaatatctatataaaataatatttcttatgcagctcagctattagcagtagtcttatataaaattgaatcatgtcctttcgcatctcatgggaatctccactaccattccaatatctaatttttttgatttatcatcaaatgaaggaatccttattcctggatttattcagcactgattttcagcttctactgaattctttcacacagctcacttcaggcgactgctctttcttggtcactgtgtgttgacgtaaatgtggaacatagcccctttaccttcaattctacaaagcgctactcattacaacccattatgtatggtagatttttacaaaaattcagggtaatgaccggtgattatagtgcacaaagcccaacaaagcacaagaagggaaaaattttacaattaaattttagctacaccgaatagtttttgtttgttttgtttggagacaaggccctgctttgtcctccagactccacaggctggagtgcagagacataatcacagctcactgcacctcaacttcccaggctcaagccatcctcccatctcagcctcctgagtaggtgggaccacaggtgcacaccaccacacccacggctagtcctattcttaaagctttcaataactttactgtcctaccagtacctcccctagaaatgagtagacccacgcagacatatgccaatacactgcctgaggcatctgcacactcatcattttcttcttaagttctaatttgtttctattttgctgagcgttctcttttatgttgggcttttttcttttcaacctcacttaccctcagtagaatgtaagctccaaatgttccaggagttttcagtctgatgcgttctatgttaaagctctaagatttagatcagaggtcagcaaagtgcagcctacaggtagtatttggcctgttacctgtttttgcatgagctttgagctaagaggagtttttatattttacatggctaaaaaattatttcaaaagaataatgttgcaaaggtaaaaatgtcaacctccatgagtatagcatgtttgtttgttttacattccgtttttatggaattctgtggctgcttttgtgctataatggcagaataatagcgacagagagcttgtatttactgtttatccctttacagaaagcattgccaactcccaaattagagggtttcctgttatataggcattaaaataatattttttaacattacatccaaaaaagacttatcactactaaattgaggatttcaccctttatccatgaataatcacttaatactcactgaatgtcagtatcactgaatgtcagcatcttcagctaaaacctagaggaagagttctatccatcctgtcaaaataaaaaagccgtgagactcaagtgagatgtaaataaagttctttgaaatctgacaaacttgtaaatttacatgttaactgagggtggcaggaaaaggggtaaattgagatattagacaacatctgaagtgttacatggttgcagatacctttataactcattgaaaatggcaaggaatgaatccccacaagtcaactcctctccgaccgccaagtttacaagtatcatataattgtattgatataataatataaataaaagcaaagaacaaagcccaggtttttatggaaaagtgatccctagtcatctaatggactgcctaagcatcaagacagtgaagaagaaagatggaagactcatgtgcaatgcatttgagctcaccaataaattgaacctcagttttctcatctgctaaactgataaatttttcctttccctcatcaaattgttttgtaactttggagagagattgcaagcagtcatgttctacatatttttcccattatccagcacacagtaggtgcctgctgattaaataaagttttatggttctgaaaggagtttcaaaatagaaacttctttctgccaaaatatgtatgccaaagacaagtgttgcttgaagccagccccaaatgtcctagactcttctaaaaggtaaagttcaaaaagtatatgattaaattctacaaaaacaattcaaaacctccaaaacagatgaaagtgtcattgtgattaaccaacagtgcacattttaatgctgttataataaaccagggtgagtacattacattcccatcagcagagtgagtggtcaggaatattgcacattaatgtgagttacagtgtctgggagccattctttccaaaggtgtattaacaattctcactccatctcagggagattgccatggaactcttcagtacctaaaattccagggtgcttatttcagaaaactgaagcctagatcaggtccatatgattaaaataaagtggacgaggaaggcaagatttcaaataattaacccagccacctgctaaaatgttgcaaagatgatctaggttagtcacgtcctctcagactttggaatgtttcagaacaagttgggtgaacttggaaacaataaggatgaatacagttcattagggacaaacgttatctagagctacctttctaaaaattttcctacctgtctgattctttgttttttttctttggtttcatttgttaattcattcatttatttatgcaaaaacatcattttctaagacttatattagattctgaatatttactaataaacaaaataaacatggtcattgtcttcaagttgtacatagcacatagggcctaactctttgattttgagtttctactaatgactaccctttattctgatgtccactctagctttctaaggcctaagtccacaagaggccagatgaattcaaagaaggattcatagttcccttgggactctttgaacattttttcatttgtttcactacaaattattttattattttattttttactggtttagtccagaactgttcatgacaaactcttctgtgtactcacataattttaggtactgaagatagcatatcctgaaagaattacgaatacgatgagggagactgaaaataaataatactgatacataatacagtctcaaatgatctatacaaaatacaattatctagatgtaattaaatgttcattttatggatagggtgattcatcgactgtcatgtactgagggtgaagtcacagaaaatctctttagaaaagaggaatattagaaatactacatcttctcccacatagaaaaagagggtcattgctgcgttgggttctttcaaaattcaaatattaatcatttttttcaatttttgtttaatttttattaaaagtaattatttcttttggtcttgaaaaggggctttttgcatatttatttatttaattttttatttctgtaggtttttggggaatgggtggtgtttggttacatgagtaagttctttagtggtgatttgtgagattttggtgctcccatcaccagagcaacatacactgtacctaatttgtagtcttttatccctcacctccctccagctatgaggatgcaaagccatatattaaatttttaaccccagcacctcagaatgcaactgtatttggaaatacgctccttaaagaggtacttatgttaacatgaggtcactgtgaggtggattagataggatgggcataacctcccttaaaggggaacaaacttgccaaatagatggagaggaaaagctgcccaacagtgcacaaaccacatcgtgggatcgtcgttagagcatgctgcagcaaggaggtagaagagcagaaggggaaatctccaagttcacaaaagtacagaaacccatgattgatgtccttgggttgacctgttgctcactataacagtaaaaaacacacccttgagtggagacttaagatgctgatgtgacatgtgatgtatgtactggcatgtacatcagtagcacatgtgcatccagaggaccacccagaacatgcttaacagcaacaacccttcccacccacttcataaataattttgtaagctttccataaagggagattccccggtgtcaatcaatgccatctcacctttcagcagccttctctgacagctgtcagagtgcactttccctttgcagtaaattcttttgcttacttttattttggactcgctctcaaattcttttgtgtggtgaagtcaagaacctgaaccagcccactggctacaactaggatgagccctaatccaatatgcctcagaagaagagaaaatttaaacagacacacacaaaagcaatcccacatgaagccacaggcagcagacagccagctgcaagccaaggagagagacctcagaagaaactgaatcctgaaaatttgagacaggcctcagttaatttagaacgtttattttgccaaggttgaggacatgtgctcatgacacagccttaggagggcctgatgacatgggctcaaggtggtcagagcacagctttgttttatacattttagggagacatgagacatcaatcaacacatgaaaatgaacattgatttggtccaaaaggtgggacaacccgaagcaaaagcgggacaactgaagcagtatgtggcttccatatcacaggtaggtgagagacacatggttgtattcttttgagtttctgattagcctttccaaagaaggcaatcagatacgcattcatctcagtgagcagaatagaatgggaggcagatttgcccaacttgaattttccggttagctcagtgattttcagagcccaagatagtttcctttcacaaaaacaaccctcatgacagcttgatattggatgcctaaacttcagaattgtgagacaatatatttatattgtgaaagctacccagtctgtgataatttgttacagtgactctagcaaaacacagggaagaacagaatggggtctcatcccctcctctgtgaagccttgtcctgccaggcccatcttcattgcttttgctataacgttcctgagctgctgctgtttttcccttatttttattcagttagcgctgacagttttttcctgccatataagcctcacgtttaccatgttgacactgaattatattatgaaattatttgtggagcagggaaaagaaacagtgtctcaagaccccccagaattctggttttgccacttactcagtgacactaattgaatctcttaacaattttgagtttccctggctgtactggcacatagagatactgctcaacttactagatggttgtcaggaataaatacaagactacaagcccaagtgtccgatagagtaagcacttaacatatttatattcttgaatatgttgattctgaatatcctggggcagcttattccagtttaatgaaactgagttgtggaaaaaatatctatattgagtccaaatcttgcacagttaccttttactcttgaatgtaagttctgctcaaagagccaacgcacaatatttctctgtagagtcagaaagtaaattaagtaactattttctccttggtgctttgttttcatgtttttcttccagttgtttagtgtgatgttccactgattttagagggaccaaagcaatttaggggatcaacactgagaaatatgggagagcagaaacagcctagattcttcatagggtcgatgctgagtctatgtttttaaaaatctagaaggatgtgagtagaaaatcaaaggctttgtacagaaccagatgaaaagtggatggtcagatagaagaaggtgagagatggccagggaaaccacagtgagagaaaaccaggcacaattctagagatgtttgtatattagtctgttttcacgctgctgataaagacatatccaagactgggtaatttataaagaaaaagaggtttaatggacccacagttccacctggctgggaggcttcacaatcatggtggaaggcaaaagccacatcttacatgggggcaggcaaaaagaaaaatgagagccaaacaaaaggggttttcccttatgtaaccatcagatctcctgagacttattcactagcatgagaacagtatgggggaaaccacctgcatgattcaatgatctcctactgggtttctcccacaacatataggaattatgggagctacagttcaagatgagatttgggtggggacatagagcaaaaccatatcagtttgtcaacattaccattggctttttcttcacatcctctaataaaaagcataactttccatattcccaaggtaatatttacccatttaaaatattagattcaattaaataaaataaattttaaaatacctataatttcatcatagacaaagtaacactaccagctcgttgcagtctttttagcctaaatatataaattattggtttaatgcctgaaatgttatcatattgtgtagagtcatttgtagcctactgtttggtacttgaaaattgaaaaaaaaattaaacatctccacatgtccgtgcatactcaaccttatgtgagaaatcggaatttatttatatttttggttgctctgcaaattggtagaatctttctacaagatcatttgttaatgcaggaaaagcttaaagtgacttggccctttgacacagtatggttttactgatgctttaatttgaacttctttgatgagaatttaaaaaaatatattttatgtattttgtggctatttccatttattattaatcaagtgaaatattcatatacgttttctcattttttcttttatgtatttaaaattcctcactgagttttttttacatgttaaaaatattgatccattatctgtcatgcattttgacaatttgttctttacctttttattttgtaatgttggatgataatacattcaagtcctttcatagattgatgggttaatctagacccttcttattaggaaaaaaagtgggtttgcagcttattgaaaattaaacaagaggaaaaaattgaagaaaaaaataaaggaaggaacaaaatataagaagaaataaattccagtgtagatcaggaccaaccttattttatgctatcatttcttgaagtttggacataaatatagacagtgtttatcaaaagacaagaaaaagataaattccaagtcaatttcttcttgaagctcaatatgtatttaaatggtttgactaacctttgaattcactaaatgagttaattgaattatgtggtttcaaccaatggagtttctactcattcatctccagaagagtttgaaagtattgagcccgtttaccagaggttaaatggtgacagcctccgggatcaattagtaggccagctaattaggtgtgattaatcagctctgaaccatgaattgttcttgtgtaagtgttgtctctttagcttatgagctttgatgactagctgagctgcttctgatggactgtatacaaagataggctttgcccatatatagaaattatgtcccatgacggagatggaagaaaatagctagtctggaagcagcacaccatatctgtcattttcacttttttgcaacatgcctaactcctagaaatatatttgggcagtcttgtgttgagcatgataataatgttagtgctaaaaatagggacttagtctatgaatctgttttcacttaagagaaagtatgtgtagatgaaagataataagcatggaatctgaagagtcttggtccaactcctgactttatgatttacccttactcttagccaataatttttataatacttctttgaggcttatcactcgtacccaagctctatatattccactaagccttcttctaactccatttccctaaatagggctaattttcaggtagtcaaaaataaccaactgaaaaataattgccattgtttaggagtgactttttttcctctagggctttctaagctatttttgccctcagtgacttaaaatgatgttgaggagacaccattcagcctcaggaagaacaatagaaaatcaccaatcactgacacttggtctgtaagacatcagttcaaagtcatctccattaagttccatccatttatctttgttttgttgcatttgctttgggtttttggtcatgaactctttacctaagccaatgcctagaagagtgtttttttgatgttatcttctagaactttcatggtttcgggtcttaaattcaaggctttgataattcttgagttgatttttatataagatgagagatgaggatccagtttcattcttctacatgtggagtgtcaattatcctatgcatccaacaaaggactaatatccagaatctacaagaaatggaaacaaatcagcaagacaaaaacaaataatcccatcaaaaattaggctaaggacatgaatagacaattctcaagatatgcaaatggccaacaaacatcttaaaaatactcaatatcactaattatcagagaaatgcaaatcgaaatgacaatgcaataccaccttactccttcaagaatggccatatttaaaaataaaaaaaaatatgttggcatggatgtggtgaaaagggaacacttttacactgttggtgggaatgtaactagtacaactactatggaaaacagtgtggagattccttaaaaaactaaaagtagaactatcatttgatccagaaatcccactactgagtatctactcagaggaaaagaggtcattatacgaaatagacatttgcacattcatgtttataacagcacaattttcaattacaaaaatatggaaccagcctaaatgctcatcaaccaacgagtagacaaaaaaatgtggtaggtctaggactggtggctcatgcctgtaatcccagtgctttgggaggccgaggcaggtggatcacctgaggtcaggagtttgagaccagcctggacaacatggcgaaacattttctctactaaaagcacaaaaattagcaaggcatggtggtgcatgtctgttgtccctgctactcaggaggctgaggcaagagaattgtttgaacccgggaggcagaggttgcagtgtgctgagatagtgccactgcactccaacctgggagcctgggtgacagagtgagactccacctcaaaaagaaaaaaaataaaaaatcatgtggtacatatataccatggagtactactcatccataaaaagaaataaaataaggatggagttggggaccactattctaaatgaagtaactcaggtattaaaaagcaaacacacattgtatgttctcacttatcagtgggagctaagctatgaaaacacaaaggcataagaatgatacaatggactctggggactcaggagggagggcaggagggggctaaggggtaaaggactacacgttgggtgcagtgtacactgctcaggttatgggtgcaccaaaatctcagaaatcactactaaagaacttatccatgtaaccaaacaccacctgttccccaaaaactattgaaataaaaataaaaaataaataaaaaacaaactcatcaccaatgcaggagcttctctgatgttctccattaccttgcttcttccaagcagtaaatttagagacctgcctttatccggtatttgtccttggctatgacattccttcatcaccccctatatgcacgatcagttgccacgttctattgattcaatcttctaaaatctctggaatccacttgtctcatgtttatcgggaccccaccgccaccccccaccttacaggtaccattatacttattctcactcatattattgcaacagcctgttttctctgcctcaatatttgtgccctgacatacatttttatcatttcccagttagggggatttctactaaaatagataccagatgatgtcactttttcctaaaatcttttaggagttacccattacacaaagagcagaatcccatcaccctagcaaatcttcagtcctgtcgtgtgattcaacaaacttacattttctgccaattgaccttcataatacatcatttgtgtaatcatgtgtcttgcagttctccagtccatcagttctatgtccttataaagaatgcctgctagcttgggtactggtctttcaggaccttctgctatgaagttttcaccagctacattaggtgtcatttctcccagctccagtgacattcaatcatacctctatttttagggcttatgcacatttagggaatgtggttgtcaaatgatgtaaaaaaaaacttgagaaaagggatcacatttttattcctatgtctccagctgagcacattatctgcttatattaactgctcagaacaggtgtattgaacatgtgaatcaatcaatgaatgaatttttttcctcctttgattctcaattgcctttgacttactgttgtctcaccatgcgatgatgcttaggatgctgatctctacatatgcctatctttctggtagaatggccaaattctaaggacttttgtttgaattatttttatattcttcataatacattcacaatatatgacacataataggaactctaaaaattgttgagtaatccatagatccattgatttatttatttacttgtttactaatggaatattttgaatacccattgctcattgtattaacccatgtttcctagaaatggagcccatggcgaaaacttgcatgttcactctgtatttgtgaatacaaccctaggaaagtgatagcaaaaagtgagcgagtcagggaggaagggagaatcaataaaatgatgtacgtttctgaattgctcacagattccccacaagcacaactgatggcaaagcctcacagaacatcttcagagggtattatatatgtgtgtatgtaatatttgtattatatatttgtgtatgtgtgcttgtgtgtgtatttaccccaatgtaaatttaggaattaggtgtgagtatagattacaagtgtgttaccccaatgagaatggggcacaatattagtccaggacaaattcattgatatggagtcacttagcagagattctggatttcatatattaatttgtgtggcagtaagtggcttgaaaactcacttgttcagaggcaaaacttccttgacatgatgtgaaagaaggaatctattatctgtaagaaataaaaatgttctagttgatttaccatatgcaatctgaacccttgtctcttaactatattctttgagacaacccaggagacattcttttcactgagacatagaaaaacatattagagtgtagagcaatttcatttttgaaatgctctgctatgatttgaatgtttttgcctcctccaaaattcatgttgaaacttaatcctcaacgtaacagtcctccagtattgggaggtgtggcctttggaaggtgattgagccatgagagctccaccctcatgaatggcattaggtgcccttacaagtgagcttgacagagggaattcaccttttttttttctctgcccattcagtctcttctgaggtgtaagaacacagcactcttcccctctgaaggatgtagcaacgacatgccatcttggacacagacccagctctcacccaacaccaaatctgcttgtgccttgatcttggacttacaacctccagaactgtgagaaataaatttctgtttgctataaattacccagtcttaggcattccattattgcttcgcaaatggactaaggtgcttctcttcattgggtcacattgaccagaggagatggttccattaacatagatccacctaatttcagtggggatgatgggataccaggctgggaaagatgaggtggcagcactaaacccctaaaaccaaggtaggcacagttagtgtaaaaccagcaggaaaacagtggtgaatcactgtgtctttggtcactgtttccccataaatgaaacaggtagcctactggagtatcactttacacttatagcgcaaggctttctaggtctggaagccaaaaaccggactcaaagttgcaacagtgtagagtcatagccctttgcaagtttttaatctaaactggttcaaagacttgatcatattaagaaaatatcccctagcagtttcacagtgtgtaatgttaaataatattccaagtctttcctgtagggacctgaagccattttctacagtggctacaatgggaaaacaactaaacatgggttgaaaattgaccctaattcctgggaacccaaaatgctaatttgcctgaccaaagtggatacttattgcaatcatacgataaattaaatattagctgaagttaaaattacaggatcttggtgactttattatatcaatatatggttatattcctaatttctaaattaataattggcacagacatacttggaaatctgtagaaaccccattttggctttttcacctgtggatagtggccattacagtaaggaaggggtaagaaaaagattatgtagctttctctttgtagtgatgttaattatggtaatgcatgttaatctaggagcaatattttattttcatggaaattgcaaaggatcaaatacctgaaatatgcaagattataaaaccatatgatattctcacttaatttgcctctttggcctgtgcaaagttgaatgtgtcttgaaaaaaactttagcaccaatatacccaagttatgaatccaatcgcagctgatactacatatatagtataattgggaagcaaatcaaaatagtccctttcaaaatgcagctgttggcctaatggtttttctccctttgtaattttcaaggagcatcagaagcagtctgatagtatataccagatctaatagtataccttttagaatcttgttacaggactggaccaactcttcttttctctgcctaatatagtctgcggagttattgaccattctgacattccaagcatcatcataccaatcctccacatctgtgctactatggatctgatgagcagaattatattaaatgccttggtagtacttacaagaaccagagaaacagagagaatttgaacaaaatttcaagggtccactacttcagtgaaattcctagaagtcgaatagtcaagagcatgtaaagatagctcttcaaagataataggcaagttgctaccttttgaaccatctaccccaaaaatgaaaagaaaaaggatgcacaagcattactgcaccttttttctggattttagaggcagcacatatcatatttaagtgtgtttctgtggccaatctttagagtcacccataaacttaccagacatcagttataaacagaattaagagaaggctctgtaccaagtctaagcttcaatgcaagcttttctcctaactggaacttaagatccagcaaagcgaatggtacccaaagtgtctgtggtttggtagaggtggtatatttaacctctcgaaagaaccgataggaaaatcacacagcaagcctctatggtttctaataaatccatgccgtcttctatggataactatttatattttataaacagccctcggcttgctactgggtcataggagaggctgaatacttaatatgggacatcagatatggccgtgtaagctgagtttcttatcatgttcttgttgttatttgactcaccaaaccataaagttgagtgtatgaaaaaaaaattatcaaggggaaaatagtgcacaggaaattaggcttcagctggtctaaagggcacaagaaagttatttgcacagataaagtcagctccttcgaaacagataaccacaacattacctgttctcatttaatttctccttatatgacctggtgtggaaaaactcagacttgttttactgatggttcagcccaatattctagcacaaacatgaataactgcagcccaacaaccctacttcagagtttcccagtttgacaacctccccaggagacagaatttcaagtgatacattagattatctattttgtctagacagagatataaccataaatataaatttgcatggattcttaagcagttgataacttgaaattgcttgagcacattggatcctattcattatggaggagcagagatttgtcttttctggaatatacatatattctggatatggatttgcctttactagtcatagtgcttcttctagaatcaccatatgtggaactctaaggctgtctcattcatgattatgacaatccacacagcattacttctgatccagagagtcaattcacagcaaagtatgttactgggtttatggccatggaattaagtggtcatactatacaccccgttatccagaagcactggtggaaaaagaagatggacttgcttactgaagattcaattatcctgccaatttgaagataccatactaaaaagatcaagttctatattacagggcatagtatactctttaaaataaattcaatcagcagtgtatggtgatttctttcatatagctaaaatcaatggagctagaaaaatggtatattttgggtggcttctctctttattatacttgataaccccttcacagaatttttggttcccatcctggaaactttcagatatgatggttggaggccttagctcacaaggggaaaaatgtttctaacaggagatacaaaaacaatctcaatgaattgaaagtttagacctatctctgattatttggggatctttgtgttactggactaatagggaaaaatgggtgttaggatgctgactggagtagttgatcccaataataaagaggaaactgggtagctgctacacaatggagacaagaaggctatatctggaatctacagaatattcttggattctcttaatatttccattgccaatagtagaaggtaatggaaaattgcaagaaccaaaataaggcaagaccaaaaatcattcaggcccttcaggaataaagttttgaatcattctactaatgaagaactttgaccatctgaattcctggctaagggtggtgggaatatggaatgagtactggaaaaaagaaagctatcaactatgacctcagaggcaactgcaaaaacaataactataagcaatttgcacattttctccttgactgtatgtgtatatatatatatatatatatatatatatatatatacacaaacacacatacatatacatattttacatatataatatgtagaaatatatattatatatattttattatatatttattatatatattttatgtatattttatatttattatatatattttatgtatattttatatatattatatataaatatataaatattatatatatttctacatattaactattgtttatatttctacatgttaaatattttctctttttccccctgtaattttatacgaattgtattagtccatttcccacccctataaagaacagcgtgagactgggtaatttatgaaggaaagaggtttaatcgattcacagttcctcatggctctgaaggcctcatgaaacttacaatcatggtggaaggcgaaggggaagcaggtaccttcttcacaaggcagcaggagagagagagagagagagagcccaggggaaattgccacttttaaaccatcagatcccatgagaactccctcatatcatgagaacatcatggaagaaaacaaccctcatgatttaaccacccctcaccaggtccctcccttgacacatggggattacaattcgagatgagatttgggtggggacacagcagcaaccatatcacaagttttctacaggttaaatttcacattattatttagtaccagaatatttattggcactgtgattaattttgagaagtaaataatatagccagcaattaatacaatgactgtctggaatgtgtgttttctcatttgggggagaatgtgtgagcctggacacttctatagaggttagctgcctcttgtaaagtaaaaacattgattttttttttaaaatagaaagcatgtgtagaagagtactcatggatgctaagtcaaccaaaggatggactctgaggtttattaatttactgattctcagttccatactccctctgcttctccttgtttgtgatattggaagtagactctgcagactgtattttttcttgcgtgccatagcaggttctaggaggacacttcaaggcaaggaaagggagagcatgtgttcgagtcttctgtgtagtggcaaggggatctaatgcagggatcccgacagcctttgtcatggtggtaggctgctcttgagattagctgaggggtgtccaggtcatttcttcattaccacattggcaggaattcttggaccaacacactatctcatttcttgtctccacaccagtgggcaatgtgtttctgtggcagctgtgcctcttgttgtagggctgaatctcagtcttgcatttccccagggctgaaggaaaaagaaccaaggaagaacgttagaaactctcagtattatatttagtaacccctttattgtctctcagctccaaaccaactgtgctttgccttgcttgtgatcctggaaccagattccaaagacagcatttctcccttgccgttgcagacgctagagggaaactacaggactagaagaggaagaaaatgtttctgttctcaatagttatgaattcctcgcaccttagaattttatttttcctttttttataattaagtgtgattaggagctcaatgtatgtgcctttcccacaatattcccaatatttgtatgttgaactttgaatcccctgtgtgactgtatttggggtaaggaataattaaggttaaatgagatcatagggtggtactctgatccttctaatggaatatgattcgtttcatcataagaagagacaccagagagctcccctccagcccctccacactccaccatgcacatacacaccatgaaaagaccatgggcagggacagaggcagctgtctgtaagccaggaagagagccctcaccagcaactggatctgccagaatcttgaccttgaacctctagcctccaggctgtaaaaatatatgtatatttctgttgttaaagccacctagcctatggtattttttatgcggctagagaaaactaatacaaatacctttgatctaactaaaagtatttttgttaaatttttgtctgttaaaattgaacatgcagtttctatcttctgagtggatattggcagatacaggcaaaggtagtcgtgggaaggatggagagtcaatttatctgtgtgttctctttttttttgggtgggctggtaggggtagtctgagtcttgctctctgtcattcaggctgaagtgcagaggcacaatctcagctcattgcaacctccatctcccaggttcaagtgatcctcccacctcagcctcccaagtagctaggattacaagtgtatgccaccacacccagctaacttttgtatttttagatggggtttcaccacgttggccaggctggtcttgaactcctgacctcaagtgatccaactgcctcagcctcccaaagtgctggaataacaggcatgagccactgtgcctggcctgtgtgttctcttttatgtttttcattggtcaaagttcttaacacttgaggattagttcatgggaagttatatctccacatgtctttgaagtatctcctatttcctacagaagcctttgggtaagcgatagtactcagacctagtattgatgggaataattagaatcctagttgttatctcagagctgtgcctttgtatcagctgggataagtcacatttacattgggttgcctcaatgttgactaatctagtccctgtagaattggtcaccatggtagtggtgggggcttaacaagagtccaaagaggaccttgggcaggagaagccaaggagataaactctgatttggatgaagggaataaagatatgtgacataatgtatctgaagctttcaggaaaaagtgaaaatattaatagatttttcttcccatggttcactctctcttgcaacatttgatcagctatccctgtctgtatgctttctctctttcttccttccattgtagctagtactgtgatatcacattttttttcctagtgaggtaatctcgatctgcttgaaagactatctaaaattacgatgggaagccaatatatacaaacttaaaagtaggatgcatggaccagatttgttctaggatttaacattttgtcttcttttatttactaccaccctaagaaaataaaattctgagcctgtctgttcaagattgagatgtgagtcttgtagaataaccccaacattcaggcagcctgacttgattctcatcagggcaaaggaggcttctgtttcatccaactctccagagctacagacaccaaataaaaatataggggtgagtccagaggtaataataattatgaaaaaaagagaatcatgtgtatgtctcttctgactttaacaacaaggaattggagattaaaactcctaacaaaatagctttaaaaaatagatataacaaagacatacttatgtgtcatgcacagtgctagggacaccaacaagatgagatatagttcattttctttgtgctcaagaaagtgataaacactgtatacatcagaataaaatacattattacaaaagcataaaaaggggtataatagcattttgtggaaacgcagatgcagaatatatcatctgttgtagacaattgctattttttttgcctacccagtctccgttttctcttctggtgatatcgctccgatttccttttgaaaactcatactcccttcattctcaatccacatgtgttcattgcccttatccaagctcctgtgtggttatgtgatccaagttgagccaatgagagttcataatgagatttgtctgagcttcagaaaagagaaacactctctttttctcctctctccttttttctttttctttttgtttttgttttacttcttgtagtgaagaaagttctaaggactactgaaactgctgataaccagttttttcaccatatggaaagatcctatctatacaatgtggcttctacaatggcaagacaaggacctagttggagaaagagaaacagagaccatgtctttgcagcccttagatctagccatgactgaagttatatttaacttggaaatcctcagttgtgtgagctaacaatgtcacttttttgtttattccaatttctgtttggtgtatttgtaacatttcaataaaaatactataatcaatatataattcaaacaataaaaccattatctttaattctacctgtgtatcagagttagctggaaaagaaaatagtaatgataattattataataaaatacacatatctggatcttaagtcatgcagactaactctgcagttccaatgtgcaacacactttctctcagtctcatgcctaagcttcaacatgtcttatgtatttcttttctctccgttgttcttctgccttcagtataagaacaggcacatcatagcctttgggagagattagacatctggaacagagctgagtcagcctggttatctcagttgagactttagacatttgagaaagaccaacataagaaaagctgcctacttaacctgcagctaaccaaagatggatgagtaagttctgccaagcccaacttagatctatcaaaccaccatgctaacccatacatttttcagcaaacataagtaactattattttaagccagtaggttctggggtattttgttatgcagcaatagctaactgatacactcaaacacatttccacaacttgcataagttatatatctcagactcataccctagttctatggtaccagagcccatgagcttttccaacttactattaccttggttcttccctgctgagccttttattcatgaatttttaaggacataatctttctgtgaagtatagaactctgaggtttattttctttttcaatggagattatctaatttcctttcaaagtctcttcttaacctcatcagcacttgtcatctgtgcttaccatatcaagtggttctgcattacttgtgcaattccactatgcaggccagagatgagcatccctgaaataaatatgctgccaagagagtttatctgtcaagagaggtttgctccaagtttctgaaatacaaagggacatcctgatttaaaaacaacagatatgctacgtgggtatgctcaggaaactcttggttgactcagagagctatttatgccatatactatttttttgtaactatttataatttagagggaaaattgggaggaagggaaaggatttaaaagtttttgagctcttctattgaaccaaaaatatgtacatgcactattttattgtcacaaaaccttatgaaatatgaagtatgtattattcatacatcccaaagttaaaaaaaatttagtttagtagaagttaaatattgtattagcgttctccagacaaacataaccaacaggagatagatgatagatagatagatagatagatagatagatagatagatagatagagataatttataatggctcacacaattatgtaggctgagaagtcccacagtgtgcctcctataaggtggagaaccaggaaagctagtagcatggcttagtctaagtctgaaggcctgaaaaccaggtaacataactttcagttagaagccagaggcctgcgaacccagagggccattggtgcacatcccagagtccaaagactggagaacttgaagtacatctgctgtctaagggcaggagaagatagattttccagctccagaaaagagagcaaatttacctttctgcccttttgatctatccaggcctccaatggattggttgatgcctgcccgtattagataaaggtgaatctccctcagtccactgattgaagtcccaatcttttccagcaactcctttccagacataccctgaaataatgtttgcccagccgtctgggtatctcttagtctagtcaaattgacaactacaattaatcatcataaatatcatataaaatactcagcttgtacataaataaagctgggatttgaagcataggccttcacattgcatggcagtataaaatccaaatttggtatgattaagactaacagaacaagtaactcacacttctaactagttttataaccttggaacaagctgatgtagtcatttattttttatttttattttttattttactttaagttctgggatacatgtgctgaatgtgcaggtttgttacataggatataaccatttttctcatctgttaagtgaagaaggaactggcccaatttattttaggctcaaaactgctttatccaatactgtcaacaataactttaaaagagatatattcacagtccccagggatgcaaattcaaatttcatataatttattttcattttaaaaaactataaaatttaatcctctttactttttcctatgatatttcatcacccaccattgtttgaaacaaagtggaatagttgttcagcatttccagaacagatgtaatcagaaagaaaaaagctagtactgaggcacgacaactctctacaaacacattttttatctggaatgtgatccatgtgtccctgaagggcagggaatacctgatatctactaaaaggcaaacaactaatcttaaaggtgattttcagaaatctttgttctggtatagtgaaatattttctcaggctttatcattacttaatattgtaaaatgtcattacgtatgagaagaaattacaaaatcccttatattcattcttagctagatgcccatagattatttttcattatttaatcagtggctttcctgcttgactttctatacgctttgcactgcatttggagatggacttcaacatttaggtttacagccaagtctccccttacccaaggctgtgacgttgggcaaactgtttcctatctagtggtgtagtgctagtaataagacctactgaaaggtgttgcagccaaagaggtaaataaacataaaaagcttggcatacagcagaccgtagatgctcaactgagtctgctcaattgctcatttttgggagagagagtcaagtgaaagtgagtttagatccaaattatatcttctacttcctatggcaaactcagcaactcatttctctgttttgatataatgtcttcatttgcaagatgggttgttaaattctctacagttattctgagaattagaaaccatacatatacatactgagttttagaacttggatggcccaaaggatgtgatgaaattaaaaaaaaaaggtacctcttataattagatcctctagtgtagcaataccttcatttctgagtcttgaggctaaaaacctagaagattttcctacagagaaacttcactggaatcagtgcagcattcacttttaaatattacaacaaaggagcacatagggctgacttcattgcactagccttcaaaacaattaggcataatggtaaatcagggtaaactacatttctgaatttatctacagtgtaataaataacatctgcatctgcaggggaacaatttacagtgttctgcgaaacacaacacggtagtgatcagattctcttccatcccttatgtaatatttctttattatttggtaaatctttcttttttagagtcatgccggcagtagtaggagcctttgctgtcctactgtctaagtacttcgtttcataaaggaagactcttaggagtagagcactatgttaccgacccgaggtttcccaggtagaatggagcaaaattgggcccagaatgtgggaagtacggctgattaacatccctctcattatatcatacacttcagtgaaaactggactctcaagtttggaggggatctaaaaacatatctcatgctttcttcttttcagttcatgaatcttctctggattaccaacaaaagtggccattaagccttttcttgactatcttcagtgagccaaaatgtactacctctgggagctagacttccagtattaacagaaaatgaacacgtattggtaacagaactttatcagaaacagaaacaaataaatctgggctcctcagaattccagaatccacttcagatgttgagactcctaactgttgttatataaagatttgataaggaagcctaaaggcaaatagttttagtaaagcaacacttttacattagtgaaagccatgaaaagttttattaaaaaattgaaaatccaaagacataaatgtatattaaatttaaactaaagattttttttttattttagtttaagcatattaaaatgccttcggtagagtttggtttgctatttgaattattaggttcatcatatttcaattagagtaatttagaatctaatatatacctggcactctgctattggctttataaacggcatctcattttcaatatttatctcttccaaaaatggaaaaaaaaagtcactttttaattgtcctcgtatctgggatgatgtgaaccagtggtctcaaacttgagcatgcatcagaatcactggaagaattgttaaaacagattgctgggcaccactcccagagtttctgtttcagtgggatgtgggtggagtcagggaatttgcatttctagtaagttcccaggtgatgctgatgcttttggtccagagtcccaagtttcaaaactgccactgtaagccataagctttcaatacaaaaaagagtaataaaagttcatctaattcagtttaccagctaggtaatgttgagcaaattaattttgcagaagctcacttttattatttttcaaagtaaaaataatatttcagtttgaaattgttttcgatgattaccatagagaaatgtcatttttaagacaactattattattatttttttgctttccttctcctcttctgaaatcagaaattacatgtgtatgccattgaacacagatgatgtaaagacttttttgttaatatcttaacggtgtgaagcactgggaaaaacaagtacctagaatcagatttaggttcaaaaactgtttctagctttattactttggctgcattaaataccatctattagctgcaataaccctcatcccccacccacgaattagggataatttggcacttctgctagcttcagctaaaagagcctttccacctgaatgcctgagaggcatctcaagctcaatggaaactcacctcattacctttctcctaaagtcttgattttagtaggttgcaacaaaatacatccagatatttaatcgagaaattttgaggtgacaattggttcttctacctcagccatatttacccagttgaacatttgcaatttccttctaaatgtttctcaaacattcttttcaagtctttgttcagctattgaccatctctcactgagtccattgcaagagccactgaagttgagagttgtcattgtgtgagacaatccaacacataaatccctcttttgtgtttagaaaatcctcctattcttaaccagtaagctccaggtaagctctttcccatcttgccttactgatgggtcccaggatctactaattaggtgctcccaacttgatcagaagctaggaacaccaagaagcaagaaccctgccagactgattccggtggtgaaagtagtagcagtggtctcaaccatttcctagaggaatggttatctgtggttctagtggaagagtctatgctcagtatctaagatggtacagaacccagttctgccatgatagtgatgaaatctctgtgttttcctgggattgatggggctccaaggatatgagattctcagttttaaatctagagacagtcatggcaaactaggatagagtctggaggtatattggtactttgttcctgactgctgacactcaagcctaagtctctgaaccttccagaaatgtattagatactttaggatcctttaataagtatattttctgcttacatttaccaaatagttcgttgtttgcaattaagaatgtggaccagtgtcacttcctactttgcccccgaccttcagataaagttctttctttctaaagttctgacttctgtcagaacagtctctatagcacccacaattgtccaggtgggccctaaatccaagagataaccacccctcacttactgactcgcacccacatctcacagcattgccctggtggagatgtgcagatgcagcttgcctttccagcttcatctctcatgagcagggactatccttccattgtgtgagtcttgtcttgttgattgagtctttgaaggattttctgttaaagggtggaagttgttgcaagcagatgttttttgcatgagttgatttatagattttttttcttgaattgtaccagttatgcttggatgcgtattaaactttgaaaaatttatagcacagcaattttaaaagcagcatttcttatttttacacctggactcccactccttgcagcacagcaaggatttgtggtatcatagcaacaaataaataaataattatctaaaacaatgcctgttcatacttaggatttttaaaagtaggttcatttagcagctcattccttaggggtgtattcctctgctgaagacacacaatggaaggaaaaaaaaaaaggaaagaataaagcctgtttgaaaacaggaaaacttgagatttttaaataagtaaagacaaaggaagaatgatccctgggttccaaatgattcttcaattataaaacatgccactggctttgaaaactgcagctaagggttattgtgccacagttgcacctcagggttttgagtgctttgatatcattatcatttgaaacatggtgactttgtattcacgcatacagtgcataaatttctaagttcaggctacacaaattaacaaatagaaacatttttggaaacaacaggttttcctttgtgatttgatccccaagttaatgggtttgctttgtggtttcttagttatcaattggctaatcaatacattacttgctaactagatgatcatgttatatatctgttgtacatgcttagagagtttgtgacaagttgaaaagtcattgatcagaatcatttttctttagagaagcctatggttattcttatataaagtgcagtattatggaagaaaactatattttaaagtcaaatagaatctgattcaattgtagattaatgacccagagggggtatgtctttagataacttctttagtttctatgagtttattttttccatctgtagcttgttgattatgaggaagattcataaagctatccattttaggttaagtttgcacagtggtatagaacctagtatacatgcaataactatttttcccacaccctaagaagtaaggaatgagtcaatgactaagagattttattgagcagctattatttccatctgatttctttgttcatctctttattcaatcatctgatgtaatcaattggttacagagtccaaagatgagtaaatgccaaaaggagaacacagtccaatggaagaatcagacaattacaatgttttgggataaggtgtgtaatgtgctagtagagcatgatatgagactgcttaggtccctcaagaagccaaataactcaatggtcaagggccagttaaatgtagtttttggaaaaagaggagaggagagaagagaagtgagagaatggaagtttgcgaaagaagagaaccttgtacccagccaggacaagtggcatgaatgtgtaaggaggccaaaagaaagtgtaaatgagagagaattgagaagaaacaagatgaaagagacggtttagaaaagtttaatatacattaaatgtataatgtatattataatgtgagactcttataactaatgctttctggttttggcccagaacccttattttctttcaggaacaattacccatttctttagaaaatattttctcatagagtttccatatgtggtctaaatgagagctgatattttcttaataatattacagttactatacttgtgattggtttaggttgcaagattgcatgtttcctaaatttggcaaattaatacccttaagaaatagtatagtgaagtggttaggaacaagcaatgtggttagtaatacacgcgcccagttgtcagaaatgcaagcaaattgcttaacctttatgtcttgatttccttattggtcaaatggggaaaatagtatctatcttctaaatttgcaggaaagagacattaaatgaataaacatagacaaggactgaccctaacagtgcctatcactgccaccaccatcactcaacctctggaagcctgagaaccagaccatctgttgtctccattcctagtaaagccccctagcattcccaccaacataagccactgaagaattctgaaaatgattcaagctgaagaaataatacaaagactagattactgcatcaccccaaagccaaagacaaagcacccaactcaactgacgttataaatgcatctatgtgggaacacatggacacatagagggaaacaacagacactaggacatactgtagggtggagcatggaaggagggagaggactaggaaaactagctaataggtactaggcttaataactgggagatgaaataatctgtaaaataaacccttgtgacacaaatttatctgtataaacctacacatgtatccctgaactgaaataaaagttaaataaaaataaatagatatactcataagaaaaaagcacatgtctatagaaacaagtctttccctatgaaagctatcccacaaaattggaagaagtgactgttacacaagatcacagatatcaacgtagggacacaagaaacatgaaaaagcaagaaaacatgatactgccaaaagaacacaataattctctagcaatagaccttggagaagacaaaaatctaaaaaatgccagaaaacaaattcaaaatagtgattttaaggaaactcaatgagatactagagaacatagatttacagtatttaaaagttcagaaaaataaatcataatttgaatgaaaaaattaagaaagagatagatactataaaaaaagaacaaaggagagatcttacaactgaagaattcaataaaagaaatacaccatatacttgtgatcattaatattaggtgtcaacttgattggattggaagatgcctaagtagctggtaaattggttctgcgtgtgtctgtgagggtattgccagagggactgacacttgagtcagtgaattgggagaaaaagacccgccctgaatgtgggtgggcaccatccaattggctgccagcatggccagaagaaagcaggaagaaggtgggataagctggcttgctgagtcttttggctttcgtctttctcccatgctggatgcttccttccattcatcctgtccactcttcctacatcagactccaggttctttggcctttggactcttagacttaaactagtgttttgctgggaggctctcaggcctccagccacaaaccaaaggctatactgtcagcatccctgcctttgaggcttttggacttggattgagccactactgccttctttcctcttcggcttgtagacagcttattgtgggactttgtcttctgattgtatgagccaaatctctcttttaaactccctttcatattatatacatatgttctattaggtctgtccctctagagaagcctgactaatgcaatgatcatcaagaacttcaacaacagactacatgaagcagaagaaagaatttctgaacttcagactaggcctttaaaaataacccagtcagaccaaaaaaaaaaaaaaaaaaagggaaacagtttgtgatctataggatacccttaagcaaataatatttaccttttgagccttccagaagaaaaagagatggaaaagggtacacaaaacatatttaataaaatgatagctgaaaacttccaagtcctgggagagatataaacattctgatacaggaagctaaaaaagcctcaaatagattcaatctaaaaaggtctctctccaagggacaatataattaatctgtccaaagtcaaatacaaaaagagaattctaaaaacagcaagaaaaaagtgtcaaataacatataagggatttcccatcataataacagcaaatttctcatcacaaaccttataggctaggagggactggaataatagatttgaaaggctaaaagaaaaaataaaaagctacaatccatgaatacagtattcacaaagctatccttcgtaaatgaaggaggaataatatttttccagagaagcaaacactaagaggattcattaccactagattagccccacaagaaatgcttaaggaagtcttatatctggaagcaagggatgacattaacaatcataaaaacatacaaaagcataaaactcattggtagagcagatacacaagtgagaatgaaaaagaaacaaaaggttatctccataggaaaacaccaaactgcaaagataaacaataaagagaagaaaggaacaaaggatatacaaaacaatcagagaaagattagcaaaagagcaacagtaattctttacctatcaataacaaccttgaatttaaatagtttaaattctccaattaaaagatgtaggctggctgaatggattttaaagaaagaaaacaagacctagctatatgctgcctataagaaactcatgtcacctgtaaagataacatagactgaaaatgaatagatacaaaaagatattccacacaaatggaaatgaaaagcatgcaggaggagctatataagacaaaataaactttaagtgaaaaaataaaaaaagagaccaaaaaggtcattatataatgataaaggaataaattcagcaggggtatataacaattgtaattatagataggtagatacataagtaggtagatggatagatagatagattggtctaacactggaacacccagatttataaagcaaatattagtagaactaaagtgaaaaaatagaccccaataaaataacagtttgaggcttaagtaccccactcacagcattagacaaaacatctagaaagaaaaatcaacaaagaaacattgggcttaaactgtactatagacaaaatggacctaacagatatctacagaatatttcatccataatgcatatacacattctgcaaaatacatattcctctcatcagcacatggaacattatctaggacagactatatgttaggccacaaaacaagtctcaacaaatttaaaaatctcaaaaccatatcaagcgtcttctcagaccacaagagaataaaattaaaaatcaataacaagaggaattttgaaacctgtgctaatacataaaaattaaacaatgtgttccagaatcaccaatgggtctataaataaattcagaagaaaattttaaaaaaaattctagaaacaaataaaaatggaaacacaacataccaaaacttatgagatacagcaaaagcagtaatgaaagttttaacaatgaatgcctatatccaaaaaggagacagatttcaaacaaaaaacctaacattgtagctaaatgaattaggaaagcaggaacaagccaaaattaagataatagaaggaaagaataataaagatcagaagaaaactaaaccagaaagagacaaaattagcaatatataaatatcaacaaaacaaaaagttattttttgaaaagataaacaaaatcaacaaacctttagctagactatgaaaaaacataaagtcctaaataaataaaacaaaaaagtacactgattagaactgataatacagaaatacaaaggatcattagagaatattgtgaatgttggtgtattaattatacagcaacaaattggaaaacccagaagaaatggataaattcctgggcacatataacctaccaagattgagccagcaagaaatagaaaagctaaatagaccaatgatgtataacaagattgaatcaataataaagtcccccaacaaagaaaacctcagaatccgatggctgtactggtggattctatcaaacttttataggggaactaacaccatttttttttctcaagtgataataaaaaattgaagggaaagaaattatttctttgagaccattcagtgaacacattctgtgaggccagcattactctgaaaccaaaaccagacaaggatgcaacaagaagtaaaactacaggccaatgtctcaaataagcttagatgcaaaagtccttaaaataccagcaaagcaaatatgttccacgagaacataaaaatataatgaaccaggaccaagtgagatttattccagggatgtaagaatggctcaacatatgcaagtcaataaatgcaatataccacatgaacagagtgaaagacaaatatatatatatatgatcatctcaatagacacagaaaaagcatttagtaaaattcaacaccccttcatgataaaatctctcaacaaattaatactagtaagaatatatgtaaacaataaatgcaatatatgacaaatccacagctcacattatattgaatggggaaaagcagaaagatttttcactaagatctaacaagacaggaatgtccatttcaccgcttttattccacatagtactggaagtcctagccagagcaaggagggaagagaaagaaacaaagggcatccgaattgaaaaaaaaaaaaaagtcaaattgtttttcttcgtagatgacttgatcttatgaaaataaaaacctaaagacctccaaaaaatgtcttagaactggtaagcaaatttagtcaagttgcaggatatgaaatcaacatacaaaaatcagtagcatttctgtatggaaataataaactagctgaaaaagaaattttaaatataagcccatttatgacagctacaaaaatatacctgggaaaaaatttaaccaaggagatgaaatatctctataataaaactacaaaatgctggagaaataaattgtaaagaatacacaaaaaaatagaaagccatcccatgaattggaagaatttctattgtgaaagttgccatattacccaaagcaatgtacagatttatttctatctttaacaaattaccattgccattcttcacagaaatagaaaaaaaaaatctcaaaatgcatacataactacaaaagacctgaatagttaaagtaatccagagcagaaagataaaagctgaaggcatcataccatctgacttcaaaatatactacgaagatatagtaaccaaagcagcatgatattggggtaaaaacagaaacatagagcaatggagcaaaacagagaacacagaaataaatctgtgtatatatagtctactgatttttcataaacaagccagtaaatatatactggggaaaggataacctcttcaatggtcctgggattagtggatatccctatgcagaaaaatgaaactacatcccttttcttgtcatatacaaaaaccaacttatgacaaattaaagacttaaatgaaagacctaaaactacaaaactattggaagaaaaatccaaaaaatccttcaaaacgttggtctagacaaagatattattgggtaagatttaaaagcacaggcaacagaaatagaaatagacaagtggaactatatcaaactaatatgattctgtatagcaaaagaaacaataaatagagtgaagagacaacctgtagaatggaagagaatatctgaaactattcattcaacaaggaactaatatccacaatatacaatgaactcaactcaacagtaacaaaacaaataattcaattaaaaaaaagtctgggtgcagtggctcatgtctataatcctagcactttggaatgccgaggcgggtagatcacttgaggtcaggaatttgagaccagcttgtccagcatggtgaaaccctgtctatactaaaaatgcaaaaactagccgggtgtggtggcaggcacttgtaatcccagcttctcggaggctgagacaggagaatcccttgaacttggtgggtagagtttgcagtgcgctgagattgcaccactgcactccagcctgggagacagagcaagactccacctaaaaaaaacaaaattaaaaaaatgatttaaatagacatttcttaaaagatacaaatgtccagcaggcatatgaacaaatactcattacggctaatcatcaggaaaacgaaaatcaaaaccacagtgagatgttatctcacagctgagtgaggtggttcacacctataatcccaggaatttgggaggcggaggcaggaagattgcttaaggccaggatttgagatcaactttgacaacatagtgagatgcttatctctgcaaaataaaatattaaataattagccagttgtagtggtgctcacttgtagtcccagctactcaggatgctggactgaaaggattgcttgagcccaagattttgaagttacggtaaactatgatcatgccattgcactccatcttgggagacagagcaagaacttgtcgcaaaaaaataaaaataaaaagacaggaggaaaattaaaagatatctcaccccagttagaatggctactatcataaaacagaaaagaacaaattctgcagaggatgcagagataaaaaatttcatacattgatacactgatagtgggattatacattagtacagcatttatggaaaacactttaaagctttctcaaaaattaaaaatagaactaccatataatccagcaatcccacaatcccactactgagcctttatccaaaggaaacaaaatagtatattcaatagatgtatgtacccccatgtttactgcaccattattcacaagagtaaagatatgaaatcaacctaaatgtccatcaacaggtgaatggataaagaaatgttatatgtacacacagtgaatactattcatccatttaaaaaacaaaacactgttattcatagcaacatagataaacctagaggacgctgtgttaagttaaataagtcaggcacagaaagataaacagcacatgttttcacttatacgtgggagccaaaaatagttgaggtcatagaagtatacagcaaaattgtggtcattagaggggaggagagggagacattggttaatgagcaattacagatagaagaactaatttctgatgttcaatagcactgtagcatggatatcgttaacaatgattcattgtacattttaaaaatattagaatagaagattttgaatgttcccaatacaaataaaagataaacattttaggtgatggatatgctatttaccctgatttgatcattacacattgcacacgtgtatcagaacttcactctgaatcccataaatatgtagaagtattatgtgtcaactaaaaagaaaaagaagaaaataagtaaacatcggttaaaaaatgtaaaacagtgccaagcacttacataatgctatataagtttgctattatttcctggaatgtttgttactgtaaaaaagggaaaaggtaaacaaatccttctctctgttcctagagatacagtccaggtgttgctggaaatctggtctacttttcatgagaaggaagcaagtctttactaagacagaccacaggatgaacagagaaagtattcgaactacttgatagatagaagtagagtcgaaagttatctagcctccttttctcacccctatgattcctggaccacactattttccattatttgatgtctaattattcaataattatttttgtttagtgagctactcaatagtccttacaataaatacccttaatttgtttgactaagggagatttatttgaagaaataaagtgtgatacccaatgtggtgctaatacagacggtgttacacagataatgaagaggagatggagttacatcactgagcatatggcgtaatcacaatcatgatttagaaaatttactctggaagcagggaggcagaaaggcaagacaaaaagctactgcaggggtcagtgagatgtggggcgagggtctgacctgcaaccatgagaggaggccagaaaggcagggacatgttgtaggtagagctgatgaaatatgacaaatatttggaagatgtttgggagaatttagtagaaatccatcatttatgaatgttctaaatcgtgtgaacccctttccatgttttggtaggacactatgttaatggaaactcatgcatatctgagctatgttcttgattttcaggttttcttgcagcgatcagggaactatgaaacacaaagaccgagttctaatatgtacaagtttcagttaatataatgttatggaaagtaagaactgcctgtgtacatgtgcatactgcattcctaaatttcatgctactagtgtgcaggtatgagatgttggttgttccagcttgatcttctctaggagtctttgatttggaagtaagctttttgaaaatatagattaagcatagggcattgattcttttgacacagtagcatatataatatactgcagagggtctctagaattagaggtaatgcataacattgctcaattttctactagagcagagaaattctctattgggggtttagcaaagatagtacccttacaataccagattgtgggggggcattgtttctcaaagccctggttttatatatatatatatatattcataagtccatcctagatattctgtgaactaccaaatatcccttagcagcatgtatcataggttcagggacaggaaggaacagtctgccccagattcaggaaataagcagatacaatatttaaagagaatttaaaatcaataatgaaattaaccaaaagttagcctgctttttattatcatcacatgtcatcaattccaaacaatctcagtgttaaactactcctcctccctggaaaaagtattccctacagacatcccccgaccctgttatgtcagtgtcccttaataaattccttccatataaaattgctagagtacattctgctacctgtagcttagaactttggccaatagagaggaagaggtgttaacaagtcttagttgtcaagtctaagcagcaggaaaagagattatgacattagctagttgggtgaaactggtttggaagaatgattatgagtagttttagacaattacgtttaaggtaattgtgacctatgcagagaaatactcacatgaaaattaggagaaagaacaatgc

SEQ ID NO: 612 - DNA, 20001 bp, Homo sapiens
tttagaaagactttgttgaattgtaggctggagagtggtatgcaaagtggtttgtttagatggattgctctggtatttgtgcttttacaaatacaaaaattgaagatataaataatacttgagatattggattagtagcttgctaaaaacgtaagatatccttaagcttgggtaacagtagtagatattaaaaaactggagtgttctgggaaatatataggaactaaacaagagaccgccatagcttacgactgctatgaagtgataattaggaatggaaagcatcccctggtttccagcctgtggtctgaatggacagtgatgtcaaccccatgcagggaagtactgatggaggagtccatgtgatgtttggaagaagaatatagtaatctgattcagatgtgttagggtttaaaaagtctaaagaatattctagtggatatattatctttaaaattaggagatatagatatacacacacacatacacatgtatatatataaaataattgcaactgtcattttattagacattgtggtcaaatacctttctaattatttttcacccacacccatgtattttatctttgtgaagccacagtgactctgggctaggacttgtgatttgttttggccagtgggatgtagtagacatcacacaatcagaggcttgaaaaaaatcaatgtgcatgtttttatttgtagtccttgcctctatcatcaccatggggaaggacaaacctacaataatgggatgctcccagcaggagtcccatggaagagccaagctccccctaatgtctcagccaagggccatctcagatcaactaaaaggcaggtgatgttaagatatctggatgaagccaggcaagatcagcaagctatctagctcaccacctcagagtattagcaataaacacttatttttatatgcgactgaggttttgtggttgtttgcagcaccacaaaagttgtgttgtaggaaatgttaattattattattctccttatggtttttgtttttccagtttactgcttgaaattgaaaaagagtaacagattggtgtgaaatctatagagtctcaagacatactatagtagaatgtgataatctgtactgtttaaaataaatccctacctgcctatatcatttagcattcctgcagaaaataaatgacacatttaaaaggacagtttaaacaaaagataacaatatttgaaaaaaatatagacaggtttgaaggaaccaacaaggaaaagtgaggcacatgaaatagtaatagcaggaagctgttagcacccctggacctgaaggtcaaagaggtggagctgttgcagaaataggaccaatagccaactggaggaactgaggacttcaggtgggccaaactgtgatccgatccagttggacaaagatggtgcatttctgaattatttattctctgctctcatcgggaagatatgatgtagaatttgattagggcataggaggcaaacattacatgggggaaggtggctaacaaaaatgtctagcaaagtccacaacctctttcctctgtatctacttttgccttttgtctacatgaataatctgaagtcttaacacaagcccccccatttgattatggaatgatattaattcagtgacatcaccacctaaacatgttagcccttaccagtgctcttcataaaagatggcaatcaaaactgaggacaaaagaaataaatgacatacaacatacaacatacaacttttaacttgtgcatttacaagtaattagatatcaataaaatcagcaatcagttatagaacatttaccattttgcatataataatatagaaaacaagaaatgtttctattttatcaagttcctcagtttgaatactgcatccaaggcccacaggtattaagagatgctctcagctgtgtctctcagtaatattatatctatctatctatctatctatctttcacatatataaataacacatgcatcttgtgtgtctatgtgcatgtatgtatatatgtttcttatatatgttatatatatatatttcttgtatatgtgggatgtgtgtgtgtaagcaagaaatctacaaaaaccaaatatatagaaatattcttacaggttgaaattattttatttatctctatgtattatttaaatataaaacagagaagtacaaataaaaatattttacttgcatttcaataagtttaaattcttggatgcaagaaaagcatacaaaccttgaaataaaacaataaagaaaattatattattgatctgtttgaataatttttaaataagaattttattgtcttctcagttttaacttgtcttgaagactttgtaaaaaatgaatcttcctgttttacataataataaaacttaaaagttaggatggctttcatcttcaaaaccttttataaatggctacaaatattgttttagcattaatttaatctgtgaaagtacccactagagaacacccattattcctgatttatgtcaattttattagctccagttacaagaacacacatataacaatcttttaaaccagcttttctaacccctgtaaactgtaagtacaatctcaatttatctgttggtataaacttgatatctactctactctggaagtcttaatttaatgagctataagaaaccacaggtgatgagaaagtgtttcatgacaaagagttcatcggatatctggacttgttgagagagctgtgcctataagcaatatagatttttcattcaggggactgaaccattttcagttagagattagtatatcagccaaatagaaatattcatataacatgccaatatttttttctgactactctttcattttgctttccttcccccagcaaacaataacacattaagacctggagcaataactcttaggagaggtccttctctgcctattaattctcccgcaggtcttcttgcaaagggacattaagatttcaagttcggacttcacactgcctacattcaaatgtgggatcctgaattatagtgatgcgatttgagcttggctcagtaacctctctgtacctgtgttctcatttaaaaggatgcctagtaaccttgctttacacttaatattactcaaatggagaaagaatttatccaacacttagaaattcctaggcccgccctcaatcaatgtttgctcttaataattattattagaattattagggttatttttgtaagtgttaggtttcttttctttttttttttttttttttttttttttttgagacggagtctcactctgtcacccaggctggaatgccctggggtgatctcggctcactgcaacctccacctcctgggttcaggtgattctcctgcctcagcctcccaagtagctgagattacaggtgccttccaccactcctggctaatttttgtattttttttttagtagagacagggtttcaccatgttggccaggttggttttgaactcctgacctcaaatgatcctcccacttcggactcccaaggtgctgggattacaggcgtgagccaccatacccagccaagtgttatctttctaaatataaacctgacacttaatggcaattcaataaatattcatggaataaatgaatgaaaagttaaataataaggactcacacagcatgtatataaagccctctgctatctctctgttgtctaccaaataatgtctatattctaattagcaagggcagtctggcatgggctccacatccacatatctgacccctttcagctgccctctaccaggtacaccctatgctttgcctagggagcctgtccagcgctatcctaacatgagctcctctaatgttttcttccttcacactgcaaactgcttctcatccttttagaatcagctcagttatgccccactggaaaagtctttcctcatttctcgtggtgatggtatttatctcctcctcaaggcctgggagatgctacctattgttgttgttacatcccatattgtctgcctggtatggtttcccagtcaacccaacccttcttgacaatgactattttcgaactctgcgatcctgttacccttcgaccaccaatgctccatcatgtttcttgtattttcaccagataatcttgacacatacttcacagtcaaaatagtctccaacagaaaagaacttctatcttttctccaccaaatctgtaacttatggacatttcttccatccccttgatctagctaacttttctctcagatcctattacatgctaagtgaatgattcagaagactatacctttgaccccagtgctcaaagcccataaatacttttttcattttacttaaagtaaatgtgtcaccgatcatgttggtgagattacattagagcaagccatattttccttagctgactgtggcctggtcagtcccactagtggaagagggtgatgtataattgcagtcagaatgggtttgaaagaacaaggaaaagaaaaataataaaatacataattgtgttgatatatatttggaagaccttgggaaactaaacttgcctgccatattttgtactggtcaagtgtgaggtaccatttgaaaacaaacttacaagtttgcatgacttactgtgtctcatctctgttacttgttgtcagcagtgaacatttttgcaaacattatccatttaacccttatgagaagcttatgagttagcctataattcatctcaattttacagattttataaaatgaagctcacagaatgaaacgtctaccatatggggaagcctggtctagaatccatgcatactgaaaccagggtacagttccttaaacaccaaattgttatttgatgttggaaaattttaattgtgtcaaaacgacttaggcatagggcatgtgtttgttaatagaatccttttaagccagtataagtaaatggagatgatatagcaaggatatagggggatctcattaatacccagagcaggaagtgcttcaaagcttcaggaagggtttgaactggggactgaattgttatcaggaagcaatcgactcctctcagcatccctgtctctgcctctgcatctctgagtctctctcgtgctctcttttcctgaagtagctgggattctaaacatcaccccaaagatttcaatcccttggttatttaattaaacatgaacttaagtattgctataaaagcatttatataattaagatcaggggccataaaatggcattatcctggatatcggatggccccagtctaatcacatgagctcataagagcagaggaggatttctttctggacctaataggagagattcagctacaggagagagcaaggaacagaagaggcagaaggggaagtgagaaagatgtgaatcatgagaaacgttcgacccaccgttcctgactttgaataagaaggaaaaaagccacagttcaaggaaagtaattagcttttaaaagctgagagggatccctggttaatagccagcagccaacaggggctccagtcctgcaatcacatggaattgaattctgccaaccacttgaatgagcttggacacggatgcttcccagagcctccaaaaaggagtgcagccctgccagcacctggatgttagcccagtgagacccatgtcagcctcctgacccacagcactgggaattgtaattgtatgcttttctaaaccacctaatttgtggtaatttgcaacagcagcaatagaaaactaacacatttgtatacttttaactatgcatctcccatatttgtgcattttatacttttttctctacatacaggttccctcatcttttttgtgtattccattctggcagcctctgactttgcctgcagtcctgagtcacatgagcctttcatctagtctggaacctatgattaattaaacccatctccacatttcacttccaaatttctaagtgagggaaaatcaaattttgccaacccaatcactgggttaaatccccctggtcaagacaccgattcccactcggtcacatggaaaagactcatggagaatgttgacagctcattccaggacttggaaggccaggttcctgaagtgggtcaaagtgaagaggataagatgtcagggagggaaggaagaagcctatctgtagtagagatatttagaagacgtaaactgcatgggataaattcaaactgatgacaatgtagaacagattaagatgctgagaaaaggacatgtggcaaggaataggactgtaattttttttactaaataacagttaggtttacatctattttctaaatccagggaggactaaaatcaacacgagaccctcattaatgcatatataggggttaattatgagtcttttgtgtaagtaagtgagcttgtgctaaatgtatacaagtatgtattgatcactttattttgctgttcatcaactttttccccattttttcaaccctataggctcagcaaaataaaatggcaagaggcacaatgaaaagcacaaccagctgagattaagttctgcaaagattagttctggcacaggttttatttaatgttgtagaatagtgacctggggaaataaaaatgcatccatttgagaaactattgaccaaacaagaatagaaatgcaacaaaattcaaagtgcaaaagtggatctggaaaattgcattctgtgcaactcaagtaaacactgacttcataaatccaaatgtccacctctgttatgtaaagcttccccttcagtgcagttagggtgcttggcaatgcacgaggtcagtatgacttatgctggataggcaaacactgagcagacatttatgaatccaattttttattttttgactcttcaccatctattgaaaacccacattttgaggctcactttctgtgaaactttcttggcattcttggacatagtcctcttagaagggtgcatgttttagtgaagaaaagcacccaagaaggagagtggcttaaactgaagaacagttggataacttttcatcaatgcatttgccatcaaatataagcatcagtgtaaccatgaaagacataaggtattatagaacctaatttttaaaactcaattaactcaacaaatagttacttgttatcgattacatgtcaagagctgttctgaatgttggtgatacatgagtgtgtaactaaaattaagtttttgtccttgtggaaccttgaactgtcagataaagaaattgaagtccagatagcagcttgtctaaagctacatgttgtattgagatggggctatagagttgagcttctgtctccatattcctacttcaactgtgtttgaaagcagatggaatatacaacataaataacaacatagaatggagctcttgttgcattacactaaggtactacttctctgtcatttttcttcaggaaagaatttggccacctaaaaatagtttttaccacttttaataatatggaaattaaattgaattgaattgtataataaagagcaagcagttactatttttaatttaaaaaataaaactaggtcaatagatttaaccacatgtgagcttgagacccataaggacaaatacctactgaacaactgcacctggaagttacagttgatattttcaagactgaactcattacctctctgaacatagatgactctcatatttagcattttgttgaatagcacccttctctttcaagcagtgccagtcaagaaccatgagaatcatcctggatgtctccatctgtttgatcattctccctcaagccctaccacactggcccacgcaatgaatgaacttctaagttaatttcattttatctcttgtgatgaattatatttttgttctcaaacattccctccccttaaatgattatatatctccattcctagggggcttggccataagagttgctttatccaaaggtgtatgaaagggtatgatatatgctacatcggtgcaaaagccttagtgtcattgaatattggggccattttctttcctttcctctgtgctataataatagatgttctatatagggctgttccttccgtttaagccaaagcatgagaagagacatgagcaaagtcccaatgacctagagaaaccaaagtgagtgagaaataagccatctttgtaaggcactgaaaattggagtggtttgttactgaactatctcctagaagcaaatgactataacctcctaacctttcttataactgacgtcttccctccagtctcactgtcacatcttcactcagtctgtcatcatttcttcctggaaccctggaatatcattaagactattcacctttctaccttcattcacctcccacttgcaatcaattctcaatatggaaaaaaatagtgatgtttctaattataaatctatttatttgaagttatttaagatctcccaatcattattgtggcaaagtccaactccttctcattcaacagatatgtcttcctaatctcttatgtaattactttaccatcctgatcactgggtattttaatgttgagattctaaatgcagccacattgaagagtgtaaagttatgcaaagacagcttaggcattcatgtaccttcacgtatgtcaatttttttctgaaacatcttttatatcttcagccacatagtaaattctgattcatcccttaagaatgatctcaacaacacgtgtctttccttatgtgtccccttctctgttcctatagtactctgtatatatgagtgttatcacatgaattacactttgtactgagtgctgttttaattttctgtcttctcctctgaacgatgagaaatttgaggagaggtgcatgtcttactaatttgcacattccaaatggcaagcatagagcttggaacacagcagataataaatgtttgatgaaatgaatttattaagttatgaaaatatactacattgaagcacttgaggacttatctatgttttgtttatgtctaaaatttaccaaaccgcaaaatttagtgtttggggctttctgccaatatttcaatatttaacacaatctgtatttttgaacagaaataattagttggtttatctgtgttcgcaatgaaaagtgttttctgttcctcatgagcagaacttcattgccacccttgccccataagtgtaagctggaagggtttttgtttccttgttggttttccaggcgtgttgttcatcctcctacaggccttggaaagatttgcatgccaacactgacttgcctcttcaccaggcatcttgatgccactggataattttagtgaaaataaatattccagtctcactgaaataagtattaacataacagtgtggtaccatgtgtcaactgcaaactagccaaaacaaaaatcaatgtttgtaatgagcaaaggttgaaatgactgctctcatgcactactggtagacatataaaatatcaaataccttctagcctgcaatttcacaatactcatcagcagcctcaaaataaacttagtttcatctgtattaaggaatatttctttaaaaagatcaagtatgattttgatggtctcccaattttctgagaactgtcactcaattttccctctgtacttattaatgaagatatttatttatgatggtagtattagtaattttgaaaatgttgaaggtgtttaaatttctctacttcagaaattagttcaataaataatagtatggcccaagattgcgtgctgtgcatctattttcatggtgtatcaaagaatgtttaatgctatgttaaagcactcttgatgataatgttaagtaaaactgtgagatgtgcagccttatagaaaatgcagtcccaattatataaatatccattaatccaataaaggtgttttaagaacctgctatatgtgccaggcattatgttagaaatcagagatagaactggagaagggagttaggggcaaaaaacaaaaacaaacaaaatatcccacgtccttaaagagaacgcctagaaagagtgactttctctgaatatgaggtcatcattgatttatagtttgccttccttatttgtttatttgccagacttgtagagtaaacatatagtacttttatcatgatttattaagaagaaaaattatcacaattattcatctctatcagccaggtctaattcagccaaaaaaaaaccctgaaatcataatttgtaactagttcatcctgaaaacctcagcaggcagcaaagtaatgtacaatcagattaactacactgtggttctcacacccactgtggacattatttaatgcttctgtggacagagtccggtaggaacccctttcccaggacaaattacagagtgaagaaaagacgtgcatgctgacccttccagtgtgccttctcctagtattttcatccttgattttaaaatattctgaaaacaaattttggacatggatgttgtcttcactgcacagatacagaaaaggagactctgagagttaagttgcttcccaaggtcacacagtgtgtgaaaccagatcttcctaataccgaaatgtattctttcaactgcattgcatcgttctttctttctttctttccttccctccttccctccattcctcctttcgttactttcttcttcttttatttcttccttccttcctttccctctctgtgtgctaggcactcttttcctcttttcactaggcatataataaagttctcaagtattctgtgaggcattgccccccacttgtagatttctagaaacaaatcccttggcagaagtgatggaaaaaataagaaataaaacgtgtaactaaacgaacaaggaaaaccatacatttctccagcctgaaaacactgaaatggactagaaccaaattcatattagaaagaaaaggtgatacatgggtgagtttggggatacagatggaacagaagccagccaaataaatatttttgattcctctatttgtatatgttaaaatataatgaccaagttggacaagctgtataaactctctcagttaacgtgttcttacctttaaaatatctacccataggtttgtgcaaagatcaatgaaggttactcacctgaggtactcaacgtcatatatagcaaattcaataagtgaagccctccctaccctatcctcagatattacctgccagccattaaaagtccctgaattaaaatgtttatactcttggaagacagattactatacaatcaagttattacaaggcagcaccattgacctttactcattcattcaacaaatatgtagaacttgctctgagtcatgccttattttaggtgctagaagtacagtgttgagcaaaatagctaaaattagaagtgcagatgagtggttaggaaaacactgcagaggcaatgatttgttctgcctaaaggcggaatgtaaagaaagattcagagaaagtgccatttaaggcaaccgaagaactgaggaactttgatgaggcaatgcattcgctgcagtcctccttgcctgaagctgtctaagtgcttgcttactccagtgtggtttaatatagtattcacaagcaaaggaccatttggagaccttcaaatagcccctcaccatgaccccatgtagcttaagagttgacaattttatggaaatctgttctcatgattgtatgtttttcctatttgcaggtgccattgcttggcttttccattcaggttttagcttgcccttctttgctccaagggcaaaagatccaactaatggatgtaattagaaagagactttttttttctcacaaattaagaaactatcaagaacactcaaaaatagaatgggtgatccggaaaggcagggagggttttgtcccaaacatattcccctgaggaagagtagatagctgtcaatgatatgccattgacacctatgtcaaatagaacggggcctccctctgcttcattttactgtcagtaaaatggagacaaaataaaaaaccacctacatcacagggttattgtaaagatcgcaggtaaacaatgacttgcacataaataaaaacctcaataaacatttaactcataataataatagtaatagatggattagttgtagcaatgctacatcatgacaattagaactagtattattaatattatagttcttctcaaaacgctggattaaggttgtaattattcctttgcaatttgcctttctgatttttcttttccccctcatttgcttctaataaatatcaaatcagtattttctatataatggcacagtttggggcactttggataacatatagttagatcagggaataatcacgtgcttaagatattgtaggactgtccccttagttcagctaaaagccaggctcttgtcacatggccatgagagattaggcttgcagacactttgaagggtgagaaaaatggaatgtattgggcaaaaaggaaaaaaagggaaacagggactctcagcaaacctagagtcctgctagccagtttcccgcctcacaaattgaattccagtacaggagaggacaggctcctcctggctgcaaagggctcgaacacctgtggctccatcctgttcttccagtgcgcaggccaggtggagtttctccagggacccctttatacttggctgtttcaaagagatgtctgtgggacaaactctagaactggggagtccattaggaagacatcagtcgcatcagtctttgtatatttgaaataattagaattaaatgacatcaaaactcagtcttttgttcataggagctacgggtggtcagtggctagcaaattggaaagtgcagacatggaacatttacgtgatggcagaaagttctgttgaacagtgttcttctagaagagcttggatgtgcacacacataaaaatgagaaaccaacaatcacaaggatttggggaccttccctctgtggccaccctggccccttgcttcaccacctcagaaaaatcatgtttcttttgccgcagggccttttgccctttctgaaaactcctaaaatgcacctgctgccctcagtacacacctaacacccgtaatctttctctaaacacacacaagcttacatctttatctgccagtcattctctcttgtttcagactttagctcaatgatggcttcctcaattagcctctcccactctgacttacccacctgccatttctccctgttacatacccacattccattatcgcctcctctttgcaacacgttatatgagtgtgactttacatttatttatgaaattactttattaaaatctgaccctcctaacatactgaaatcttcacgaaagcaaatattatgcctggtttcgctcaccattttatttctgtacctgacatagtgcctggtccatagtagggtcacagtaaacatttagtaaatgaataaacaaaccagagttgaagagatcacttttttctagtggacctcagcaggcctcagggagaaacggatgctttagctacactgtggtaaatctaggttctaatagcttatcaagataggcataacccttgttaggcagagagatgagataatttctagttactgaaatatggctggatgggataaccattgacccacagcagggagagaagaccagcaggtttttcttcccaaaggctgtattatttatgcaacgagcatgctgaattacatcacttcaacacaacttagaaatacaggaggagtgctttcattatagacgtactaaaagtagagtcagccttctgtttaaagctttctgttccaggcacatcactcttcacttattctctgctataccctttctgctaatagttaacgaacaaccaccgctttcttactctgtttcactctgcaaatgttgagataataaatggccaaggcttagtgagcattttacccagtgtcagacactaaatgctttacttgtatcatcccatctaatcctaaaagcaaccctatgggagagctactattattattttaagtgagattttaagataagaacttgatgaaaaagtaagtttaatagtttacccaatgtggatgccccagccaatggtaaatgggactactagctgacctagactgttgcaactcttaggtcgattattgtaatactatatgataacaatggcaaggtattctaactgctgggaggaaacgtggtgaagtcagcctgccgaaaagaccttggaagaatgagagtaattgttatgctttgctgatagagctgggtttttattttactgcaattagcgcccccacctaaaaacacacatctgacatgatgtgtcatgtgtgctgtacatgatgtgtcatgtgtgctgtacatgatgtgtacatgatgtgctgtaatctcagcacttttggaggccaaggtgggtggattacacgaggtcaggagttcaaaaccagcctggccaacatggcaaaaccccatctctactaaaaatataaaaattaccaaggcatggtggcacctgcctgtaatcccagttaatcaggaggctgaggcaggagaattactcgaacccaggaggcggaggttgcagtgagccaagatcatgccattttactccagcctgggacacaagagcaaaactctgaaaaaaaaaaaaagaaagaaaaaaagaaagagagagagagaaagaaagaaagaaagaaagaaagaaagaaagaaagaaagaaagaaagaaaaaaagaaagaaaaaagaaagaaagacaggtaatgaagtaggtagtgttaaaaatgtgctttagaaagaaactaccatcttttcaactacttaacctttctgtgcacgttttcccattgacaaaatgtgaatacccaccagcatcactacattgatttaaggattagatgagaatgtatccataaaacccttagaagccactcaaggcacactattatttcaattacagttaactcattggctgcactgagagtcacatttgccctctgatggtccatgggcttgctctaaaaatcaccaactttcacagctgaaagagttttcagaatctagaaggtcatttcactgcatctcaagatgcacctcaagtaggtgtgactggtataagggggtatcaaactgtggcatctgccccccagggatggcactgagcatatcacatgtgaaatctgatttccttttcacacggtcccctaggaggtgtgaaaaacctgacagttaaagaaacaggctcagggagattatgtaaatttctcaatgtcatgcagttaacgaaggaaaggaaattccagcactttattaggcagcatcatatatttttatctgtgttctaattaatgagatgtgtctaaggaatttaataattgtacttagtaaactggtttcaattattttagtaaactggtttcaattatttatatttttaaaaattcattttatttccttattgatgagatactttcactattttatcctagcctacttttggaggtgtgagagcaataatcccaaatcagataatacttttctgaaaaaaaaaaaacacacacacatgtaaaaacatgtttcctttaaaacatttaaaaaatagaaatcagactttctgttttgtcttacaaaaactgttttaagtttatctgtaaaatatctttttgttttactttcatgaatttaatttattttttatagagatggagtctcgctgtgtcacccaggctggagtgcagtggtacaatcatagctcacttttaactcgaactcttggagtcaattgattcttttacctcagcctcctgagtaactgggactacatgcctggctaacaaagatccattaagttgtgttaagcggcaattttttttttttgtttcattctaagatcctctgacaggtaacacattcacgtcagccagagcattgcggtggcagcagaagtctcataggccatgttacacacagaaaactccaatcacaacagaaaaagtgaaaataaaaccatagaagatggtcactacatatatgtttaatattaaactaatacttagtcatcagttagtttaacaaatgactagatgcacactactgtctttacatgcatgatacatgtttgagttccaaaataacatgaaatatagtgtcaggtgcggccgggcgtggtggcttacgcctataatcccagcactttgggaggccgaggcggggagatcacgaggtcaggagatcgagaccatcctggctaacatggtaaaacctcgtctctactaaaaacacaaaaaattagccagatgtggtggcgggcgcctgtagtcccagctactcaggaggctgaggcagtagaatggagtgaacccggcaggtggagcttgcagtgagcagagattgcgtcactgcactccagcctgggtgacagagagagactccatctcaaaaaaaaaaaatttatatatatatatatatatatatgtgtgtgtgtgtgtatatagtgtcagctgaactttcctcattttagtacctccgcgttacatttatatctaccatgccaaatgctcattggttttagtgaaactgaccttttatttaatcctcaaattaatccttatttggacagcatttaattgcatctctattatataaataaaacaaaagcaaaatacaaaattaaatactctcttactgtctccagaagattagaaaatttggatatgcttaaaatctcatagaacctaaaccctgttctgtgttttagacttcaaaccccacaaattcaagctacaaaactctcccttgatttaagaggtcactgaagggggttgaatagtatcctccaaaattcatgtctatccgattgggaatagggtctctgcagatgtaaataaggtatgaatctgaagaagaaatcatcctggattatggtaggtgccaaatctaatgatttgtgtccctataagacgcagaggacacatagatacactcgggagaaggtctggtgaagatagaagcaaagattggagtttttgctctcataaaccagggaagcctggaactatcagaagctggaaaaagtaaggaagaatgcatctctagattgttcacagggagagtagccagatcaacactttgatttctgacttgggcctccaggacaatgaaagaactcttttttctgtgatttaaagccacctagtttgtgttaatttgttacaacaaccctaggagatcaatagagtcactgtccttagatctccctggaaacatggacttactggaatgcgatcttccctctgaaaccacaacctcttgcagatgctctctcttgaggagcaggcttggccatattccgcagggcagttctctctcctccagggccacgtccagatgctagcccagaaaaaagatgctgtgcttcatgtttcaaagatgaaaggttccaaccttccattttactacaaggagcttggttttttccaggtgctcattcccaaggaggtgggcagaagccacatggagtgcttagactatttattgttattaagaggcagtagagacagacagtcaattagacagagaggatgcatgtgactactttgcatgctgttacacgcctctactaaacaactctgggggagattctgctgagttgcatttactatttctagacatcattctcaaggttttgtgctgtacaaggaaggcagtgttagtgctttcactcatcaggcttaaaaaatatcttcatatttttatgtagaaccacctaagaaggggagggttctaggggatggggaagatggatttggcttttcatctgaaggagctcactttctctctggggagaggcaccaaagctgtaagagtttctagtcccacatgtagagcttggtatgcacatctgctcttccttctcccctctccccatcctcatcacctcagttggcacaggtcatccagtgccttttctttgggataatttacagacttttgtacccttagcttgtggctcagcccagttgtcacatttctgaagagggcctctgaaggcctaatccaaagccacccttccatcgctctctatcacatcatctttcatttgttcttggcacttttttattattatcatgtaatatatatattttttcctttgtttgtactgtattttcattttgcatccctaccccatcaccacacaactctataagggcagatgagtcatttttttcctctgctgtgtccctaaccccttgaaaagtgacttgttcagtgaatgtgttcaataaatgaataaaagaagggaagagtgtatgtttcacaatgcaaccctacagaattctgtaactacccaacaggttcttcctgcctgctgcacaaacaaagatcatgacaccgcagtaaagaaagagttgaattgatgtgaggcttgctatactatatggaagacagaattattacttaagtcaatctcatagaaggtttggaggttagaggtttttcaaaggtagttttggagaaggggtaggggcagtttggcaatgagtgcttgccactgattgattaggtcaatatgaaatcatagagacttgcagctgtcctcttgtgctgagtcacttctgggtggggctgtaggagctgcgtcaggtccaggtggaaccatgggtgtcagacatgcaaaaaacctaaaaagataccacaaaaggccaatcttaagtttcacaatagtggtgttatctgcagaagtaattggggaaattgcatatcttgtgacctctgcaataatggatgccaattctatatgtgtataccttagcagaattcagattcctctatcctcatatcccagtggtctctcattaacttgacaaaggcatttgagttttggggaaaagctatgatcatttaaactataaactcaacatctggcagcttgaaggttaaaggcaggatggagattggccagatcaaatctcccccactgccataattttcttactgatgtaatctttgcaaagatggtttcaattccaagaccatctactgcagagtggcagtacccttcatgtactcccaggtctcagctggtagtttatctataacctgagaccaacatttccaggaagaatcttgacataccatttgaaagtggtgccttagagtcttaatgagtgagtcttaatagtcaaaatgaatccaccacgagccaagggaagaaggtttagacaacggaatgtgattagctaaaacttgcctcggggctttgctctacccctaacaaagacttcaaaatctaatagacagaagtgttagttttatagctaggaagcacttcgtggatgctgaacatgtcctaggtatttttcatctatgcatgaactcggggataaatgtaacctctttttatggctagctcagagaaagaaaaaaatgctcaagactacatagtttgcaaatgaagtggagagctgagaccaatctctaatgccttatctctcactttctccacttcttaaagtcttgtaaccctatcttcagaaaattgcgtcttattatcaagtccaaaagttaggggtttcctggggcagttttcaagacaatgactccctactagctctagccaatttctaggatgacaaatagtggcaaactctcttgaatacagtagaccaacagcaatgtctaacagtgaggggcttgactctgtggagcatagtgaaaccaatctttagctgactcaggcctggataaacatggcaagcacctctggaaacaaaaagtaaaaaaataagaaaatccattttacctctcgtttttattaagagacacttttgaataattactattcatggaggtgggccttgaatttgtgcggctggatattgtctttccctaagctactgacatttggaagacactgcttaaggttctttgtggaggcaaatcagcacttggcattttctgtgaatgtcctgctcctatgaaaagggcctcctgatcat

SEQ ID NO: 613 - DNA, 20001 bp, Homo sapiens
gtgatttgtatggaatttgcatgttctctccaggtgaactggcacatctaaatggtcctagtctgagagcgagcgagcgagagagagcgtgtgtgtgtgtgtgtgtgtatgcacacgacaacgtgtgaatgtgccctacgatggaatggcatcctgtccagagttggttcccaccttgtgccgagctacctggataggatcaggccatgcgagaccctaaactgtaataagcaggtaaattattgtttttactaatcattctaaaacatatgtatagctcatatttattttaatgtttaatattagaagtgatttaagtgcttgaatctttaaaaaatgcagtgatgtgtttgtgagcagaaatatgccataggaactgtattcttgtttatatcaattaacctttggtaaaattggtttcctaatatgttgtttcacttaagacggcagtttccaagaatctaccaacgatgataaatgaggtattactgtacttcgttggtaatatatgcactttgttcctatttactttgtatctattattagaaaaacatataactctggcaacaataacaaaaacaggctaaaataaaattatatgcctaataataataattataattagactacttaatatcttgttttaatgataaattctcagagatgggacatatactgagagtatactatttctattggagctatgtccactttattccagtggttctcaacaaagggtaaacttactctccaaatggtgacattctcaaggtcaacagacacttttgatgatcagaactggctagttactactacatgtagcggggagaaactagagacactgctaagcgttctgtaatatatatagcatgaccttaaatgtcaatagtgcagagaccgaaaaactctgcctttcaaacagctctcttattttgagctggattcacacagcctcaataattagacatgcctgattcagagtcatggcatgatttcctagctaaaccactacatctaactatatgaagggttgttcactgggaaaataagccaacagcatctccctgggcacaaatactgtcattctgatgcatgaatgtacataatttttcctttagcattcaattcagcattagcattgtgagatctcgcaccgacttagcaaaactcaaaaatttaaacaagtttttcgttgattttaacctgcggaatttaattttgagtttctatggcatttgaaaccaaatataaaattataacaataagagtatccattaaattttttttgtctcttacttctgatttactttatcaatgaacattaaaaagtagccatctggactgagaaagaaaataataacatttctcatttttaaaagaattcggtaataaccataagcacaaagaaataaaattcatcagatttttttctcctattgcttcagcctagggacacagtgataggctgacaaatctgaataggaacataaactttgattgtaatttaattaaaaaaaattattttactttttactccagttcattaatatttttaattcatgcacttgccaaaagcatgatgctctctttcagtcaaaaacacattgaacccgcagggaagaaatactaccccacgagtaaaggttccttcctcagcttgtcaagaaagtcattccaaactcaaacaatggcagacggcagatcttgctatataacacatctattctatgatacactgccattcttgaacgtacatgtatccttcagaaactacaatggattataatacaaattaggctgacaaaagttctcttagtttatccattggtctcagaataatgcagattttcttgcttcatctgagcacttaaaactcaataatatgccagacctacctaagaaatgccttaaaagtagtttattatctagcatagctttcaaaaagagaaaaaactattttatggtatttgtttttaataggttatgttattgctatagtgacagaaagaactgaaaagacctactgtatgtatccttgtataagaaatacacaaaacattaatgaaaaaactcatttgctaaatcagtcgctaatcttgtccagtttaactttctgtaatccctgacaaacaatcctaatattcatcactcatcaagtcatgcacaaacttttaaataaaataattgtatatgggcaagattattctacttggcaaatggcctattgcactgatatccacctttggttttttagaaatgaaataatcacagtcttgcagcttatttctgccagaaaacttcagacagaaaatgtgtattaatacaatactctatgtctgcctaagaataagcttaaagacacaaattctccttctatattgttgaaataaaacagaatcatagaccaagaaaattagaatggggaaagggaatatttctaatgagttaggaatgattaagtaagatgcatcaaaaatgtcactcgtcctcttagatatctagactctatgctatgcattatggaggacagcaagaaatgtgagccataattttgtccttgattacaattaatggagaagaaaggaattataaatatttagaaaaatattataacaacagattatgccaagtgcaaactatagggttcaaagcataaatgaatattatccaagactatgagagatttttgacattttgagacattatgcaagaagcaaaattgagctggtccttgaaaggatgggtcgatttagaaaaataaatgcagagcttcataaatcaccgtttcaagagatgaggacattatataaactattccattcatgcttttattacagggacagtgggaggaaagagaacagaatattggtagaactaatcttcagcatgatgttggcagatctcaataaaattatggccacttgtctccaatgttacaattcagggctttggagagtcttattttataggcttcctcattaatcatgggatgtctttctccaaacttatgtttctacagtgtaagtgtgagatgctctcaaaagaacttccaggaaggtaggttaccctccttacttgtagacaccagcaagctggtttttatctccaaagtagaatgtcttggacccagtgtagcttatgcagatatataaatggcacaatgaccccagtacatcttttacaagatgttgttcacttgcgcaaaaaaaaaaaaaaaaaaaaatttgaatacaagggacactgatttccttcactaaagcttcctgtatttaaagctgaaatgaagttgcactttttactcttaattgatttatatgctacttttaccatggggctatagcacatgttgtcttgtaactgtttttcagagaagggtcattaggttgatatatttttgtacagcaacaggaatgactgctctgctaaatcactaaaaattaagacaaagacaaactgaaatctgcaaggattgacttggcttctgtccatagccatatcattcttggcaaatgtgaaaccattttaaaagtttttattattggcatggaacatattttggcatacacatatacaaaatgaacattataatgacaataagaataccaccttgttagtttaaatcagtaagaatattgattactcagtaatgtaattcagactattagctaggttttgccaaaagtaaagtaaccctgtatttctttagcatatcttgcagaaaattcagattcatctaaaggaaacaaataaataaaaaacattctaacaatgaaaagagaaaatacagtgagtactgaagagtggtggagctgatcatactgatagctgtgagttctctgctgatggtgggaggtgggtggcagagcccatggaggtgaaagatctaaaagttcaaggcagcaatgttccttctgagtttgagaaatatcatttagcagggtagatgctcaatattcctttccttcctttatcctgatatgaaaaatggagatgttgtggtaaataggggggtaaattgggcatggaggaagaattaaaatatttagtatattatgttttttattgttggcttatgttcatgactattgtgtttcttttttcagcttttaggggaagaagaaagtaccagcaataattcatttcttacagaatttagctgtggtttcgtagagaagaaattagaagacctgggtttatgctggatcctcgtccaaataactttgtgactttgggcaaattactttatgtcactggacttcacattttctgtatgtaaagcaagatgttttgattacattcttccactggtatgcgtacaattatggtactgcaatttatgactttctgttcctactatattgcgggcaatttgaaggaagacaatacatttttcaactctaaattctcaaggcttgacactggttggcatacagttaatgctctgtaaatgtttgttgaattgacttatgttgattatcttacttccaagtccttgcagaaatgacgtgttataaataacctctctatcatttcataacattagtgatagaaagccgtattagtgccttggtgggagccaagaaataaaaaaataaaaaatatattttctacaacaaaaaaaattaagatggacagttttacttgatttctgaaatcagagaacaaacacctgttccagtaaaactgaaaagacaaaatatacattaactaaatctgtggaaaccctcaacttcaaatagaatctagatagagatacttcatctggatggagaaaataatacatcgcagtattaagagaatgtatttgttcctaacaatgagctctttcacttcaatattaaaatcctatttcaaagagaggttaatcaaagctgaagactattgtgtattgcgattttcacagaatatataattctaacacggacccctttaataatcaaactgttgctaagaagcttcttttgttattattattattattatactttaagttttagggtacatgtgcacaatgtgcaggttagttacgtatgtatacatgtgccatgctggtgcgctgcacccattaactcatcatctagcattaggtatatgtcctaaagctatccctcccctctccccccaccccacaacagtccccagagtgtgatgtcccccttcctgtgtccatgtgatctcattgttcagttcccacctatgagtgagaatatgcggtgtttggttttttgttcttgcgatagtttactgagaatgattatttccaatttcctccaagtccctacaaaggacatgaactcatcattttttatggctgcatagtattccatggtgtatatgtgccacatttttttaattcagtctatcattgttggacatttgggttggtttcaagtctttgctattgtgaatagtgctgtaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccgttctaactggtgtgagattgtatctcattgtggttttgatttgcatttctctgatggccagtgatggtgagcattttttcatgtgttttttggctgcataaatgtcttctttagagaagtgtctgttcatgtcctttgcccactttttgatggggttgtttttttcttgtaaatttgtttgagttccttgtagattctggatattagccctttgtcagatgagtaggttgcaaaaattttctcccattttgtaggttgcctgttcactttgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggatgtcttctaggatttttatggttttagatctaatgttgaagtctttaatccatcttgaattgatttttgtataaggtgtaaggaagggaaccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttgcttactatagccttgtagtatagtttgaagtcaggtagcgtgatgcctccagctttgttcttttcacttaggattgacttggtaatgcgggctcttttttggttccatatgaactttaaagtagttttttccaattctgtgaagaaagtcattggtagcttgatggggatggtattgaatctataaattaccttgggcagtatggccattttcatgatattgagctaagaagctttttaatgaagtcatctttcaatgtaagcatatataaaactcactcattttgtttacattacttttgtggtcatttcaaccagtgtttaacaagttagttttgaaaacagcagacatggaaggaatgattcaaaacaaagatgtcttatgatttcaggggaatattttattacaaatatggaacacttaacccatgaacttagctccacaagtctttgacaatttagggaataatgggaataccaagccagatttctgtgcagtggatggaaggaattaatcttagcaaggtaaacccttgtttttgatttctcagaccctccatttataaaaataatatgggaacatacaaaccacttgatacttttatctgtaaaacacttagggcaaaaaatatatattattataggaatcaaaaaattaaaaataaaattagcattggaaagacttgaaataaaaaaatccattttgtctttgtaaatctaagtataaattcaaatcatcctcagctttccaaaaaataccctcacaaaatttccttacctactggggtgaaataggcattgctgttaaacgatgctaactaaacgaattctgctcttttcagaaaatagtatatattttacaaatatccttctttagtttatcaagaaatagacacaaatacaacaaatacttgagttatacattggctttctttaaagaaagtacatgaaaatattttcttttataagaggagatggcattgaaaacatgagtatgaaaatagcaacattaaagaaaaattctatcatgctagcaggagtttcatgttcatctctatatgaaattgtatgcattgaagtaaaaaataaacactgacggctgcagaagcccatctagagtggccgctgtgaggatgccagctgcagcaggggaggtgcagctggggctgtgtgctccatggaactgatgggggaggggaacaggtgatcccagtgggagccctgcgcccaactaaatagtgaggtgggagctcctgctcccaggcacagctgcagctgcccagccacggctccagacccaggcatccctgtgctctcagagacccaggaagcccccttcccctgcaggctcagaagtgcctctgcacccactccctggcctctccctgctccaagcacctgctctgtggtggagcaaagttgtggacatgtcccaatagctaagcccaggtgctgttgtgacctggtcaggtgtgcctgtacttgggggcagcactgacatgctggtcccctgctgtcttggccccctctggaaactgcttctgaggctaaaactttgggtgccaacaagcacaggagggaggctgggtgtctgagattggcttggcacgtgcctggtgttgaccctcggcaaagacagcctggacaccatggagggcacattaatggcagccggaggcagacaggttcctaagtgggaagctgtgggtccctggtgaaacccaccttcaagccagggatgacctgaagcctgggggccaggatgccagttttgggtggagtcagtgacctggagtcagaacttccttgatgtcttatggccagttgaatggtgctttttccaggcctgtccatggccactcactgacaaaacagcatgcacttctgccattctgagcccataacatctccagactcagccagatccagagacttgtgaggatgacctgcctgcagataggagctacccacttcaggtaacctctctgctgagagctgtgctgtcacttaataaagctcctctccaccatgttcaacctccagttgtccacataacctcattcttcttggacatgggacaagaactcaagatccaccaaacagtgggagtgaaaaaagccataatatatttctggccagcttgctaagtcatgggcagtgacatgctcctggaccacaggattgaagagtggtgaaccttctgggggctcagacctctggattccccaagccagagctgctttaacgtcatagccctcctgccctctgctggtaccaggcagcttccccaaacaggaagcagcagcgaggcaagccagcccaggatttgcaggccagaacaaggtggcaggactgaaagagttgtaacacaaacggtctgaaacacacctgctctgcaacatccccctcacagctcgctatgctgcggcggtgaggggagaagggctgtaaaccttctgggatccccgacctcagggctccccatgtcagggctgtgtcattcggtaacaccctctttggggttctgcggtttctggcatctctacgctttcaggcgcactgcattcccctcatccggacattggtcctacagtagaagcctcttgcagtacacctggtccagtctcagtctctcatggtgctgccacctgtgctagtgcgtggagctgccagcgctgctcaagtagccaacatgactaactgtgtgcactggcaggaccccacgcttgattgtttacacacccttgccactccacacctggctcacccttggcaggcatgggatctgtgttggtagcacgagccaatcaaagactgcaaggctgagtgggtgaaactagcccagcaggcatgagcaaaactcaagcagaggtgctgttgaccccagatgtttccagctggcaaagtgacatcctgcatcaacatcttataatcgtttactaggtataaaaaaggggtagcagtgagcattttcatccaaagtagatcttcataattggaaataatttacacttatactctcactttatagatgagaaatctcagatacagagattgcaaattgtcaacagtcacagaagaagtcagtattaaaagagccctacaactgaatctcaaggaacataaagagtttactggagaaaaatatcatttccatagctatatatgttccaaccaagaatatgtcactaggcgttttacattcttatttacttaaggacatgaagccgaaagtcagaagttaggacagacttagaaaatactggcagggtagtaaacatatatagaatgactgtgtgttgctttgagttagaagtgatgggaataacctgccacctccatacgtgaatctaaatcccatgcaggtgactactactgagaaaatctggcttcatttgctgcattgagacagtgcaaaaaataagagtgttcataaacatacatacacaggagtttaaattgcagtactattcacaatagcaaagatatggaatcaacctaaatgcccatcaatgacaggttggataaataaaatgcgatatatatacaccatggaatactatgcaaccaaaaaaaagaatgatatcatgtcttttgttggaacatggatggagtggaggatgttatccttagcaaactaatgcacggacatataccccatgttctcacttcaaagtgggaggtaaatgttaagaactcatggaagcaaagaggggaacaacacactggagactatttgagggtgtagggtgggaggagcaagaagggtacaaaaaaaaataactgttgggtacgaggcttagtacctaggtgataaaataatctgtacaacaaacctctgtgacatgagtttatctatataacaaacctgcatatgtacccctgaaactaaagtaaaaattaaataaaatactaaagtgtggataaacatcttttaaaaagagtatagaaagttgcaatagaggatcatggaatatcttcaagacatctcagattttatcattaaatttaaaaattataaaatgtatgttcattcccaccaaatatattgcaaaataataaaatagatcccctaaacttttctcttctaaatttgacaaggggacaaaagagtataaggactatactatttttaatgagagagagaaaatagtcttgctcctttgtagaaataatttataagaatatgccacaataaagcctgaagtatgtgcctctattctatagggggcacaggttcaaaacaagatatttgacctattttccactatgagaacaggattttttactttaattccttagacatgacaagttgataggaaaagcccgcattttgctaagatacagtcatgatgctacgggagttaaatgaacaactttactaaagtcttggtcaatctgactttagtattctggatttatgatgtcatgtgtttaaactctccctgataaaattattaaagagatagaccctgaggtcacataaattcttacccatatctcacttgtttgtcattcaggtcatttctatgtttgttggaaggtgaattaatcacattagtaataaaaattaacagcactgaatcattttagtgcattgaaatgtggaatgaacagtaataatcaaagagtaggaaaacaataaaatctgagttcttacataagaatttgagttgtgaataccaggcaaggcttttgtacatatgattttttaaatattttggtttatgcctagattaaggtatgtgtgagtgttagagagtcttatctccttaagttttaatatatcatatttatcccagtttcttttttttctccctttttaaggaatcactttattaagatatattttacacaccataaaactctcccttttaaagtatacaattcagcagtttttttgttaactcacaaagttgtgtaaccatcacaactacttaattttagaacattttttaaatccccaaaagaaatcctatacttatcagcagacagcctcttcttcttcctcagctcttggcaaccaaatctatggatttccctattctggataattcaggtaaacataataataaaatatgtggtctattgtaactggcttctttcaaatagaataatgttttccagattcattcatattacagcacgtaacagtacttcatttcttttacttttggaaaaatagcattgtaaaatctataccatatttaaaaaatttattcatcaattgatggacattgtgattgtttctattttttagctgttatgaataatgttcctcggaatttgggggcaagtttttatatagacatatattttcatttttcttgtgtacatacctaagagtagaatttccaagtcacgtagtaatgctgtgtttaatcatttgaagaactgctaaactacatctgaagtgtctgcatcattttgcattcccaccagcaattgataacaattccaattcctccacatccttgacaacacttaatatctgactttttgattctaggcatcctagtgggtgagaagcagtaccttgtggttttgatttgcctttctttgttaactagtgattttcatatgcttttgaccatttctatacctttggagagatttctatgcaagtcatttgcattttttaaattgggttgtctttttatgtttgagttgagctctttatatattttagatgctaatgtcttattggatatatgatttcacaacactttctcccattctttgaattatgttttcacatttttgatggcattatttaaagcacagaagactttaagttcaatgaaattcaatttatctatttttctttgatgttgtagttaagaaccactgtgtaacacaaggtcacaaagatttactcctatgttttcttctaagaattttatagttttgccttttatatttaggcctgtgatctattttgagttatatgtggtttgagatagggatctgacttcattcttttacataagactatccagttgtctcagcaccatttgctgggaataaaatattactttctccattgggttatcttggcacctttgtcaaagatcagttagccataaacttatggctttatttctggacattcaattctattccattgatttattcgttaggccaattttgtctatgcttgtaacaatgccatacttcattgattctcatggttttatagtaaattttgaaatcagaaactatgagtcctcctactttgttcttttttaaagatttggctattctgggtccttgacaatgccatgtgaattttagaatcagcttgttagtttctacaaagaagtgagctgggattccgattgagattacattgaggttgcagatcaatttggggaatactgccatcttaacaatgttaagtcttccaatccatgaatatattttttccattcatgtagatctttggttttccccattaattgaagttttctgaatatcagttttacacctcttttgttaagtttattcttaagtattttacttgatactgttttgaatagaagtgttttcctattttcatatttgggctgttcattacgaatgtatagaaatatcattggtttgtaaagtattaatcttgtatcctgaaaccttgctgaactcattagttctgatatatatttaagtagattccttaggattttctacatatacaattatgtaatctagagatagagattctttccaatgtggatcctttttatttctttttctttctcaattgccctggctagaacctccagtacaacgttgaatagaagtggccaccacttatcactcctggccaaaattatttatgtcttcttttaataaaaacattaagatgttttttgttattgttgtagctaaattcatgtgattgacttctagtttcagtacagtctttagaaaatgtgaattgtacatttttggggatcacctttaaagttgtctctgtttcaatgtacctgttcttttttaaaggttgcatccaaagtttgagatatatcttttatcttaggtcaatatttgaaatagtcattcaaggaaacatcacagttacagattaaatgcttttgagggtgtttatcatctctcaaagctcaactcaataaacatagtgttcaagttgtgtgcttaataggcctttgccagagttacgtcacttgtactttctttcccagaatggaaataacctgatgtacatatgaatatatattgaggtagtaaggcttggatagccttactcccataattaaatcctgtatagagcagccaactatattcaactgtgaggtctttactcaatattaacagatccttaagtggatgaaagaaggtcacagaatgcttggaaagtatttctgatccagttgaagaaagcattagatcaaaatgtgaaggatgaaggtgataaaaatgatagacaacacttcttgcctgatattgttgtaagcactacaaaagttgcatgtaatatctttacaactgctctttaaggtatccccatttacagtggaggaaatggaggtacacagacattaaataactcacccaagttcatgcaggtaacaagtgatatagctgggatttgagcctaggcaaactaacttccaaactgtcctctgattactaagctacagtacaatgaagatcaatggcagaggagtggtcagaacactacctggctttgggagactcgcagagtttatttggtgtcccttcctgcattccctactttgtcacccacattatcaagagggaaacaggaagatttcagactgcataagtggggagagctggtaaaatatctggggtaggttagtcagagtgtccttaacacatcctcttttgcttcaaaggtgatatggtttggttctgtgtccccaatcaaatctcatcttgtagctcctaaaattccctcgtgttctgggaaggatctggtaagagataactgaatcatgggggcaagtctttcccatgctgttcccatgatagtgaataagtctcatgagatctgacggtattaaaaatgggagtttccctgcacaagctttttttttttttgcctgctgccatccatgtaaaagacataactcactcctccttgccttccaccattattgtaaggcctccccagctacgtggaaccataagtccattaaacgtctttttcttcctattctcagcttatgtcgttatcaagagtgtgaaaatggactaagaaaggctaagagaaaaggcactgaagctctaaccacataagcactttatctgagcacttcctctgtctacattcagggcttgcttaataagttggttctccttatctccattccatttttgtctcatattctggtttcttgaatttcatttccagattgacattatttgtaattattcaactacatgtttgtagaaagaaacaaatgtgtatgtttatttttcttcaagaagaataaacatttgagaagttttctgtggtgacaaatatttttgtgaaaattagtgacaaattattatactttggggaactgtaggacattttttctttacaagagaattcttctttcaagatagccctcacaacaaaacttggctatgtctctaatcgttggatgtttcattctctctctgtctttcccagcagtacgcattgtttagggaagcagatgacttcaggacagtcatgtaaaagacaagacaaatcccaaccaagccagcgttaggggtaatacagtaactacatggctatgaatgtttgaaacagtattaatttgatttgttagaatttaagtagaaaaataagaaatttctcattgttttttaaggacaacttgtacatctattaaacagaacattgacattgctataataccaagaaaatgttatcccataattaatcttctattaggatctgtctcagaacctcctcggttaactccattccatcctacaccaaaaaaacttcactatcggatatccgcataacactgacattggcatgcacacattccaagcatttaactgtcttccacatgtccaaatcatacaccttcccaggctgtaaggggtatctcagaagtaagaaatgaagataaagtgggattcccattcagaggtaggtggccataagcaggacagtgtaaaattatttgtctatactccatattagcataacctcattcccttaaagcctgcctaacagccctaccacttaccattgttcagtgctttaggaagatgctatgttattctttaagcatgattttttaaaccattttagtttaaatgttaaacagttaaacttattgtgtaatatttcatttcaggaatctcaatcatcttccactatttctcatttgcaaaaatggtaagccaattcagcatcaactagaaaatagaaataatatgtgaaaagacattttcatatgtctcaacatgtttgtggataacttttcaaggcttacatctttctttgacattagagtttgtatagcaagaatgatacacaggctcaggcaaagtggaaatattctcttattacaaataagggaggagaatgaaaaatggataggagtgtcagctgaaaattgtagaatgttctgtatcaagaacacataatacttgttaaataataagtacagtgttctgagtacccaaggttttgttaaaaagtatgtacaataacaaacagagaataataagcagagagcttttgaaattagggaagaactataggatagtatttatattttggtgaacacctggagaagagctgcttgatttaggacaggaggcaagaaatcatacagcaaatgtgtgcttaattaaccacaaaacgttctttcaatgtattagcaatatgatagataatgtcagacttattagaatcactatataaattattcttggccgggcgtggtggctcacacctataattctggcattctgggtggctgaggcaggtgaattgtccaggaattcaagaccagcttgggcaacatactgaaaccccatttctactaaaaatacaaaaagttagccaggcgtgatggcacaagcctataatcccagctactcagaagttgaggcaggaggatcacctgagcctaggatgtcaagggtgcaatgagccaagatcgcaccactgcactctagcctggataaccagagtgagaccctgtctgaaaattaaattaaatgaaaatatcttcataaaagcattcataaatattttatgtcagatgagaggctaaaataaaaaagtagatagtttaacttcccactaagtgatcactcttccatgtagtccaattattaacactcttagtgtcaattccttggagtgttaacaaatgcataagtcctatgctaccctgaggggcaattatgaatataatgtaatttttgcttaatgccaaagaaacatgtttaaacactggtagtccttctgaaatgaaacttgccgtcttgtgaatgtttaatgaatgctatcctgatggtgaaattaggtgaaaagcaagctgatactcagtgaatgaaagctatcgtaggtatgtaacctctcaagttgggttgaactccacatgtaggaattctgattcttacacattgaataaactttatagaggtagattttaatgtcctgatatgatttggctgtgttctcagtcaaatcccatcttgaattgtagctcccataattcccatgtgttgtgagagggacccatggggaggcaattgaatcatgggggcagtttcccccatacagttcttgtggtagtgaataagtctcatgcgatctgacggctttataaggggtttcctctttttgcttggctcccattatctcttgcctaccaccatgtaagatgtgcctttcaccttctgccatgattgtgagactcccccagccacctggaactgtgagcccattaaacctctttttcgttataaattacccagtctctggtatgtctttatctgcagagtgaaaacaaactaatacatgtcccatgaatattttagaggctattagtgattgacacaaaatactttatgagtcataatttgttgtgcctccttccttagtgataaattgaaatccttttaattccaggtaattgtatacaattatttttgatctctagtcctatgtgtgaagaaaagaagtttaactaattagctgttgtagaaatgaatgatgctagttggcatgttggtggcatttaaattactatggatcctaaaaagtaaaaatgaaatagcagagggagacttccactctaaaaggtaaaaagagccaaagacataggaagcaggtggtgattcaggtcattccagaaactaaggcaagagttgaacatagtaaactttgggcaccacatcaaaataaaattatctaagatacagtggctcctttaatttagaaattgttgttagatggtctttaatatggattgttgcttaatgacagttaagattaaagaacttcaactattattaaaagaatgctgtccattttcctattagaaagtagaccattttgagtgtagatatgtatcttgtagattttttcctatttcatgtttttttagtttatctagtgacatttgttaagtgattcatagttgatttttattaaaatttgtagtactatttatcccaagtcttctattttggaggcctaagttgcctgctttaccacacaagtaaatggtactgcaggttatttggtaaaagtcaggagagaattatttcaaagtctaaaataaaattgtcaaaatatgtctttggaaacgtggctctagatttcagaaatacccaaacataatagctcccatttccgtttgagtagtttgggcgggctttatgctgctgtaacaaacaaaacaaaaataaaatgcaactcagttgcttaagaaaacagaattcatctgttgttcagataagttagctgtgaaactgggagtatcttcactgcagctgtcctccatcaggtgactcagggattaggaagattcagtcttgtggctctactgtctcaaatgcatgcctcctctacaatctcctttgcagaggaagagaaagactgaaaatgcacatagaggatttttatctcctctgcacagaagtgatatactttacttccattttcccttggccaaaagtaatcctatgaccacacctaactgcaaggtggaaggaaaatatgattttctatatggtcaataaagaaagaaacccagatattaatgcacaccaatagtatcactctcaccatccttatgatttctaataacctgctatcccagcaagctaaagggaataaaaggcttaaagcaaatgctcataattttaaataacttttttaaaaatgataaataaaagcacctaattatacaggaaacataaaattaaggtccttgaagttggggtcatgtcatatcctttttatattacccaatccctatcaaatggtttgcaacaaaaaaaaaaattgtgagagaacgaacatattagtaaattcatgagagtatgattccttcctttggtcagggaacacatgatttatgttcatatcatgacataaatttacatcaggatagcatactagcagtaataacaactttaataactgtgtataatgttaaaatgtgcaaagcattatcatatactatatgcttaaaaagtcaaaactgtgagattggtatatatgtttggtttgttctctacaatttaaatacataacataacaaccttgaaaacagtaacatcattttaacacaaaacatttaatttttgaggggagagtatcttgtagataaaacatcagaatatttttggtacatataaaagaaatacactttttaaactctctagatggaaatagcattcaattcttggaaaatacaatactacatttgaattaatttgtattatttgaaagatattgtatgactaatgctaagcacatgaatttaatttgcaagttacctataatactgttaaaaaaaattcaggacggccaaacttgcataaaatttgcattagaaaactgagaacactaatgaggaaatgaaacagccattaatcatcattgcgtgactgcagaagggttaagtgggtttctatagattttgcttcacttattaatgacatggttttacaggtataaaagatatgtatacacagatccaaaattggggcgtaggctgtggcaatttatttccccttggatttaaagtaactatctctgaatttttctcaataactatataagtacaaaagataaaatcttgttttaactatctatgtataaactttcctaagagctccagatcagggttactactcaaatatatgtagaattgggttttattaaaaacttactaggataatagtatctcagtatatatagtctttagagtccaaaggatagactgaaatctcagcatcttgattcattaagtatgagactgtagatgaactaattaagctctctgaccattagtctcatctctaaagtgatattaaaatgccctttacaaagtgagactggaagcatgaaatgagaatacacagataaagcacctagcattgcacctgacaaacggtgaaagctt

SEQ ID NO: 614 - DNA, 57962 bp, Homo sapiens
gatccattcattctactaataatggacatttgggttgtcaatttttagctattacaaatagtgctgctataaaaattctagtttatagcttttggcaaacatacatatagaataatctggggaaaattgatatctctacagtactaaatcttccaaaatatgaacaacgtacatttatttaagtctttttaaaatttctctcaatattgttttgtagtctttgttgaacactggcacatttttcattagatttattccttagtgttttatatttttgatgctattataaattgcactgggactctgtgggattttaaggagatggaacattttagcagcctgagctttattgcctttctagacaagaatcctaaaattttcttttattaaaatgataggaggagaaagattatttaaatatcccaaactattaaaactgacaaaagggaaaacaaataagaccagaggctgcaattagccaattagagtgccaactacaaattccagttttcacttccaacagtatcaaataggccccaagaaaccttttcccagaaaaggatccaaaagaaataagttgaaattccatggtttgtgtaaaagaaataaactctttttcattgatctctggccagagagtgagtactttttctaatttcaaaaatttgaaagggagacaaaatccaatatttatacatacatattatgtgtcaagtgcattttacacaattatctatcatgacaaacctacacactgtttgcatttattcaattttctagttgaggaatctgaaatccaagagattaatgccccaaatcatactctatcagtgatagaaatgcaaattcaggcctgacagatgccagcagcaaccccgcacccccatctttagaagtaacatgaattggtatcttttcaactattaaaattaaagtcatgttcattacagaaattttgaaaaatatagaaaagtataaagaaatgattttatagatatacattgattttctactcagtatcacttataatatcctcacgagtttatatactcttgaactttatcattctaacatctgcatactttttcatcagttaatacactgtaatatttaaaccaaatacctttcatgttggacatataaaactattactatttttcatgtaatacatgactctgcaatgaaccttgcatctgtatcattgcaactttgcacacacctctgattatttctttatgataaattcctccaagtattatcctgagtcaaagggatagaaacatgttaagactgttaatacacatggtcaaatcctcctcttcccttccctcccatctcccagataagtcacagcttcttcctatccttagcaagagagagggccatctgctgtgtctttgtctgtgctggatattaccacttagaaaaatatttcccaatcggataggtcgaaaaaatcatattttaatttacacttctttaaataccagtggttttgagcatctagttattggccatgtgtatttgtccatttggatgttgccgtttctcaacaaatgctctctggatcacttgcattagaatgcttatgtgcataggaaacaggtcgattcctgattcccagttcagactacctaaagtgatccctgcatgggggttggagggaggaaatctgattttgttagctctgctggcaattcgtatggactctagattttgatcatcactgtcctcctccagtcgggcctctgcagattccagacctagaagcagcaaacaagtctacatgttagcagtggaagagactcgaattaccccgagttatggccggaatatccatacgggtcagtagcaacttcagtccttgcctcttcagaagaaataattcaactgaggggcataaagcagaaaaagagactgaagcaagttccagagcaagaatggaagtctattttaaaagacgttagaacaggaaagaaaggaaaattcacttggaagagacccagtgggcacctgaaggtccaagggagaaaagagaaaaaaaaaggggggggggggctttaatcttgatcctacaactttataggctcgcctctttcccacgaaaggtgtaggattcccgcatgcgcaatgcttttcttgccctctggaattgagcaggcagcgtgtttagggagttatacgcatgcccatctgaggcattttcctttttccggtggcatgtgttcccggaatgtcatacttcaccattttgtctcttaacatgcgtgcccaaaaagctgcttttccctgggttctacattcaatgaacatttttaatgttaacaggtgtggaccatcagtggcttgactctccgtggctgccgaattatcatttctatagaggcaatgcgataattgccgaactatcactcgacatttctagtgggtgggggagagccccctcctgccccactcatgcctaactacctgtaacatacacagccacggacttgatccctttataagtcaaaatcactggtgatcctcacatgaagcttttgtttgtctatataattcaaatgtgttttcaggtatttttttttttaaagagatggggtttcactctgttgcctagactggagtgcagtggtgtgatcatagctcacagcaggctcgaactcctaggctcaagcaatcctccagcctcaacctcccgagtagctggaactacaggcaggcacaaccatgcgcagctcaggtacattatcttaataactgcagagaaatctctgagatgtcatagttcaacccctcatttagccatgtcaataagcttaaaacacatttttttttgtggtatagtcaagccaatgactaaagattcaacatctctgcccagcaggattctaactacatagcaaaagaagagatttttttaaagagaataaaatttttattttgaaaagtttaagaaatcctgcaagagctgtgaaactagtagagtttcacaagtagagaaccaagcacaataaagcaccattcaatcctggatttcaaggagccagatgaaaagcctagtagggtggggtcctcagcctctcctatcttacttcccttcactgattaggccctagcaaatagaaacaaaaggattgttttcctgaggacagcatgtacatgtttaaagacattcagcttctgtaaatgccttacagggaattttaaggacataaaagctacaatgatattgtttgagaagctgcttttttcttatgcctttgcaattcaagcaagccaaatataattctattagcagtttttaaatgttaagtgtaaggattacctaatatttactaccagcaggccaaaatgacgcaaacaataggccagagctagcagggtgggcaggaggtggcacgtcatattcatgtgaggaaacctcttcccaaggaaataggtagaagcatccctgttaccgactgaatcatgctgccctccaaattcatgttgaagtcctaacatccaatgtgactgcatgtggaaatagggccttatattagtctgagtgctccagagaaacagaaccaataggatgtatatataatatgtagaaagaggtttattataaggagttggcttgtgtgattatgaaggttggcaagacattgatatgcagagtgaatcggcaagctggagaccaaggaaggcaatttaattctagtccaaggctgaaggcctagaaccaggatgaactgatgtttcagtatgagtctgaaagcaggaaaaaagctgatgtttcaattccaaggcatcaagcaggaagaatgctcttctacttgagggagggacaggctttttgttctacttaggcctttaactcataggatgagggccactgatatcagagagggcaagctgctttactccatctaccaatttaaatgttaatctcatccaaagtcacctcacaaatgtacccagaatgtttgaccaaatttctgggtccagtcaagttgacatacaaaattaactatcacaagaaaagtaaggttcaaacattacgatcataagggtggggccctaattctatatgactggtgtctatataagaaggggagactgggacacacagagagacaccaaggaagggcatgcacagagggaagtccatttgaggacacagcaagcaagtggccatcagcaagccaaggagagaggctcaggagaaaccaaacctgccaacaccttgatcttggacttccagcctccagaactgtgagaaataaatttctgttgtttaagacacccagactgtggtattttgttatgacagcctgagcagactaacacagtccccttcccaggaaggaagagaaaacagctttcctgttgcaaatcatcatatatgaagaacttatgcctgcactgagctatgcatttttcacccactgctctcatttatccttatgacactgtccagaggtgggtgcgcatatctttgtatcagttaggaataggtttggttgcacataatagaaaatccaagctaccatggcttgaccaaatgaaggcttatttttctcatattcaataactacagaagaaagcagaccagggctatgaggcagctcagggagatgatgtggcagctgtcacatccaggctccatcaagcttctgctgtttagctatccttcatgcatggcttttgttctttgcttatttccttgtactaacaagaatataactccatatctggcattcaggtaggaagaatagtaaggatgatgagcaaaaggcacaggacaactcagtttctcttttaaaaaaggttttacagaaaagcagaactcctgtttacagttcattagattgctctatgttatgctgcaagggggggctgagatctgtcattttagcagaatagaactgagggagaaggagagaatgactactggcaggcaacagcagtgtttgccaccttccccttgcacggatgagtatggataaattatacatgtcagttgctatttaaatcatgacacttggggaaggggatgctattgataataatgccaggacagcaggcacaaaacaggactctcctgaacaaagtgtttggatgcactacagaggaggccgagaaaggatgcttaacttgtccaaggacacattgaggattccaaccctactaactcttaccccaacactcatcctccttaacaattgcactagaatgttatgattataaggatgtagatgtagattatttgcttcagaaacactaaagtgcttgctaaaaatactgattccttgaccctaccccagggctttggattcagtgagtctagagtagaggcccggaggtctgcttcctaaataaacatgccagggtaagtctgatgcagtgagctgcattccgggaaacattgttttaagacaaccaaacctgtataaataagcacaaatcctccaccatgctttcactaggagaaaaatgacatttattcaacttctgtgactcagcagtttaaaaggacaatgggacatttcttgcaggacctggtcctcctgataaggactagccattacctagggaatctgggaaccaggcaaacattcatctcattggggagagcaaaggtgaacagacccatgggaggctgcgggagggtcatagcagcccaatggccagaggtgtgtctctcctcactcctgcccaggtaacttttatatgctgagcctatcaactcccctggggtgaggtggggtgggttgcaggaaaccagctctattctgataaccacagaacaaaagggttggtagcctctagaaaaaatacccaaataagacagagcaagtatagacttttcactcatacaacgaacagttttttaacacctactctgtgtcagattcctagtgctagggatatgttgatgagaaaatacacaaaatacgtgccttcgcagagctttcagttgagcaatgagggaaatcctacaccaaagaacctcactggtgaatgcatacttaacacattgcctctgttgatctgaaggaagcctccagagctacaagcccttacagagtgccaaaaccacctctccatctcttccagttaattcttcagtctcagttcataacatgctcccttagtccaggtcaaactccctgatattggctgatactcaaatttctgttaaatgcacatatgaagaaataaatgctctaagtccatttattacaaagttttctcaatttttacacatattgattgcaaggtatacaaacaatttgataacactttctcttttttttggttgggagtgggaagggaggagttaggaaaaaaacacacacacacacattaaaatttccagaccatacgatgcatctaaatttcatgagtttgaaaatacagagagaaatgagttttagaaacaaggaaaagcagtacttagtgacttgcaaccatcatctgctcatcacctgggcaggggcaggggagtatacattagtacatcagtattttctgcatctgcctgtaggaacctcaaggccagggaaggtcagacttggtgtaatgcaagggttcatatggcagtttgtattttccaaagcctctcattcctcatgttcttcttataaggtggcatcaacactcctcctaccaagaagtaaagtctgttccctcctcttgcatctagaggatgagtgcatgccgggggtgcgggaggtggggtagtgggagaggagggaatgggtaacttctccaaactatagaatacagtggaaagggccaggtgcggtgactcatgcctgtaatcccaacatcttgggaggctaaggcaggtggatcatttgaggccaggagtttgagaccagcctggccaatatggcgaaaacctatctctactaaaaatacaaaaaattagcaaagcatggtggcacatgcctgtttggaaggctgatgcacaagaatcacttgaacctggaaggcggaggttgcagtgagcagagattgtgccactgatggagtgagactctgtctcaaaaaaaaaaaaaaaaaaaaaagaatgcaatggaagagacacaatgcaacttcccaggctacgttacctctctgcctagctctggctgtctcctaggatgctcatcctcagtacagttcagctgccatgttggcaggaagcacaggccacatgaagaggtcatatgtaggtgttccagctgacagcatcagagaatgtctcaactgacagccggcatcaaccaccagacaagtccctgagtcagagccttcagataattccagccactagatttcagtggctggaattatcttcagccactgaagataattcagtcaccccagctgacattaagtgatgcaggcaacctgtccctacagagccctgagcaatttgtagatctgtgagcaaaacataggtcatcattagttcaaatcactaagtttagggggcagtttgtgatacagccatagtaactgaaacagcatgcaaatgcttactgcttctttcttagcaataaccacagaaacatggtaacagttaagttttatgtcctgctttagagtttgcttcttgcactctttcatttcaccaataaattattgtaatcacctccacctcacatgcaagaaaattgagacacagaaagacaaagcaatttgtccacagtcataccttcttctccatgggaacaagacaagggttaccggagttattaagaggaattaaaggagtgcagttttgaatgccggctcttccccgtttcttgctgcctgccttcggataagtcattaacctctctgagtctcggttctctcattgtgaaatgcagatgaaaatagtaccactttgtggaatttttattcaatgtttaactacacaagcagcactgaagacaaagtcaggcccagagtcaggcgctcttttgtcttgtgtctccagcagcacggggcctttgacagggctggcactccatgaacatttcctggatgaatgaacaaatgaattgaactcccatccactaggccccaaaatgcctcctcctgttatatcaggatgccacacttagggcttataactagcagggttgattttccttggcaaatactaaatggaaactgtgtactgggttggcacagaatggaaaaattggaattttttcctacgcttctatgaatctcccattcatagaagcattcaaaaattcagaatttaaacacacagccacacacacattgtagcatcacacagtgctcataaatcagggctgggatgcgcactccttaaggactattgccccaaccctggctgagctcttgccctctgagccacaacagtggcttacaggtctcttcgccctgcacccaaccccaacacaaacccaccacttccccagctcggcagagtggcactagctattctctgctgaaaacaaggaacagaaatcaatttcgttctagccatactgagtgcagcaagcaggataaggctgaactctgtcaaaccaacaatgtagaaaacccgatttaatactaagatggacccaattctctgacaggcgtgttaaatgtgattaaagctgcacagcattccctgcatacccatctgccatgttgaggagcccacagctgttctgatttctgatgtacagtttcttgtcagttgtttcaaatgtatctcatcttgcctgtaatctgggctctccctcccttgcccctcttcaggccagccttggccagcttctctaagcagttgctgatatccacatgcctttggccgcgggtctgtagaggcatgtgtgagctctggctggtgcaaaatgtgtgatcacagagaaagcttagcgctttagcggctggaatgagtctcttggatcctaagctgttgtgacgccaccacctgcagctcctgcaggtttttgctgcagggtgaggggaaagagcagggacaaatcgtttttgatgctacagagagctgtgcctgagatgcctacatgctaccatggaaatacaatctgaaagctgtggaagtccagtgcaggcatactttggggttgtggagaaaggcagaggcagaaatggaagtggggttcttctgggcaagggatggagtcctcagaggccattgcaaccttgtgcccaggaggcacagataaggtagaggacagctgatttcaagaggactggaccacctagcattgacccatatggcatcttcatgagaattttttaaaagttggagctatggccctgcaccaaggtacacaacctggcaagcagggcataggctggatttcagccccactcaccctcttgaccaggggtccttgtgcaataaacaacatgtacaaccacacatatcaacaatgaacagaggaagagctccaaggagcatacggaagtcatgatgagaagtagggggacaaaataagtgaaaaatgcctgcccttaagcaactgagagcaagcaaggctagcaatatggacgtggaaaacacaggagagcataagagaagggccaggagagaaatagaaaaacagagtgccaagggattcaaagaggagaacatgcttctggttggggaaatcaagaaaggcttgcagagagagatggcatttgaaatgaaaaggagaaaggtacacaaagacacttcaaacagagaggcatgaacaaagaaatggcagaggggagatcagggccatgtaatgggacagtccatagtccaatttgtctggagctttaagtggatgcaagagatgacatctcacatctccctcgggctccacacaagaaggatgctatggcagacaccttataaatggagaatgaggctctgaccctgactccctctccatgtgtctctggccagcccatcttcacccttatgatgaccccccaccacttgtgcatttgctcatcgtggcctccactgtgccatcaccttcttgttttgtttcctggacgctggagcactaaaataatttggggatatattatagaggatcttgaatgacaactatggaggatcttgaacgtaacaaagatgtggactttgtagcagatctagggatcaagaagagccactggccatttttgacatgattcatggtcaaagcaacatgatcagaatgcacctaggaaaatcaccctgtggtggaaggactggagaggaacaaggcaggatgctatgctctgggtggggaaaatggagggagtgaagggggcaggaaggaaaagcagggccatttcaaaagccaatatggagactagaaagggtgtcaggtggaaaattgggtcaaatcattgaattgtcagaattaagtcctgccagcctgcactggactcctggatgcaaaggctggggtgttgtgtttctacacacccaaccgcaacacagcagagggtactgacacgatgctggagccagccaatcaaaaaacgacttgcttgtgcagggggaaactgactgcagtacctctgtctcccagatagttggtgtcttcctggggaatgatacaatgggaataacagaaatgaagtcatcagactggaatgttattacagaatcaatcactttcatggaaatctttattccactaatagtctcgttttaagtataagattttatctgtttagaaagaaatgtaggagagggaaaaaagaaggtgaagagaagagtagggagaaaagatgaggtaagtcacatatacgccttcttaagtctccaattcacttgagaacttaaagtcataataaatagttcagaaacacaaacatactgattctcccttagctatctgtattgacgtgctggggctgctgtaacaaagtaccacaaactgggtggcttcagcaacagaaattcgttgtcttacggttctgttttttgtttcgttttgtttttgggatagtatctcgttctgtcactcaggttggagtgcaatggcacaaacagctcactgcaaccttgacctcctgggctcaagtgatcctttcacttcactgggccacaggcatgcaccaccaagcccaggtaattcctttattttttgtagagatggggtctccccaccttgcccaggctagtctcaaactcctgggctcaagcaatcctcctgccttggcctcccaaatcccaaagggattataggcataggccaccacacctggccctgtctcacagttatggaggctggaagttcaaaatcaagggatcagcagggccaggccttctcagaaacctgtaagggaaaccttccttgcctcttcccagcttctggtggtttgctggcaatctttggcgttccttggcttgtcactgcataacatcaatctctgccttgatcttcacatggcatttcccctgtgtgtctctcctgactcttcttataaggacattagtcatattggattagggaccagtcctactcttgtataaactcttcttaaataattacatcgacaccaactctatttgcaaataatatcaagttctgagacactagggattaggacttcaacatatctttttaaggggacacaactcaacacctaacactcccacatttccctgttccttctcccagaaaggtagggttggctcccaaagagggcctcatctaagagattccttccctgacctctctcatctcttcacacctaggtttccactctaggaatttctcagggaggcagagtggatttggtgtcattgtagggaacccctatgactggtccttggggtcaaatcctaactgcaagattggctggctgtggccaaaaaagcccaggggctcatttggatcctcccctaccttgaggtattcctaaggaagcactgttattaccaccctcactctggtcaaaggggatggcagagccttcttggccttctggctcaagtatgcacatacccttcactgggcggggtttctgcacaaatacacaagtattatctttgctcatctcctatgatctatgacactcactatgaaactccagaggttgtcaagaataccatcccttccccaacccttctattttctgttgtcaatttgctttctacaaggggtcctcctagagatatttgaagacatttatttagtacaatgtccactcccacccccttagtcctttcttcagcagagatcagtccatttaacttcacatagtaagccaaccaagtcctcaggctccacacaagaaggatgctatggcagacaccctgagcctggacaatgaggccctgactcccattccgtgtatctctggccagcccatctttaccctgacaaggacccccactgcttgtacatttgctcatcatgacctccactgcgccatcttttctcctagaccatcatcttcttgttttgtttcctggactttgaagcaccagcttccctcctggaatggcacatcagcagcctgctaccccaggcacagccacaccctgtagtgcagtacagatcccatatctgtaggctgcaccctgctggcctagtctcccatggaccctctttcctgaatgcagagaagccatgagaatgagtcaggcacaacccaaccctgccacatttctccacgtgactgctcatcacggtgacaatggtaatattggaatacctcccgccctaggaaggaattatttcaaaggggctgattgttgcttcccaactccccatgaggcaagctcgttagcttgctccactcaactaaccagcctgggcagagctgctgctgcattttaggaaacgtggcattctttcttgtctcagaaataattcaaactcttccctcaaagccccagttcttcagttctgctgactcaatgctttcttaagatacatgttgaaaatgacaactctgtattagagaaaaacttgagtataggcccttcagttcttttaaagacatcagaaatcacttagtgatttccttaaagaagaaaccagtactaattgaaaatgaagttggtttaattcaataaatatttgctggcaaatatgatatttcaggcacaaaagacaaaagagaaataaggcaccatcctcaacctcacaagtgcacgttggtgacagaagcacagtacaaatggccacccaacattggtataacatcaaaggtcatgttcctacaagcctgagctcttcctttcccaaacctcaggtcacatttgtaccactctactcagatactggcaaaactcaaattgtcatttactaagcacacccattttagatcaggtataaataaataaataaataataagataaaaccacaaaacatatctgtatctgtgcatatgtgtatatatgtatatatatatatatatacacacacacatacacacacacacacacatacacagtgtgtattgcaacctcaagagatacagtcacaaatgccacaatccagaatgtcaaaatccctaaagatcaaaatccctaaagtctaaaattcctaacatctaaaatccctaatctctaaaatccccaaaatcacaatcctgaaagattaaaataccaaatgttgaaatcttgaaagcagaatcctaggggagagattagtatattttcagttgtacacagagctgcatcatattagtttcatcatcttaggcaaactattaccttgttagtgtctttgtttagaaattaagtatagtttaagggtgccaagtggacaaggagtggatttgtggacttaattttaagtactaacttgacagaattaaggaatacctagaaacctggtaaatcattattctgggtgtgtctgtgagggtgtttccagagattagtgtgtgagtgtgaatgaactaggcaggaagatgtgccctcagtgttggcaggcactgtctaatcagccaaaggccctgaacaaacagatacagaaggtgaactggtcttccactgaagctgagagaaatatttcttctgctgctttggacatcagaaattcaggctctgagctctgggacttacaccagtggcactctgggtcctgaggcttttgaccttggacagagagttacaccatctgctttctaggttctaaggcttttgaacttgcacagagccacactgccagcatcccagggtctccagcttacaggttgcctatcatggaacttctcagcctccataactgcgtgagacaattccccagtaaatcccttcttatatatctaaatctatatccttttggttctatctctctggagaaccctgactaatataaattttgtattggggaaatcagatattgttctttcttactgcattccttacaacataatggaagagatctgtgaaagttgttccctctaatttaattgtgtgaggctacttaatggtgaaagataaaagtttaaaactaattattactggtgctgcaaaagcagaaaatcacctaattgcaatagccaagcaatatccagactctcagatggacggcatatacttacgaaatgtatagaccacaactattctccaaataaaagtgcagcgagtgtttccaaactcaaagatgtgaaaacaaatgaaaaacacaagaaatctcccctgccaaattattctattgtatacaacttctgccccttcacacatagtgccaattggctatgctatgagttttatctttgcatcatttctagtactggtgatataaattgcacaaagacttttagagagctctaattcattttagacattttttataaaaaatggacaccaagaaagtgctttattcacaatgttgactttgtgtgtaagcactatgcatgtatgtaaaaaatgttgaaacttcctcagtaaatgaagatgtaaagaatttatctttcacaatgcagatgtacaaaaaggacctctctttgcacatctgcatttgtgaaagatatgatttcttgaagtcccaattcttcgggtgactgcatatgcagtggtgacccactgtggtttttgtttgctctcgtcaaaagattgaggttgcccatcatggtatttcagatgaccacagttataaagctgggtgtacagaattgccaatcatagtggtatgcatttataaatttcactttctgacctatttcttcatgtatacagttcataactgttatgctctcatgactgttgttagtacacctgactgtttatgcttgcaaaaatatgcacgttattattaactagtctgttctgtaaagcagtctatgaagtatgctgtcattcttttatgcttctcaaataaatcccccttttaaaatgtaaatacatttattttaaagaatttttattttttccagaattatattttggggattttggactaggaattttgatcttttggggtttcaacattcaggattatggtgtttggaattgtgtcctttggtattatgacctaaacccaccaacaagtgggagagcaaggattcaaacccaggtctgtcccattccaaagaacatcctcatgaccaatgtgccagtcagactgtccaggtgctactgtgctccaggaaaacctgaagggaaggttacagattgagcctcaaaatccaggttaggacccaaacctggatcagcatcatccattttacacattaaccctgatgaaggagagaaactagacctgaagaccaaagaagcagattccaggggtcagggtgaggtggccaacaggaaacgaggctgcagtttgaaggccaaggggatggaaaccaggggaaggtgggatgggaggaaggaatataaactggccctgaagaagggtttggcacgtggactgtaaatgaggaaagggtctcactctgattagtcactggccagatgggtggacccacctgcctcagggacagtgacaagtctgggacagacccatggcaatggcagcccccacctaggcagctgccagaaatcctgtgcagagtccagcactgctgactctgtcgtgtgacagctctcagatgcaacacgggtggatccgtgggcgcttccttgaggaggctgagcacagtccaaataatgcacagcagactttgatggccctcccaaccaaacctttttaggttacagacagtgctgtgtttatactcccagggacggaacatcctttgctcacagccccacgctccacccccacccaccatctccccaactttggcaaatgcctagactctgagcaatctgtgcagacatgttgtgaatcactgtcagttcaagtacacaatattccctgattttaaccctccttggctggcttgccttgcatgctcccactccaagcactggtggaggcaaactccataaggaagcagcacccccagggctgtatggagcaggcagcagggagcaacagcaggcaggacagccacagaactaggtgactgatacccatgaagctcagacagtgccaggcacagtcccagagactttacattcccacagatctgtgagcaagtgattattatgtccattgtgagtgtgaggaaattgaggttcagaaagattaattttcttttttatttttttgagatggagtcttactcttgccacccaggctggagtgcagcagagctatctcggctcactgtacctccaccttccaggttcaagcgattctcctgccttggcctcccaagtagccaggattacaggcacgcgccaccatgcccagctaatttttatatttttagtagagacggggtttcatcacgttggcctggctggtcttgaactcctgacctcaggtgatcggcctgcctcggcctcccaaagtgctgggattacaggcgtgagccaccgcacccggtccagaaagactaattttcatacacactaaagtgagagagcttagatttaaaactagatacgttcttcctaatatacaatgttctatctcaaatcatcatgtttccaatgatttctattagcagccataatagtaatagcagcagcctgtgggctaaacactacactaagtgctttgtatgtactaagtcatttaatctttccaaacagcactgaggaagatacaactactatcttcattttagaaatgaggatctgaggcaagagagttgagcagcaggagagaggtaaaaaggtagtgagttatcccctatgctcttcatttcctttgcccttctccttactagagcccactcagctagttggggcagactgaggctcatatgactctaagttcttaatagctcatctacagacctgtgctgaacagggaggatcctagaggacatgcggccatggagggtctgagagatggtttgggggtcgggatgtatatacaacagtcccatagagtcattccccaaataaagcagagaaggacaatttgaggtcttgagataaataagcaagaatggctagatgggaaagcttggaggcttctgaagattcatagagagggagcaggagcaggcagggcaggcccattaaaggaataataaaaattagccctttcgtgcacacagccctgggtcccaggtcacaaaggatcttcacagatgtgaatacctattttatttagggattcaaaggttccatgtatgaggcaacatagcatgtgggaaaggagcttggggacatgaagaaggatagagctctcgagcaggtgggaatacactaagggtggtcccaagaagggctgttcatgccaagaagtggattgacaggctctggaatgaagtgaatccaggaagaagccaaagcagcatcaatcatttcctgccatgcttgtgatgcccatcgaacatgatcactcccttgagggggctccaatgtctcatttgggagtgactctaccccagtttgttactttggctatcattagccaggaaggggaggttccttatgaatccattggactgctgattcctgaagacccagagtgatccatgaaggactcaaggacaatcctctccctattccttacccccactactaggaccaaattcaggtttaacttgccttccctggtcacctactaggcactatgctaaatgcaattctaattttggagacaaagaaactcgttcagggagaaacttgctcgatgtcacagatatccataagtggcagagccaggatccaaacttggacctcttattccaagtgcattgctcttttcactacatcatgctgccttctagaaaaatcagctaactctgtgcttctagactctacacagtattcaataactctgatgactttgaattcaggaaatgtctatcaattggaccaggatctgctttttaagcttatctttatttctagtacttcctgagaaagagtaaagtattctgaaatatagaagatggataggtagaaaaatgcatatgtaaatacacagatgatggttggatagatgggcagacagacttttttaaaatttttatggatacatagtaggtatatatgtatttatggggtacatgaagtgttttgatacaggcatgccatgtatggtaattacatcttggaaaatggggtatctatccccttgagcatttatcctttgtgttaaaaacaatccaattatatcttttagttattggacagactttgagtttattggacagactttaattgagctcctccatcaaactttgtgactttgaaaaatagtcacttaggttttgtttgtttgttttctataaaatggccttgtcaaagcccttctcatggaactattgtgagaaactacctctaacagtgcctggtatacccatagactcttactattctcccctttgtgttaaaatcatgcttcagaattatgtccaaattctgcagcaaggacccaattcaaatattgtttgaaacatccagaatgtctgtttttgacatcaagttggcccatagatttgacagcctggtacccatagagtccccacccaagaacatttccttcaaaacaagctcctgttacagaaacggccctggttttaaatatactcccttctctcataaaaatgccccagccagctaaagtcattctatttaaaatatttaattaataccttcacagaggtctggaacttattaaagactcttggggaccatgtcttaggggcaatgctttgttctaagcagctctatgtgttacagataatataaagtgctggaatgtgctttctattaaaagcagggacatttgcctgcctgctgttgcaaacccttttgtcatcatcgtgacacattaaggcataatccaagtacaacatacacacacaaacagtgtcaatccatccattgagtaaaaagagtcccaggaaaaccacaagaaaggtctggtgattagatgaggggattaaaaactggaggagctcttcctctacctcttctcccacctgaagaggccacaaaggcacattgctccccaagcaaacaagagcaaaaacacaaaggcacacactttgctctacctccagtatcttcttggcttctcagcctttggcaggtgaaagaaacattggttaaaagtcctaccttccaagcaagtaaacatgctcttagtccccctttgtctcacaggctgaagactggcaattgcttcacatccattgttgtctggggagtacatttttttttcttattataaaaatggtataggttcaatcttgaaaaccttggaaaaaatgtaaaagaaaataattattttaaccataaccctaccacctagacatgactttgctgcatttctccccttctatgtgtatactttcacaaagctgtcattaccacacatttacccttttatttccagcttcttttcccttaaagacattgggggaaatgctcagggtatcatagtaagagatgaagactttaaaagaaattaaagccttttttttttttcaagcagttttaggtttacagcaaaattgagaggaaggtacagagatttccaatatactccatgcacccccacatgcagagcctcctccattatcaacatcccccaccagcgtggtacatttgttacaactgtcagccaatgttgacacatcataatcactcaaagtccatggtttacattagggttcactcttggtgttgtacattctgtgggtcagaacaaatgtattaatgacaggtatccactattatagtatcattcagagtactttcactgccctaaaacccctctgtactctgcctattcacctctccctcctcgctaaaccctggcaaccattggtctttttactgtcttcacagttttgccttttccggaatgtcatagagttggaatcatacactatatagactttacaactcacttctttcacttagtaatatgcatttaagtttcctcatggcttgacagctcatttacttttaacgctgaataatattccattgcatggacataccaccgtttatttatctattcacctatggaaagatatcctgtttccaagtttttggcaattctgaataaagctgctattaacatctgtgtgtaggtttttgtacaattttcagctcctttgggtagctaccaaggagctcagttgctgggctgtatggtaagcatatttttagttttgtaagaaactggcaaaccgtcttcccaaatggccatactgttatattttgcacccacaccagcaatcaatgagagctcctgttgcttcccatccttgtcagcatttagtgttgtcagtgttctgggctttggtcattctaataggtatgtaatggtatctcattgttttgatttgcatttccctaatgacagtgatgtggaacttcttttcatatgcttatttgccatctgtatatcttatgtggtgaggtgtctgttgagatctttggcttattttctaatcaggttattttcatattttggtgttgagttttttttatacttttcttttggatagcagtcctttatcagactgccttttgcaaatatattctcccagtctatggcttgtcttctcattctcttgactatgtctttcacagagcagaagtttttaattttaatgaagtctggcttatcaattatttctttcatggattgtgcctttggtggtgttgtcatttatttttaattgccaaggatgataccactgtggggctgaaccaacattaatataaccaattatttcccatatgatcaacattgaggttgagattttcactactgtaaacaatgcaatgacagcatattgataattgtgcactttttggattatttcctttggataaattcctaaaagagaaatggagtctcaatcttgttagagtatctgatatattttgctaaacttccatccccaaaagtaccactttaccctcttacctgcatgtgacaatatccatcttatcacacttttaaaaatattttttactaagatacatagatatatctgtattttttttctttaaaaaaaaggaaaaattcatcataaggctgctgccctttttcatgcatcacgggagtacagttactatccctcttcttaccattccatttacattaaaaaagaaccctgaggggaaacaggggcctccaaagggtacatccctcctcccacctgagtgaattgggagggaaaattgaaggtcttttacaaaatcctaacatggttgagagcaaggatttaaactttggcccctgtacttcagccaagatcttgtaagagtttatttatttttctctatttttccctttgataatcaacaaatttaacgtattcattttaaatcccacaagtctgttccctttcccaggagcagaatgaagtaatctagttcccacgttctgacagcatagtttaagggccacaaaagatgatagcccccagcccatacagccagggatacttccaataactggaggtttgccaaaacaatcaagcaagagacatttgcaccagagccttgaagatcgtccaacccttagctgcccaattattacctccttcaagagtagaagtctttcctccacctgactgtagccatatcttgaaatttaattgaactttgccaccagaagggttcattttatttttaatagagacacaggcaatgcttttcttaagtagggacaacctagcggcaaaacctcactgtgttcctagtctttgcatcttatctgaagctaacatgcagacagggcagggggctctcagctcagtgggtgctgtgcatcttatgctttggaggtttggatggggcaagacttgggaagaaagtaccttcagccttacggtccctaagtgacagtgaccacataaggtgtatccaagtccactgagaatctcagctacatttcatgacatagctataaaacagttccaagtactaattcgttagtcttgggttttatgctgagtgactctgaaatatctgattaaagaggctagcttcagtttccactctgaaaacctggcttgaatttattgctgcctcacacaggattgcctcaagctgggtctctccacttcagtggcaggcaggttaactatttcactgctggatgctctgtccctcactgccaacccacccccagcccccttcctaaactctcatcccacagccccgggagcggattctgcaaagggcttataaagcacagagggaaactgaccatctggcctgagtgatctttttttgaagggtaaagaagatatttagaaagagtccattgtaataaacacattttcaaaattgttttaaagtacttaaaaatacagagatagagataattttctgtttaaaaaaagacttttaacagccaaataattctcattggtattttatataaaacacatgcgtaagtttggaaagtttcaatcacacagaaaggtacaaagttaaaggtataaaaataatgtaaagcctactttacccatcagaataaacataaaacccagtatatgcttattcttataggtaaattactcttgatttaaatatgtacattttgtttgaattatgctgggtctccaggaacacaatccttatataaaatgagatagccctggactattttcacttctctattttatagaggaggaaaccaagctagagagagaagaaacaagtaacttgcctaaagtctcagggataataagcagcagagcaaggacatagtcctaggtgggatcccagagacacgtatgagctcacctgggtcacgacagtaactgcccagcaaccctactgccagtctcggtgtccaccagcccacaatgagtcttatgatcataccatgcctctatccaactacttaaatgactccccacttcatatacccacactggagagtggattggatatggaaaacaccatttagcacaaagttatttaaagacatgcatgttaaagaaagcggattctaccaaataggataatacctttttttttttttttttgagatggagtcttgctctgtcaccacgctggagtgcagtggcacaatctcgtctccctgcatctctgcctcgcaggttcaagtgattctcctgcctcagcctcctgagtagctgggattacaggtgtgtgctacaacgcctggctaatttttgtatttttagtagagatgaggtttcaccatgttggtcaggatggtctcgatctcctgacctcatgatcgaccccctcggcctcccaaagtgctgggattacaggcatgagccaccgcgcccagccgataataccattttaatagttaccaaggagtcagtgtagatgactacctatctgttaaaggctttataatagcaattaacatctttaaaagatgtaggtcaggaggtagcaataacagctgtcgtttttgtcttaaactcttcaaaatgggaggggaagggagactgatctctaagtaaataaaaatagttatccatattcagtatctagagtctagcagagactatgctaagtatttcacatacgtcagcatatttgagcatataactctgcgaagtcaatagcattatcccagtatatagatgaggacattgaggctccaagatgtcaagcaattaaccaagaccacccaatggcaagcggctgaattggtttgccagggttgccttaacaaagtaccatagactgggcagcttcaacaacagaaatgtatttctcacagtcccagaggctggaagtctggggtcaagttgtgggcagggttggtttcttcagaggcctctctccttgacttatagatggccatcttctccctctgccttcacgtggtcttttctctgtgtgtctgtgtcctttttttaaggatacctgtcattctggattagagcctactccaatgacttcggtttaaataactaacctctttaaagaccctatctccaaacacagtcacattattctgaggtactaggggttaagacttcaatgtatgaattggatagggacacaactcagcccacagcactgggtgagccaggattctgacacaactctgtgatgttggaagctaccccatgttgtgttggaattcagaatgattctttaactcctttggcctgttgcaatgagatttagaaaataaccacgaaattggcaacttctgtttacaatcactatagttcttttaacaatagtgaacaacaacaacaacaacaaaaaatgcaaggcaaggcccaaagcaaagcaattgatttgtctctaccacaggcaaatgtaagatgctgagcctttatatagctgtcttgcttaattttttcccaaaaggttccacaaatagagaaagacccaaaggcttctgcaaacctgtggctgagatttagctgcacattcttgcctggggctactatccacctccatctcctgcctgaggaccctctggcgggattaccagcccagagccagggaggtggcacatccactaattgggcagggccgtgttgggtgtctttgtgtcatcccatgaataatatcacagctacacccctttacagtccttaatgttattttctttttttgtttgtttttattttgagacggagtctcactctgtcacccaggctggagtgcagtggcgtgatcttggtccactgcaacctctgcctcctgggttcaagcgattctcccgcctcagcctcccaagtagctgggattacaggtgtatgccacttcacctggctaattttttgtatttttagtagagacggggtttcaccatgttggctaggctggtctcaaactcctgacctcaagtgatcctcccacctcagcctcccaaagtgctgggattacagatcttaatgttattttcttagactgactcatcttcatatcaccctcacaacttctaccatatctgcattcaccctgtaattttacctactatgttttaaatcatcttatgttttgtttacatcgatctttaaagggaaggtttatataattatcttaaatggaaaatctatatcatttgtcacagatagaaagtaaccataaaaaggtacacacaaaaaaacaattattattaaattctagctagttacagctgtttgccacctctttctctgcttttaaaaaaggggattgggacatgtaaatgaagtgtttgagatatagtagtcctgaagtgagactttcttataaattaatcagaagctgaaacaaacttgaagagagaataacttcttcactctgtgattagtattccctaatgctgcgactttgtcctcctgaaaaccaattccacccacatttgggaaaggctgctttctacttttcaaagcactttaacaacaaccctctaatataaccagagcagacattttacacttgtcctctaaatgagaaaattccagcaaattgtaggcattgtgagaaactcctaaactccaagcaagcttctcatttggcgtttagagttagacaactatacttggggtccaggaatgaggggtcggcaggaaatacttactgcttaaagagatgactttctatagttggctcggcccctttgttggtcttcagccaagtgctacacaactggaaaccaaatctaggctcagagacacatgctagacccaagtttccgggactcggtccctgaccagcttgcagaaggtgctgggataacatccgcttctcccagggaaggagggaccgcggctctctttgctcagctgcagcaattgatttgactacaagatttaccaggtccctctcatcctgcctttgttctgcaaatagctgatgcagttctcaaatcaaaggaacctctaagccctggctcttaaagggtggccaccagcagtacctgggagcttgtgagaaatgcacaatctcagcaccccaccccacaccacgacacgccccctgccccacaatagattaactgcacccttgaatccaaatctccaggttaacagtctccaggtgatttgcaatgcacattaaagttcaagaagcactactttaaaaaaattgtgatcaggtggtcatcctggactgcaagccgtggatccttcagctgtgtggtccttatgctcacagttgggagctaccactctaaatgttgcaaccacttggaacaccgttctaatccagggtcccctaattaccagctgtgggaactagggcagatcactcagccctttgcggcctctgtcagtgcatctgtaaaacaaggagagcaaactccttctcccagaagtatctggagtagcccttgagaatgtctatagggcactgcatgcagtgcctggcacacggtgagcggcacaaggtgctcagtcaacaaacatgcattgatgatctataatgcccggactctggggctacagcactgaaaagatggacaaggttggctggaaagaaataaagaatgaagaatttcagtagtgataaggatcctgaagaaaataaatcatgcaagcgagtaacaggaatggcagtaggtaccattggcagagtagtcagagatgctgggtctgaggaaatgacattcaagccaaggcccaaatcagggaaagacgcagccacatggagatctggaggcagaacattctggacagagggtacaccaggcagaggtgcaaaagccctgatctggaacaagcttgccagagaagaggacgagaaagaaaggtcaggatggctggcatataggtattataagacaaggctgccgagataggtggcttcatttctatcacatcataactcaccatcagcgctacagtcatccacatccaccattggctttagtcagaaagccattcatattctccccacgacagacggcagagagatttggagaccaagactgtgcctttgtgtcccagtgtccagcttcatggatgtttacctgcctgagttcctactgaggaaggaggcacttcagacccaacaccaagtgctttggagaaagaagcaagtctctcctctgcagggaagccacgtgctctggctagagggaattgatgtctcccagctggggtggattttctgctgattttacaaataagccagacgtggcaaatcctatgggaagccagcccaaagcagccagcaagatcagatttggagtcttcatcaaagggttaggtggtgctagctatgagccagacctggtggctccaaagttgcccttaaatatatcagccagaattcaaggaagttgtaggcagagggaaaacagctggcttgtctcagaggtttaaacctcgtttgcggtatcacaccatgctatgcattcaaaatcacagtttacaaataactgaggcttgcttctcacttgagcctaacaatcctgggaggcagggtaagtcttaccatccctcttttgcaatgagaattctaatgctgtgagagggcgtaggttgaggtggtaaaaccaagacttcaaagcagactttctggcctttgaccagtggcctttccactggatcagccattgccattagcaacgtacccattttccccacaatcttctcttcaagtacatctttgttaccaccatccctgcctattgtctttcccctcctatgactaccattgctaactttgggtaaacctctccttgctatctacatgtcatccaaaagcataatccacaataatttccctgatcaaaagtcatctgattagcaccttcacccctcctgcaacttcaatgcccctctaccatgtaacccaacaaactcacttcctgggaattaggatgtggatatctttggagggctgttattctgcctaacacatgcagtctgtctctgagcagccatttcttggcaaaaactttacactatgtaagattaacggcatcacttctcaagtcatcactatcatcaccaccttcatagtctccaaacactcagccaggtgtttctagttttgggttacttaacccttaagaatctttatttcattttgtaaactctacatgctcaattctttttttttttttaaacctcctgcattggaaggaaggacttcacagtcccaccccttttccgctccataatgttaagacttagagaaagttaaattccactttgggtggagcccaaacatgaaaggttccattccagaggaaatatttactgagaacctctctgctagaggaagagaagccatttcacagtcttaattagaacaagccttctttgacaatcaacctagacaatgtttatagctacacagtctctgtacagtgtgtcagtatctcacctcctcccaaatggggcgagaggccgtacaaattcattcaactagttgctttactaattacatcacacataccagagctaccaaggctggctgaatctaattacattaaatgcatctacatgaagatttccaatacacccagaaagatgttttcaagatttcaagccttggaataaaggctgtaatgaagtcggaccacattattctgttggtctggggtaatgtaaacacaaggcagggctctgtgtatctgactcttcctgctgtaaactcttggaggggccaaatggaacagaggatgctttccacattggatggatcccttcaggtaattctgtgctgagagtgcaaatatctctcagctgtttggatgccaaggaaaaattcaagactctcacctgccccctttcatttcagaaaactttactgtgcaccgggccttatcaggaactctgggagatgatacagggaaaacaaagatgaatgagacaagctcagggcagtccagtggatgaagaatcccaagcagcctaattattcggtactattttaaaagaatgttctttagctatttgttagatatttatttagtgatggtgggaagtaaatgatttaataatcattgtatgcagcagtaaatttacctactttacctccattggttgaaataaaatgttcaaacaacttatgttcatttctagagctcttgttttcttccctgttttaaattgtggtttgtttttaaatcagaccacttcttggacaggaaacatattaaagagttttgagtttaggcaataaaataattcaataattgccaataaacaacactctaccagcgttatgtggtttcagaattgtgactgactacctgattttacaaataagccagccatgccaaatcctatgggaagcaagcccaaagcagcccgcacgatcagatttggaggcttcatcaaagggttaggtggtgctaggccaccgtcccctgagtggtctcaggagagcgtggccattggttcactgcaaattgcatgagcttgtcacaaaaactctcagcaatgttccttggaccctagaaagaggtgcttttcattccagggtgctatcaactacagcaaaagaaaaactccttcctgctttgcccttcatgtaagggataatatcatgtaaatgagttcattggtacatatacattattacatacatattatttcatttattcaacaaatatttattatgtgcccactatgtaccaggactgttccaactactgagcctatttcaaagaacaaactacataatgtgcctgtttatgtaaagtttacattttaatggagtgtggggaaaaataataaacaactaaacaaatctatggattaattttagataatgataggttctaaggaggaaatcaaataggaagatgtgataaagaataagaacgctgggtattcaagagctcaagacatatgccattttctgaccatgggaaggggagctgatttagatttttatttgtaattgagctgagatctgattgttgagaaagaatggcccaggcaaagacttggggggaaaagtagcccaggcaaaggcaacagcaaatggaaaggcccacataagtttgtggcatcgaggaacagacagaaggctggcagggctgcagtggagcacccaggtaaatcataagggaatgaaagggcagagaagagaggcagattttacaggctatgataagaagattacattttcttctaaatgtaatggaaaaccattaaaaggtttaataaaatgagtgacatgatcttatttgcccttttaagagattctgccagttagtatgtagagaatagattattatgagaaaaagaatgggaattggacgactacttgaaacatatcacaggaatctaagcaaaaaatgagggtggcttacatgatgattacaattgtgcagtggaggtggtgagaaacagttggaatccagatatgttttggaggtggaggctacaggacttgctgtggtgtggtgtaaggtgtgggaaagagtggagtcgagaagaaccccaggtccattagccaagatgaggaaaatggggggtgggaaggcagcaacagatttggaagcacaggaaatcaagagttctgttttagacatgatccatgagatggtgtggtctgaatctgtatatatcaagttggcggctagatgtacttgcttagtggacaggtcaaagcaagagatataaattcggatcactttcttgtagacagtatttaaaagccatgggccaagagagtgtagacagagattaagttcactgatatattagtatccctttttagatcaatgcttctggaagctgcttgactggtccacttcttatcaagctctgaacacagtgcctgctttaaaggagctcacaacctaagaaaagacaggcagatggctagaaaacagtgtattgtgtattatatataatgaaggtatgggctgggcattgtgggaaaacagaggagaggatgactaataccttgagtcatgaggaagacagcatacagaaaatggcattagaaagggtcatgaaggataaggacagttttcccacatagcagaaaggaattaacatgtgcaaaggcatggaagcaggccatattggtgaggttctgtgaaacaaaatatatatatatcatatcccaaaaactagggccatgcttaatgggaagacataataaacattctcattaaagtcagcaacaaaacaaaggacttccatattcactactaccttttaacactagtctagtgatacatgccaacacaattaggaaagacaaggaattcaccaattcagaacttgccaggaggtctagttatcagtatttgcagaccatatgatcacatatttatggggaataataaaaaagtaggaaaaaatattaaaataagtaagaaaacttaaaaagtcagctatatacaaaattagtgccaaaaagaaatcaacagcctcaaatataaaaacaacaatcatttggaaagtagagcagttcccatttccaacagcaacctaaaggataaaataactagaaatctaagaaatgtgatttcaatgaaaacactgacagaacttttttcactaaacagattttaaatcgtatatggtaaatatatagcaatgagaatatttagaaaaattctgaaaaagaaaagtaagaaagacagactggatgtaccagctggtataacataaagctagagtaattaaaacatcatgggcctgatttaaaaaataaaatccagaagcagactccaaaacatatgagaatgtaaaatatgacagaggtggcattttgtatcagtggtgaaaaacacatagttaagcaaatggtgttgagacaactaggtagccatttaggaaaaaaataaagcaggattactaaatttatccatcagaccaaagtaaattcctgatgggtgtaagtcactagaaaaacacggaaaaatattttataatcttagaaatggaaagacctaagtatgagaaaaaaaaaaatcccaggaaccataaagaataaaatgtatacaactctacaaaaattaaaaattgccttcaagaaacacacaaaattaagacagacaatgacaacacacctgggataccatttgtaatacatgtaagaaaggactcattctctaaatatatacagtcaccaaaaatcaattagaaaaaggccaaaaacacaacaggaaaatgggcaaaggacctggatggacatgtctttctctgtggcacacactcccccgacacatacacaatccaaaaggatttaaaacacttaaaatgacatttaaaagaaagcaaataaactacatttcttatattgcaaattatcaaatatcaaatccttgaatggagcactattgggagagtagaaacagctattcacttgaattgttgctaggcttataaattgattcagtgcagagcaactgaatactcatataaaaatgtatagcacatgtatttttttttttttttttttttttttgagatggagtctttctctgttcaccaagctggagtacagtgaagcgatctcggctcactgcaagctccgcctcccgggttcacgccattctcctgcttcagcctctggagtagctgggactacaggcgcctgccacccattcccagctaattttttatatttttagtagagacggggtttcaccgtgttaaccaggatgatctcaatctcccgacctcgtgatccacccgcctgggccttccaaagtgctgggatcacaggtgtgagccaccgcgcccagccctagcacatgcactcttttaccctgatattctactttggagaatttattctatagatatgttggcacatgtgcataaagttgtagccacagagatattcctgcagctttgcttatattagcaaaagagtggaagtaacctcagttatcatcaataaggtggtagtttcacagataatgacatttccttacaatatttcagcagaagccattcaaagatttgctctctgtgctaaccaccaccaagacacagtgttacaatttttataataatgtgaaaagtcatctatcacttccagaaaaacaaaaggatacacacatttatgcttgtatatgtaagaaaccagcaacagtggttgcctttaggggaggaaggatgtggttgaaacacagagatgggaaggagacttacatatacctgaaccatgttcctgcatcacctgttaaaaaccaactacgtagcagaaagttgaagatcatagtcattttacattgtggcttgagattaggacgtgtgttaatggggaagatgcgggggcagagatgacagtgaataacaaaatcaatcttgtggaattatgagcattagaaaaatgttctgaacacttagcaactggcctgttgtaggtgtccagtaaatgttagctattattacccacagattacataacacgaacacacatcatttagtgaagtgggaggtttgatttgcaggtttaactagggtagagtgaattctcccattactctttctgttgcacacccagatggtaagttctggtgaaggccacctgtgagtccctgcaggccctgactgtgaggtgagagccaggggctggcctagagccacaattcctaccccagcctcagcccagaaggcatccaacccagaacacaccttttttcttggggaatgaaccctacaataacctctgcccttcatattttaaaatctccctttccataggggtgggctcccagcaaccatcctggtcctgtgtgctccctccaccaccataaacacaattgattggattaggtgcggacacctgactcaagctgatccaatcagattttcttctttgggcaatttggaacttgaacttgaaccaagtcagcctctatgcggctggaaatatgagacataaatatgggagatgtgaatcagagcagcagcagaaaactccagtcctctaaaagaaaaaagagaagaatgagtcacagaaggcttccagtttctggctctaatcccctccacaggcacagttacattagtgcctttatattttgtaagatgtttctgggttcttagaatttatgccctttttctttttttttttttttcgtttctttaagccaagttgactggtttctaggttgtcagttttttgttttgttttgttttgcaattaaaacatcaaaacctatacagacactgaaaacatggtaaatctcaacctcctattgattgtaacagaagaataaaggtgaggccaaagcaaccgctatcaagcttgagatcagcttccatacctctccccaaagcaaagccatgtgcaggggagaggatgtctattacatgtgggtgaccagagtacttagggcagcacaaagtggtagtggagaggaggggagggagagctggatgtaagaggctcccccagataatctgccatggctgttgcattcgtttctgccttcatccattcggtgttgccataacagaattcctgagactgggtaatttatacaagaaagaggtttatttagttcacagttctgttagcgggaaagtccgacagcatggcactgacatctgctgagctctggcgagggccatgggctgcttcactttcagtggaaaagcagaaaggccagtggtcacacacaaagaggcaggcaagaggggctgggctcacctataacaatcgctctctctggaactattccctgcatagtgagagaggtgatagcagcgttactccaggacccaaacgcctccctctaggcctctcctcccaacgctgccatcaggggaatcaaatgtcaacatgaattttggtgggggcaacccacgtcgaaaccatggcagttttctcggactgacataacaaaatgccacaaggtagatggcttaaaatattaataatagaaatgtattgtctcacagttttagaggcaagaagtctgaaatcagtgccacacgggacatgctctctgaaacccaaaggggaggatccttccttgcctctacctggctcctggtggtggccatcaattcttggcattccttggcttgcagctgcattgtgacaacttttgtctgtgtcatcaaatggggatctccctgtgtgtctctgtcttcccatgggtgctctcctgtgtctaaatttcccttttcttctaaggattccgtcattggattagggcccaccttaatgaccttatcttaacttgattacatctgcaaagatctaactcccaaaaaggtcacactcacaggcaccaggtgttaggacttcagtattttttggaggacacaactcaactcacagcagtggtcacagggaagaggaactactgctactcactgtgacgcttatcattcatccaggaaaacagaaatcatgctgagagtttaaagcagaggggatttggtgcagagaagaggtaacaggtgatagggaggctgagaagccaaagaggaggcagcatacaacccagagattagcaagagcagaaagctgctgccatgcctcaactgcacagacaaattgaatgtcagggttaggcaagacttggggcctgggtcacctactaagtggaaatgaggaccatggcagctctgtcaggaggaaattggagccaggcaggaggagagaaagaggatagaaatacctgggcttctttcatcctcccaccctccaatctcctgccaaggcctcaacaggccagagatctggctgacaccggagattgcagggatggcctcctgacacacagagagagcaaggattgggagagaatagagctgagggcaagcagcccaggcctggcctaatatccactgtgcatgagtctttaaagtctcacaacttaggatgtgagaattactgttctaatcttacagagatgccgagactgtgagagtgtcagtagctcactccagagcgccagctccgagatccattccaacttgggtctgcacatgtggtggctctaggggctgtggctccttcccctccacgtttgtaggttccattctgattccttcttgcctctatctgtgctgtccctaaatacacaggccccatacaaacaaaccacatgagggaaagccctcctgtaagggacccagtggacaaggacagactcaacaaccactgggtcaccatcgatatttcctctcttgccctttgggcttttgctcagatctcaggccatacctgctccctctctgactgcccctctccctctgtgacctggccctgtaaacatcctaaccctgcttccctggtgaacttctttttcatcctcgagaccttatcctagtcaacacgttttccaggaggccttctctggcccctcagaccagcccaccatgtgccccttggctgcaggcaattcctctttcattatcctcatgcgctttgtgatttggggcctggtgggacagtctgctgaaccattcattcatgggtgttctgtggttccatttcttcatttctaccaggtgcctggctttgcattcctttgctgcagggatttttccagagagaaagtggaagctgaaggaagacattgttcttcatgtaaaacacccagtcctttgcaggcaaagcaaagggtgagagcccttccttcgatgacaggaagagaggagagaaattctcaaggtggatgacggtagacagatgctgagcttagcagagaccagactgaaatgtaaccaagtgttagtggaatacttttcccctgaatacatttactaaaaattcagccttttaaacaattttttgttttgagttggtgtcttcctctgtcacccagactggaatacagggacacaatcatggctcactacagcctcaaactcctggcctccagagatcctcccaccttggcctcccaacatgctgggctttttaacaattttaagtcatatgttgacatggctgctgttaagaatatgacagatgatagaggaaagaaattggacaattaagtgcccagtctcctattagaagttggacaagagtacctactcccctatcatccaagggtggctcaggccctattctgcagaccaccccctcccctccctggttagagcctgcctgtgtctccgacagaagtgtgcctagggagctgtgaatattcctcagagagatggccaaggcgtgcacctgaggacgccagggccttgtcatggactttccagctcaggtggacattcatatacccacaggtcacactgacacagcagaacacactgagctgcctcacatcttggcctgcttgcccatctggagactgaggtaaaatagagatgttggcagcagctatgatggaccagaaaccagaggcccttcctgtgttttcagaatcctcgtgaaggccctgggcttctggtgcaaaactaggagttggaatttcctgctgccctggcaggatgagagcttagagtcagctttgacttaaagaaaacaaacaaaagtgtgtatttttgcacatgaattgttgactgaggttcatgcccacacgatttgtttaacgtgtgacttttccaagtccctgacagccaagactgcctgaactcacggcccaacgccccaacgcatagtaagtgctcggtcaatatttcctgagtcgagtgaatgggtagttttggaagtcaaatcttggaagagcatttctctgtttcctccgggcagaccctgcaggcatcagctccaggaggcattcgtcctgacggtcccctaaaccctgctgacacatgagcagacactgcacaactgcactggcggtttctgtccagacaggcactccctctgtggtgagaaatacctctgaagttgcctagcatcttggggctccttgcccatctttagaattttcaagtgccccaagctattgtgaatgtgttcaatgtttatattccaagcagcttgaatctatgccttgcaaaaatgcaagttggaaagttaattcattcctttatgtcaaggtaattgcagtttcaccctaatcctctcttgtcaaagacatttctacaatgcagggagttatcttttacaagagacacttcaaggtgatttaataacaacacttgctatgagtcacattttccctgtagtcatctactcttcagcttgggagagcagggcttcaagtacagaagagagaaggcatttggctagtcacataacccacttacacacgctcagccaaatgtacaccttcaagagaaaaagaaagccctaatgagcacttgtggtaactaaggtgctaaacgagatctttccaagcaatgctatttttgtttgtttgctttagggcaagctatattcactcagtgctttgaaacttaagacacgtatgaatttcatgactgcggacaaagaggaaatttgatatggagattaattattaattcaacatttactgagcccctactatgagctgtgctaggggcttggctacaacagcacacaggcttgcctgccagctgccctcaccaagctagtggtccagcaggactgcagatgtcaaacaaataacaaaggccaaagatgtctctttctctctctgtctgtgtctcttttaaatgcaaaactataaatttattttatatactcctttttacttcatctgcatgataaaaggaatacagatgtattttttaatgtaaccaaattcccatctcactgcgcagtaggaaaaagtctacccactcctcacagtttctagttctcccctcacagtggagctcatcaaaaggcagaggacattggctgggacgtgaccaggtttcaggcaatttgggagtgaaaggccagcaggcagctttatcttgaagactgttcagctccacagggtgacagattctcccaccaaccatgtctctgtcagcctcagcccaagagaaaattgagctgaataagagaggtctcagtggaaattatattggaaagactcaccataatggcttcctgaaaaaaatacataaacaaaacacatttttccatccaaattaaacaagtaggtcaagagggcaactttgccaagtgccacttactcccacctccagctggaattttctgggcatgccagcactggtgttacttgccgtaggcagattctctacccatacttacaaaaatccacaccagctacttctgatggagttcttagcgtgcctctttcaactggatttctaaacaaggaacaatgtaattggcaggtaataacaggctaacaggattgtcttaacagatactggtgccttttcagttcagactttcaccagccaagaggttctatacaaaagatccacacatcagagccatgtgatgagaggccaaaacactggagagctgtaaccctgaatgaaggagtcaggtttacatattgattcaaaaaaaaattgctactcttatccctgtgtgacatcatgctttgaatatgatcattgaagatgttacttggagtgcagctaccttgaaccctcggtgaaatgaaatgggatagaaaggagtaagattgttgggggctttaactaccgttccacacttttgaaagttagaaaaacaaagagcaacagcagctgcctctgtgttggtaatcatattttccaccagcaactggctcccattggttggagccaatcctttgctgtaacagaggatctaagctgccaagagaaggtcctcatgttcagatagagcaatagagcggagcatttgaaatgaggagcttcacaccagtcccctgtaggtctgagtgcctgaggctccctgcaatgcgtgcacacagtcattatgctgctccacagaaagagatgggagctggatgagtccttccctgatgacttgtatgagctaatgatcctaccggaaatagaaaaaaaaaagaaaagaaaaaacactagtcatgtgatttcaagacagtgacaaaagcttaagctgaggttgccacaaaaggttgtgggaaggggtgtggtctataggcatgggtgcagccagggctgagaacgactagttagctgaaaacagctgcttttcttcaccaaaatatatgggtgaataatgcaccctgttttccagggggataatgcaaacaagtgctctgtcaaggtaatttttgtattccacagggatggcggggccatgtggggaaccacagctgtggagtggggatgtagtattgcttagagccaggtgtgtgggtcccaaagcagatgtcagtgcttaaaattagtaggaatgggagagccatgcctagatctttgctctgagatacagtcgtagtacccaaaaaagaagttccggtagtgggaaatgtagatttagagctgggctgtttgacgggaaggcagggaatggcttatgcaccagcagaaagccagtttccaccttgcatatccagtgaggttgccacagggccatgaccttcattcctggggtgccctgccctcagctcattgggtgtctgtgtggctagagtttggttctgtgtgaggagcaacttggaggggggaatggactttagctcaattcaaccaacatgactgtatattcactcggcatcaggtactgggatttcaaaaaactggacattgatgtagcacactgataatggagccaaaatctaaaccactctggaaaatccagggtgaccactgtacttaagtgccacaaatagctattttgcataatcaaagctttgggcttgaaggctttgttcatgcttttgctgctcactcatgacctttctcaggaattagtgctgccatatgttggagatttacctgtattagattttcacatgcatgagactcgatccttggcttcaactcagcaaatgtctatctctctagggcttcctatccaaatctttccagtctttcaaatgcctgtctgggagaagaagaattttggactttcaaaacaaaagctaagaaaggcctagtgagccccagtggtatgaacccatcctgtgctcattcgcattctactcagactttctgccatagcaatctgtttgttgtaacccaaccacacttctagcaaaaggtaacatttggggaccctgctctaacaaatttagagtaacccaattccatgttttctgcactgagcaacatgtacaactatcaccttgaaaattatgctggatctcagttactgagtcacatctgtccgagattagtagccccgagggctgggatgcttagtgctagtttcatattagaatcatctgagaagcttgaaaaagtgttggtacctggcaccccaccaccaaagattctaatttaattgttcttggttgggacaatgttttcttttaatctttgctaggcttcataatattactgctaatcagttttagagagtgagtgcttataaccaaactcccagcctggtttactacagcccctgtatttcctccttgatgccatttagcaatgacccatggacttttgatgactggacatctttagttctctggatggaaatctgaagatgaaggagaccttctgtgccaaatagaagcctgagatttttagtgaaactaacatacgtcatctggtcttcgtgaaacgattctgaggtttctaagaatttcccacaacactgaagattggtggcttagagtttattgacccccaaagaaaagggtatgtttgactgtgagatacagttgtccttgccattttcaagatattacccactgtctttgtattgaattaccttaaaagtattgactcatagaagcaacccacatggttaaacccaactttaatccaaaagtcttggtcatcaacaaggttttctccaactatagaaaaatgtgctccccaaatttgccacattctcattctctccatgtaacaaaaaagaaacaaactcttcattgtctggcccacttggatctttttatctcaaataattttttaaaaaatgcttatgttggcttggcttggtgactcatgcctgtaatcccagcactttgggagcccaaggcaggaggatcatttgagtccaggagtttgagaccatcccggggaacatggcaaaacattgtctctaaaaaaaaaaaaaaagccaggaatggtgatgcatagctacagtatcacctgagcctgggaagttgaggctgcagtgaaccaaatcgcaccactgtactctagcctgagtgatagagtgagaccatgtctcaaaaaaacaaacacacaacaacaaaaaatccaaaaaccagcttattttgagggttgggggaaataaatgacgaaggctagattcattttggactcaattctagctcctcagggaactttgaatgtatgccattcttgatatttatatttaatcccgactaggaaagagggaagtccaagattgctggatttttgtctctccatgccatttaggaatatctcaagactctttccactggagttgaaaaacaccaggtcctagttctgagttacttctgatactgaggtgttcctcctaggttttcagtacattttgtttacatctctacgtgtttcattgtcttatttttgttagctgggtttgtttcctgtctgcctcccatgaggtccttcagggctgaggctgaatcttttctcctaaatgcatccaatctgaacccaaagtcggtactcaaatgtgtgacaataaatgaagacacaaatgaatgatgtatcaactccccccaaagctagctgcaaggagcctagctgtaggacaagagggaaaggccgtggccacaagggagtaaccatgcgcggagcctggactacagagatttattgctaaggctcatgcttttgcctccatttgcccaccgttgttttgtcagtcaatgtctgtagttgttgaataacattcatttatacattatttagtaggtgtaatcaaagtccccatgatcacggccctgcttttaaaacttgcctcttatctgtaaacacatttcctgagctgctctatcttttcatcttgtctaggtgatctatagcaatatcccagaacctgcctattttctttttaattccctgatggattataaatagcctcttctaaacctccccaaagctttgacggcaaattcctgctttctaaattactatccacctcttgctccgcactcagaccccttcaggaggctgtcctccttccccagggcagacacaaaagccttctacacttccctggcgtcatgctaaaggaacactatggcaacgaccaatgtttggaacgattgcagccgaacacacacatcgctcactgcttcaaatgcttaatagcggtgattaaagaagagaaatctggcataaaagaatggcgggagaagaaagcaaatgagagagaacaatgagtgacaggagaaaaggaaggagtgaggagagacctgagggaaacctgggagaacagaaatgaagacaagaagggaaaagggaacaatggggaccagagtgcaccccggcctgctttctttgaccttaggccctgcacatttgctaaaacacccaagtctgtcaaaccaccactgaagcaaatgctgttagaagaggcaacgtggctggaaagaactcggtgctctgtgatgccccatggatcctttctattctgcagataagagagagaaaaagccccattgcctaacttcctggattgcagagaaactgctgggcacatggtggatccggggacccaccgttctcaagaacttgctgtaatgggcaccttggatgtacacttacgaaggattgtgtttccaagacacttcctcctccactcaaaatttgctcatacttgcaaacaggaatcatcttctacccaaacccccatgaccatctctcaggccagagttgagcagccaggttgcccttctctgagcttgactctttctgtgtattaattttcaatttcaagtcacaacgtaatccattaagaagcacttattctcagcaaacctcttgagcaggctctcatttgctatttctcagtataaactcattcctaccttccggttcagtgttgacactaaatttggcacagtggctcagcacccaccttcatccctgcatcaatctccagttggttttctcatgcctccacaccatcaaaatcagcctcggcttttctgaatctccatggggcttagcagatggggtggcacttcataaatccagtctatgcaaagctgttagcaaaaatgcacagagggcagcctctcggccttctgtgggtatgctctgagctgctccaaaggtatccttaaacatggtatcattttgagcctctaaactctaaatagctaagccttctctacaatttatgccccttggcatccctgaaagtgggtaaaccgcactggttttgagtgaacatcctttaaaaaaaactcaatttcttaggatccaagtctatatgattgaaggacacagaaatgtacaaacgtgttcccaaaggcttgatgctgtgtaattgtaggcccctcttccctggagttaatctttattgtgagtttaccatgttccaggcattgtgctgattttcaggcattatctcatttgatccacccccaaactccagaatgatctttaaaacagaaatcagatgatgatgcttctcagcacagaactctccagtggctgtctcacttggaggaaaagtaaagtcctactgtgggctgtcatgaggcccctgtgagctctctgatggtgttttctagagaatcacctttcagttctgcactctagctggtcttgcggttgccctcatttgtcaactaactcccctctctcccctatgcttgtcttttttactctcaaatgtcatcttctcagggagaagatggctgcccagtgtacattgtacctcatctcctccccacatcccattcgttgctcacattctcttcatttcacccccactgtcaacctgctacatatttgtttactgtctccaccaactagaaagtagctggagaaggacaggacttctgttcactttgaatccccaggacctacaagaatggtgttttcaataaaacattttttagtaaataaatgcattaaagtattcttcttatctccattttacagttgagaaacaggtttagggaggttaattaactaaggtcttagagccagtaagtacaactagtactatgggctcaccaaccgctattcccaagttcaaaatgtcttttttcgcaagttcaaaatgtctttttgggaaatatttttgccatgctcattcaattgggggtgatttgaccaaagtgggaagctgagatggaacaagatgaacaagaaatcaccgggaggctgggtctggaatctgctatgcacactcacactcctccagactcacttatcttgtagggtctcctcacgtcactcttgacatcgaccaaattcaatcctttattaaatatacaccatagcattaaagtgcaggacagataagatcatataaattttttgacattttgaggaacaatgtgacactgctattaatatttgtaagtatcttggaaccatttactagatgcaatgtttgtgtgagggaaaagattatataaaatgagacacatcaacctcaaatacactagtctgtaaactcctagagggtagctactgtgctatattctccctgattagcaccaagaatgatctattgtaggcattcgataaatgttattgaatggataaatatctttggaaatgaaattttagttttgtctgcaagagcagatttggatagtggcatcttttccaggccaggcaatgacacacagttgtatgaaaacaatgccagggcagggtcagttacatttgaaagaaagtcataatcccagtggaaagttttacagatgaaatatatagttgcatggaatatcctgttataagagagaaacctggacagaatctgccacctcagtgctgggagggaatatatgttgttgaaatgtggcctccaaacagccagtcaggaggtgggttgctctccagccattaaaaacatcccagaggccaggcacggtggctcatacccataatcctaacactttgggaggccgagttgggcagatcacttgaggtcaggagttcgagaccaagcctggccaacatggtgaaatcctgtatctacaaccccgtctgcactaaaaatacaaaacttagctaggcgtggtggtgggtgcctatagtcccaactactcaggagactgaggcaggagaattgcttgaaccagggaggcggaggttgtagtgagctgagatcacaccattgcactccagcctggtcaaaagaacaagaccctgtctcaaacaaaaacaaaaacaaacaaacaaaaaaaacccaaaaccaaaaacaaaaccatccctgagggaaagacaaatggccatgatttacaaccagaaagttgaattggtgaagccataaacaagcagtctaaaaaaatcccagctgagactttttctctatataatctcttcttcctgccccatcaggcctcagagctctgccatatttcccttcaggggaggagaaggaagccccactgaggaacaaaatttccacaagtacccctgcttccttgggtttgtccaagtgcctgggatatcaggaagtgccttcaggtatccagcacttttggttcaagaaacaatataattccttatccaaccaccaaactcctaaagggaggaaggccagccttcaaagtggacagccatccagatgacattctagattcctcctactgacctggcaacacagggaacctctacttgagtgagcgcaggacatcgtgactagcttccaataaatacaatatggcaaaagtgatgggatattatttccatgattaggttataaaagactattacttccatctttctagcagacttttttttttatttttgagacagagtctttctctgtcaccaggctggaatgcagtggcgcgatctcggctcactgcaacctctgcctcccaggttcaagtgattctcctgcctcagcctcctgagtagctggggctataggcgcgtgccaccacatccacccaatttttatatttttagtagaaacggggtttcaccatgttggccagggtggtctcgatttcttgacctcgtgatccgcccacctcggcctcccaaactactgggattacaggcgtgagccaccacgcctggccagcagactctcttactggctttaataaagcaatctggcagtttgggaagcccaggtggcaagaaactgagcgtgtccttcagccaactgccagcaaggaactggggccctcagtccaacagcccatgataaaactgaattctgccaacaatcactaagcgaacttggaaacaccatgccccagttgaaccagtaacttggtttcatccataggaaaggccctgagctgcaagatctagccaagccatatctagattacacagaaactgtgacataataaatatgtattgttttaagctgctgacttttgagggcaatttgttacacagcaatagataatccaatataataaaaatgtaatgaaaactcagtgagatacacatgcaaagattcttgttaaaagtgtgaagcttgggatcataggatacttacagtagatactctctggaggagaagtatggggtcctacttcacaatgcaaagctgttcatgctattccaacctccacccccactatagctgcccatttatccactaaatcaagcacgagttccttagtctagcaacaaggtctgacatcatgtggtctctgcctatttctccaattttatctcctgctttcctaccacttgcactccgcctttaagtcataccaaactacatgtagttgccccaaatgctgtatacttttctctttttccctactgttccctctgcctagaatgccttcctgtacaggttcagttacaagcatctttggtgctctgtagaactccattcaaatccttacactgtcctctcaactctcttataccacatgtccacctgtcttataacctttggtttctttgtctaatacctctctagctgtaagctctgtattgagcctcttcttcaacctgggatcctcagagctagtttgcagtctggcaaatcacttcagtcaacaactaacgaaagaataactgtgggatggacgtgccagaaggagaaacaattatttattggcttaactgtaatttataccatgctattgaaataataggcagtgtaaaggacctacattcaggaaggttagtagcatacaaaattaaaagccacatagaaggatgaaaaagcaaatctgccaaacagtaggcatgtttgtcacaatgaaggattacatttcatcctaagtttgccatcagacaagcaagaaaattccaaggaattatgaatttgcctacaccttccaattgggttcatcctcaaaattcctccattaagacaaaagaaaggcttccacatggtttgtgaaaattattcaggtttccatgctatatatcagttctactcaccttcctggtgtaccaaatcagttcaaagagaaagaggaggggattttaaaatgaatatcttatttttatgcccttcaggaaatctgccttcctccccatttgttaccaactaaaattgacaaactgacccagagttaaatcaacttagggatcactcaaggagtgaaaccaaccaccttttcataaagaaatgctcagagaagaaggtagcaattacactttatcagagaaaatgtctttcttacaaagtatagccatcaagtggagatgtttgatgatccttttaaaatatctttaaatcagaagtaacttagcatggatgcccttcattttgaagaaagagaaaatatttgatgatttgatgattcatcaaaaatttgtttctatgcaacaggcttattgttatgagggatttcaatgcaaaattaataatcagccttggaaaagaaatgccttgaatcctataaaactgagatgacttaaaaagttctattcctgctcagtcaacttactgaaaaccaccatcatctttgatcaacagaagggaatatatccaaaagctaagctaaaatctctctttctttaggtcataaatcaactctgcaatcaagactacggagagtccgtgccacgcagatggctttgagttttataaattggttaggtgtggggacatgatcaatagtttgatgatttgactaagtaaaatgtgctgaaaaaaaccacctgtagggaggactcagatgactctgcacaaacattcttgaacttgaaaatccaaactgttagtcatattgagactaacaaagttaatatatgccaccaaaggagaaggctatatcatctcagggaaacaatttttgactgtgcttagtatttaggaaataatgcattcattgaaaggtaaaactggcagtaggcttacgatggcaatgggcagtgccagcagtggctgtggcatcctggagcaggaagatttggtgcatttctagtgcagcataggccagagtgacgtttctgacatttgggatgctacagcactgatagaagtggatgataaagctgtggcttcatttaaacaggctctaaagaatgatgacatttgtgaaacctcagataaaccaaaaagcatgcctaatagaaaacctgctaagaagcataaaggccaaaaaaagaatactgtaactttcttgaagtagtggaaagttggggacaaatgtcctgccatttggtcagaagacagctgcatttactctgctaccattgcttcagttgatatgaagagagaaagctgtgttgtgatttacactggatatggaaatagagaggagcaaatctgtctgatctactttcttcaacctctgtagctaataatataggacagaatgctcaaaagaatgaaaatgaaagtcaagattcaatggatgaaagtgagaactccaggtcctggaaacaaaccatttagcatcaggtcagaagctactccatggaattctgagaccacgaaagccaggtcaggtctcaaattcagtagcccaccacccacaccaccctgcttcccctcatgcttgctgcctccatttccttctggaccaccaaaaattcccccaccacctcccacaggtctagattttcttgatgatgttaatgttttatgaagtatgctaatctcttggtacattaagtggctatcatactggctattatacagggctcaagcaaaattaaaaagagggagagtgctcacgttccaattaatgagtaaatatgccattattataaaagtgaatcttacttttgtaaaattttatggtttgtggaaagcaaatgtcttggaatatttttaaatttaaaatgttaaaaagttgaaaggttaatgtaaaacagtattaaagacattctgataccaaaactattagataaaaggttgagctacatccctactagaattctcatggtatcaaagtatcacctcaccaaaaacttactggttggttgtgtggaaaaaatatacttttacaataaagagttccgtaggctctgatgacattttacatcactagtagtcagaaaaaacagacatgttttctgacctgtgatgcggtatgacctacgcatactgcactggtacactctatgacctgtgaagtgctctggtcaaaaaactttaactgaaatttaatcaggcctttagatctaatttcctgtttgcaggagatgctagggatagagcaacaagttaaatgacaccactaaagaaacgatcagacagatccagaatatagaatgttatagaagataactggcctcattgcttcaaaatatcagtgttgccaaaaataaaaataaaaaaaggtggaacgggtaactcttccagattaaaagctacttaagagacatcataacctaatgcaatgtggaatctttgattaaacctaagggggctgagaaaatttgaatatggactagattttgaatactagaccattattgctaattttatgagctgtgagaaggatgttgtagtttataaaagaatgccttcatttgcatactgatttaagaatgaggtgttatagtgtcccttaaaatgttttaaaatggttttgcaaaatgcgcatgaagcatatatggcaaaatgttaatgaatctaactggtgtgtatatgggtgttcaatgtgctattttttcctattttctgtatgtttaaaagtatatatatatttttaaattaaaaaggcaacactgaaacaagaataaacagttttcttcttacgctagaattgctacaaatttgattatgtaaaagaaactttaaaaagttatacttggtgtgggtttgctgaatcaggacagaccaaagctttcagtgccaatagttgtctccctcagagaaaattcgattggtgcattcttctggtttactgttgtccagattgagttttatttgatttgactttttcttatctacagtgctttagaggacttcttcatctttttttattgataacttaccagacaacctaacaggcaactatatctactatccaggcagccatcaacacacagaaaggctgaggagaatcaatcagggaccaaaacattccatgccaccagcatataaccttgcccttcatacactcccaacccagcctcaggaatactggccacaagggaaaatcagccaaatgctggagctgagaatgcgggttagtttgctctaagtaagtaaaggcacagctttaagttctttgtagcactccactacacaatgtttcctacaactctctgataagaattacctgaagcatgtgtgttaagcctgcagctttctagggacagcccccagagtctgggtcagaaagcctggaatggagacagccctcagaaatctacatttgtgacaaggaaaacagaatcctgatagctaaaagtgccaaaagattgttgctaggatggcagcccccaaacatagctgcacgctagaatcaccaaaggaacgttcacaattcagtaggacttactgaataaggatccctggcagtgggaaccaggactttattttttacactcccaccttgactgcatattagaataatctggggagcatttgaagatgccagtatccaaggcctcatgcaaaacgactgactcagaacctctcaaagaggagtagtttgtaaaagctccttaggtgatgaaaccagaccacagctcagcatatggaaaacactgaattgagtgctttaagatgaagctgggattatcagcttttaatctttattctccaagccagagcagcaaaaaggaactatacatcgactttgggacccacttagctgggctggtgctccaggctgctcgctgtgcatagctttaagttgaaccattgattcaggtctctctaaaaagcctatgaaattcagatcaaattaaaaagtgtcccatctgtaatgggaataaggaggctgggagcccagaaatggtgttcagtctgtctgccagttaaggatttccatatagcttcaaagaagttctaaccacatgatgacattgttgctcaggagtgaagagattctactaccagcaaaatggaaaggaaatactctggacacagcagctatattttcacagggtcctcaggatagtggtcggcacatggtaggcactcagtaaatatctcacgaatgattcccattaccatggctaaaacatgagtcttttaagatgtcttactgtggatctgtctccaacttcggaagaaattgccaccacagtcatcatcatgaattatgttactatgaataactggaactagcagcaaattgctttaattttaatgtgggccaaataagttctgcttagatatttaaatagactttacttaaacattctgaaggatggagatttcaaagctggcacctccctacctgtgaggcataataatggttccccaaagatgactactttctactccctagaacctgtgaatatgttacagtacctggtaaatgagcaaagttaaggattttgagctagggaaatgttcctagattatctgtgtggtcccaagataattcaagtttcattagaagatgaaagaaagactgcatggtggctcatggcctgcaatcccaacactttggaaggccaaggcaggagaatggcttgaggccagaagttcaagaccagcttgggcaacatggcaagaccctatatctacaaaaaataaattagcggggtgtggtggtgcatgcttatagtcccagctactaggaaggctgaggtgggaggatcgcttgaacccaggaagtcgagactacagtgagctgtgatcacgccactgcattctagcctgggtgacagagcgagaccctgcctcaggggaaaaaaaaatgatggaagacagacacagttcagacagagagagtggaagaagctatgcttctagctttgaagatagaggaagggccatgagccaaggaatgcaggtggcctctagaagatgaaaaaggtagagaaatggattctcccccagaaaagacactggaagaaatgcagccttgttgacagtttgattttaacccagtgaaactcactttacacttctgacccctgaagttgtaagaaaataaatctgtgttattttaagccacaaagtttatggcaatttgttacaacaataggaaactaacacatcacacaatatttaagagaaaaaaataatttggagaataatagtgactacattagcatttctttgcatttcaacatagcaaagggctacatttgtatcctctataagatgatgtggctagccacatccctttcaaaactgtgatatggcttttaagagtataatggtgaaataaaggttactgagatgcttgctataaataaaatcacagactatacaataaaatgaccatttctatgtggtatatgtgccttaagaaaaagtgacatcattctaaggtcttgtacatggtaaataaatgagtagaacgtctggctaaccaagatcacaacttgggcttactccggtgaatgcccaacactctctagagaatggcttcccacgcaaataccactcaccaaaggtgtaaggcactgctgcataaagatgacagtgatgctcatactgcatacccacccttctccagaaggcactatacaaccatgtttgaaagggcgtgctctcacactgtccttcctatgatccagggcactattcatgacatgtttgtgtaggctcaggaagtgtgtagtcatgcaagggggcaaaccagtgggttgaaaaggggcttgaacctatgacctcagcttcaccagtgttacctctagcaattgagctcatcaggtggaaatgggttcaactctatcagtcctatgtggcccagctctgaggcaagagacctggctccctttcattccaatgggctgaaaacagctttgaaggagcagcagtcagttacatagctgatgactgccctgcaagaatgtgcacctgaggaagggcaatgatcacaataggctgaagacactcggggctgaatggcaaacagcaccagtgtaatcctacatattggcaaaattctccaccaactagagaatagagaattgtttcatcagactccaacagcatcatgactaccatttattaagcactttactgtggaccaggcacagtgtgctaagtgtgctacaaacatctaattttaacaatcaccttaaacagaggtccattgttcatctcatctcacaaatgagaaaaccaaagtgtgggaaagtatgttgttttaaggttatatggctaggagtgacagacctggcattcaaaaccaaatctttctgcctctaatgttatactacctttaatacagtagcagaataagacacacttttaaggaaagaggcagcagagaattggcatcaaggtagcaacttacttgcaagccaaggaagatatttatttacggccatttatttaatcggttcatcattttttgagcatttggtctacgctaggaattgtgcccatacgacttggaatcaccaaaatatcaaagggtatcaggtagtaggacttggagacacagtgaaaacctacaaagttccagaacatgctctaacagggagaggacctgccagctgagcaattccaccctggacatggcagcggcagccagaatgacttggcaggtgacaatgaagaggtagcatctcaaacaaaggtgtcaagtttgaggaaaacaaacacaacctcaacatgcaacaggctcaggaaatggggccagagaccccaaatatggaatgcgcccttcttccttgcaggactgatgttcaataccggcctattcacctgttcaactgataggctaacacaagggcgggggtgaggaaggaagggctggcttggagaccacatcacctgcaaagcctcttcagcaacactgacaacgccctttaaaccctggatcctgtgggcctacccttaatatgagggagatgctcaattgttaccacaaagcagcagctgtcaaggttcagaacacaatatcccaaaatatggcaccttggcatactgagtattttaaactgaaggaaactgacaaaactcagaagcagaaagagcactctttttgccacatttctcccatgaagattggtcatttaaaaatttttctgtgctgggcgtggtggctcatgcttgtaatcccagcactttgggaggccgaggcaggtggatcacctgaggtcaggagttcaacaccagcctggccaacatggtgaaacctcgtctctactaaaaatacaaaaagttagccgggcgtggtggcagacgcctgtaatcccagctattcaggaggttgaggcaggagaatcacttgaatccgggaggcggaggttgcagtgagccaagatcaggccactgcactccagcctggtcaacaaggcgagagtccttctaaaaaatttctgacttacctcacctgaaaggaggtcaaaaagatcctcattccaaaggagtcctgccctataccctgaggtcagaagaatctgaacaatcaggccttgctaagtgcccccagtttattaccattaggtcataccgcctttatggatacttccgtacgactgtccattcttcatcaaagttaagcataaaaatggagcttcctctgggtctcttggaccttcatttctaatggctcccatgtcacacaaaactttggttgaatctgctctgcttctctcttgttaatctatttttaatgtaggggtgtcagccatgaaccttgcaatgggtgaagaaagatattttttctaccctacacagcccaaccaaaccatatgcatcataagtgcatatgataaaagtgatggaaagagaaatctgaaggtatactttcagttccacatgtcccaaagtgttttcctcgaaactacagtgaccacatgccctgatttgccaaagacagctttgatttattcatgttgtcctgggatgattattaatagtgtcccatttccttctcaaaaatgttccagtttgccagatctagtggtatggacctgtagtcccaactacttctgagaccaaagcgggaggttcacttaagcctaggagttcaagaccatagcatgttattatgtgcctgtgaatagctactgcactacagccctggcaacgtagagaaatcctgtatgtaaaaaaaaaaaaaaaaaaaaaaaaaaaattccagtttggccaaaaagttacatggttagctaatccagaaaaccacttctagagatagtaatagccgtgttgtccttctctgaaactgtgctacccaaactatgttataaaccttgaagaatgaaatacagtttaaaaacgattttgaggctgggcgcggtggctcaggcctgtaatttcagcactttgggaggcagaggcaggcggatcacaaggtcaggagatcaagaccatcctggctaacacggtgaaaccccgtctgtactaaaaatacaacaaaaaattagccaggcgtggtggcgggcacctgtagtcccagctacttgggaggctgaggcaggagaatggcgtgaacacggcaggtggtacttgcagtgagccgagatcgcgccactgcactccagcctgggtgactgagccagactccgtctcataaaaaaacaataaaataaaataaaaactattttgataaagaaacattattttaaatgccaaacagctattattatcttgcataactactattgtgttacatactgtttgggaaatattgcattaaataaagttaaacaagtttgactattggtggaacatgtggctttccaagatttaatattttagtacgtcatgaattgccaagagggtcatatactgggcaatttttccaaacttaaacgcaaaaccatttctcatgaaatgtcaaaagaggttcatgttccacaaaatgctcccacattttcatttgataaatagaggtgtctcgtatgtcttggacttgttctaggtcctggaatcagcagtgaacaaaccaaacttcttgccctcaggtgcttctgttctagtgggggagacagataataaacatggaaacaaataagtattgtaatttggaaaacaatgatttat

SEQ ID NO: 615 - DNA, 76218 bp, Homo sapiens
acctcaaggactttacaatcaatctgggaaggcaaacattgaacatataatgtccagtctgataagtgttagggaaggaaagctcagaatgcaagggaatataatctaatctaggagatcgtgggaaatatcactggggaatttggaactgaaagaaaaataagatttgattaggggaaattgaaggatcagggagtcaggcggagaagaatgtcccggcagatgagacactatgtaccaagcccgagtttgacagagagcgtggtttacagaaggaatctaaaaggtgtagtttctgtagcagaagtgtaagggtgttactcgtaggaggcctctattgaactcttttccagtgacgtagtgtgtggtctttaagtggctttgcaatgatagtaagatcagcattgcattactgaatgagctcctttagtaaacgtggatatgtgctttctgaatctatttgtttgtttttcccaagtcataaacagtgaatcaagcaaatgaaacataatcaagcttggatagtatcttccactaatttccttggtcttaagtaagactgacagtaaactgatggtcaacctgttcaatgggctttaacaagtagtagccacatccaagtcaacaaacagtacaggcaatcagggcccctggcctacagtgaatcatgggaattaccccagggacctatgctttggggactcgtccttcctggcagctatagatgccatcagaaactcatttgcacactcttataaccaagataagggcaatggttagtcccctgtcattgcatgttagctttctttcccttttctaggctttttcagatgcctcttttacattattacttttcctgtgtgaaaataatgcgtgggaaatgggtaggtcatacagagcgataatttcattcctgggcccctgtcttgcagctccctaagtaaagttttgcgcctggcactcctctggcatagtaacctctgacaaacccttgggtaatagaggagtagcaaaacccatgggtaatggaggagtagcaggaatattatgattagctaacaaattcacaaagtacatagaaatttttttctcgaataaccactatagctgaggaatatagattagtgacaaaattgtgcactcaaccaactctattaaaagtatttcattattcccgtgaaaaaactcctaggaaaatgattcactgagagatatacgattgtataagtattgagaaacagtctttcttttttgctttttatttatttatttaatagacattatagttacacataattatgggatacaatttgatggttcgatacatttttatgttgtataataatccaatcaaggtatatttagtgtactcatcacttcatgcatttattattcctttttgatgagaacattcaaaagcctctcttctagctctttcgtaatatcaataccttactgttaatcatagtcactctactgtgcaatagaatgctagaatttattcctcctattgaattgtaactttgtacctgtcgaccagcctctccccatcttcttccccttccttcttgcttccccagtctctggtaaccactgttctattcctttttttgttttttctttttgcagagttcgctctgccgcccagactggagtgcagtgcacaatcttggctcactgctacctccgcctcccaggttcaagtgattctttctattttttgggaatgtgcgttatctaatacttaggtgcctcagatttaatggtggtaaatctcactcattttatgaaaaccaaatgaacactatcctcacaatggttagaaagcaagatcagctcaactttatgaaaatatgactataaaaccatttattattgccaagtggttggagtggagttgacagaaagatgcattattttaaattgtgttttagatgacagaacaggagtcagtaatgttccagtttggaggaattagagttaattggttaattgattgattcgattcagtcaaatttattgaatgactgctgtttcagacactgtatttggtcctgggaaaacacagataaataatatataattgtattataaattaataaaatagttttttccctccaaatgtcagtagtccttggaaaggacatgtaaacaatgaatataaagtgacacatagtccagtcaagataggtaggaaggtctaagtacaattgagtggtcaatttcacttcagggaagggcaatgatcagggaagatttcccagggaaagtgatgcttgggcaaataagtaagcattttacaaagagacaaggaaggatagggcgtcctgggcagaggaaggagtgtgtacaaaggccaagtgacatatgacaacattgtacatgaaggaaactaccatcaggcagagctgaaatgttggcacatggtgaagtgctagttaccggtcccagccatgacagtagtgtaacaaatgcctgcctctggtgcacagcaagatattaagattcctcaaaacagttcatatattttataaattaagatagacattaacagaagctcatagaatcaattaatgcaaatgtaagtgacctaagaggcattttgttcagcatagttattgattttgcctgacccagaggatttgaatttaggaagatgtaagcctagagtagctgtcagttatcttgtgatacatgggccttggaagcaaggtacagggacacagtggaccaatgggggaagattaggtcctggtgatgtgattcaagccactggattaagccacatctgaaacgtctatttctgtactcttcagttacaagagatgttagtttgaattatttgcttaagtcagtttttaaaaaattcaattgcaacttaggagatacatctggcctcttcattttacaacttaggagactaatatctagtatgacaaagtgacttgccaccaaatggctggttaaaaactgataccaggacccagatctaatgactcagaggccaggcttagaaatatctagctttttttttttttttttttttttttttttttagacacggagtcttgctctgttgaccaggctggagtgcagttgcgcgatcttggctcacagcaaatttttaaagcatctacatgtgagggcctaagtatacgagtacctagaaatctattttgcagcaactatatatttgatagagtgattgagtttagtttaaagatgacatttctaagtggtagtgctgtcaaaagagcattgcattgaatcaagaatctggcattctgtgttcatagttcacttttgccactaattatttttgtgaccctgggtatttctttctgggactgtattcattggatatgagtatctctaaatcttcttcaacttctatgattctaaatggaagtacactcaattttcaagtatccattgtggattttatatactgctatgtatcctgagaaaatcttccttttgaattatttttcgtattaatgagttcaacttcacaaatatttactgaacaccaactatgagctaggtgatgtaaaagtgaatagttacttctagtcagtattacttacttacttttgtattccacagtgcagtttgatattgtttgtagttccaaagcattaaacaatgccttttaatctaggacatgtggaatcttcaaataagagcagaattacaaagagttttagactgccactttgcatcattctgagaggcaataccataagtgttcagcagtcagaagaagggacaggggaaagtcctgagcagtgcaggtggattaagaactaaatatgcctacaaaagcacattcatgcctaaatgtcattgcatttggatcacaggccttgagaagatctgtaccatcactgtgggtaacttgggcccatttagagtacttgcctctgagggaaataaaaatttgctagcaattttctctaaatgacattatcataggcacttaattccttgataggttcttttagataatttttttataatgaagcaattaatttgattcacgaaagtaagtttctagtttatataaagaccagatctggcctatttcttagcttgtctacatttgagtagttccattgctggaaaatgaccctggagcttttcaatctcatttgaagagtccaggggacagacagagacactagttatgcagtttactagagccaggttccatttcatctctaataatttttgcctgtgtgcgcctgcacatgtagcttaagctatctaagccttagttagttttgtcatcagtcaaaggggaatagtgatatctccctctaagggttgtacaacatggtggttatttatagcacagcttgaataaatgttattagatgatatagtctcagtcaggttttccttggaccatgttttagtgacatattagactccaaagaagcaaaatgctaggagcacaaggcagcctaacttgtgagttgatgtacagtgtgaagatgcaccacagatttagaatttcagttgactagaagaataagtggtagaatttgtccctggttgactactgtcttaactttgtgtctttggggaaatatttaagctctccagacttctatttcttcatgtttaaatcgggaataatattcctttctcatttcgtagaaattgaaaggagataagtatgaaagcgtttatgagagtagaaatcatgagtgtgaaagttcatgctattatggcacaattgatgttgaaagttaatattacagaccattccttttttgcacagtgaaaattgttttatatccatattggcccctgtcacatattaaaatattattttctcttattaatttctatgagaataatactgccttcatacttttataaagggacctaggaaaccaatatttgtctaatgtttcaggctaaagagtaaaaaggaataggtatactcttgaaaatagatggctattgtcaatatttttcctaccaagaaaataattccttctctataaagaactgttactgtttagagcaatattttcacgattcaaaaagattatctgagcatgtgtccaaccataactgacccctgcaaaatatttctaaaagcactgtgcatctaggctgggaagtatgcaaaattagcaaaaatcccctagcattttcacaccaagccatgtgtatttaatatacaccacctcaaagaggaacattaccaccctagcactatgagtgaggtgagacagagagatttctaagaatatatgggtgtaattttctgttaactgagagtgattgacagttcgtggaaatctgccctccaaaataacctgttttgcagcacccttagttttatttgatatgaagaaactgcctgctgttttgacccatttagctactaggaactctatttactaccctaactgcctaaatccctatggataaattaggcagtatctgtttattttagtttagatttatttttaaaaccagtgttcctttgactgttcttactatttctatttgagagttggttgaaataagatcatgtaaataaaaatacaatgtagtctagatctaaagtcactgtacatacctagataattttttttttttttgagacaggatcttgctctgtctcccaggctggagagcagtgttatgatcacagcttactgcaacctctggctcccagattcaggtgattctcccacctcagcctccctagtagtttggactacaggtgtgtgccaccacacctggctaatttttgtatttttgtagagatggggttttgccatgttgcccaggctggtctcgaactcctaggctcaagtgatctgctcatcttggcctcccaaatgagaaggattacaggtgtgaaccactgtgcttggcacctagaggatttcaataaaatttgaggtcctataattttaagatcacatttccaaaggaaggagttttgcttcttttcaaatgcatggacaatgagcaactatattgttttggtaaaactagtagtcccaaataagaaagaggtcctactagtccctagtagtctagtcccttgactagaagaaaaagtcaagcccaatttattttatctgcaggacttggtttaagggggattataaaactatcaccacataaagtctttgatgaagaggacatagggggatgtagggagtacttcagagatgcatctggtcactctcgaatacataacacatttacataaatatatatatccaagtaaacttcagacttcacatatttgtttccttttgtttccttgttgaaaatctttatccaagctgacaatcacagtacactgctcatgtagattccactgctgagagctggaagctgagagtagagtgggctggggagcgactttcttgggactattatgcttttcttgcactttactaggttcctgttcttccccacccactacctctcctgggcactgattccaggcaagtgagatgcatatctgtggactatggttaagtgaaagcctttgttctggaaagctctatctggtttctcttaagccagacagaccagcttgccatgaaggctttcataggctctggtccacactttagacttccaactggtctgctactgacattctaggctattgtttctccaagtaatgaatgagtataccattggtggtggaagagagaattttagatggtacatagacaaatgtttttattgtgattgttatgtatttttaattcatatgagaaaaatgttttccattcatggtagcaatatacagtttcttctttaaatacatttacttaaaaatgtgagttgatttaaagagaaatattaataagacttctggggaaactcaggcatgacaaaatacatgaaggtgacatgtgagtagttgaggtttagaaagcactgcaatgttatagactctaggctagctccctgcctatccccaggccagttaactagttgaattctctcaagagtcaggatgtctttgcctgttggccttcaccttaagaaagtcaggcaatgatgaggaatcacacctgaggagattgtaggagacctttaacttaaagagtggtgatgaatatgaaagaaagagtcatagtatatgatcaaagcagagaggactttgagactcagcgattgggatgtaggaaggtttcctgtaaaaataaagtcttaactgggcttcaaaggatgaacaggaattatcctgtggagaaaagtaggagaagaatgacatatgccaagtttgtttcttaaaaccacaacccccaaattgtgagctctgggtcttaatttggtggggatgggaagcgccaatctatctgtgacttctttcctgacatgggctttcaagtgcatgtaacttgacatttatgatttcctctgcaaaagaagaaaggaacagggtgatggtgcctctgtgatcagttgcatttatgggtgcaacagcaaaggaggtgggacacctaagggacaaccgttcacgtgaaatgaagcagggatgagaagaaatgcccgtttgtatttaatacatcccagaaatgaacccctttattttctgggactgttagagcagggaaactatatatttctaagaatgggggctctgctcaaatctttgtattacagtacaaagaagggtgaggacaggaagcagtggtgatcttgctctttttggaagagtttgtgtctgtccttttaaagtcaggtatgattgataggaaagtcaagtactggcatcctcagattggagaggttttattttattttattttttttaatggagtcttgctcttgtcatccaggctggagtgcaatgccacgatttcagctcactccaacctctgcctcttgggttcaagcaattctcctgtctcaacctcccaagtagttggattacaggcacctgccaccatgcctatcttaatttttgtatttttagtagagacagggtttcaccatgttggcccggctggtcttgaactcctgacctcaggtgatccacccgcctgggcctcccaaagtgtgggattacaggtgtgagccaccacacctggcctgagtttaacataaacaaagaaataaaaataatataatctctcaaaatagcaaagaacagggttgtctaatcaaaatatataactatttatttttaatagccacattacaaaagtaaaaagaaacaggtaaaattaatttaatttaattttaaaaatatattttaaggtatacaacacggtgctatgggtaaaatggttattacaatgaaacaaattaacatctccatcatctcacatagttacctgcttcccttcccactccaaacccctcattgcaagagcagctatagtttactcatttagcaaaaatcctgaacgcaatacaccatttttattattttttaaatttatttttttgagacaaggtctcactctgtcacccaggctggagtgcagtggcgcaatcttggctcactgcaacctccacctcccaggctcaagcaatcctctcacctgagccttgcgagtagctgggactacaggcacgggccaccacatttggctaatttttgtagagacagggtttcaccatgttgctcaggctggtctcgaactccttgggcttaagtgatctgcccacctcagcctcccaaagtgctgggattacaggcatgagccatcatgcctggcctacaatgcactaatattaactatagttggcaggttgggcattagatcttcagacttgttcatcctacatatttgctactttgtatcctttgaggtacatctacccatttcctccacccaccctacctctggtaatcactattttattctctatttctgtatatttgacttttaaaaaaattctacatatatgtaaaataatgcaatagttttctttttgtatctggcatattttacttaatataatttaaataatatacttcatttaactcaatatatttaaagtattttaacatacaatgaatgtaaaaatattgaaatgttttgcacttttttcatgtaaatatttaaaatttggggtatatgttatagtacatgccatttaggacattaaattgccaatggaaataatattcagattttataacatttgcagttgaaaaagtagatacatgtatccaagttgctctcaacatacttaaagttttccaataactgaattaaatatcagtttatcagtttaatataaacaattagggtaaatgaaaataaaatttcagctctttggttccattagccatggttcaggagcagaatagtcacctgaggctagtgacaacgcttttggatcacaggaaagaagaaaaaaaatcaaaataatttttcttggtcacatttagctccttttcttccaggatgattacggagctaggaatttcctacgaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaatagatctctgtggcttgaatggtcctcagatatcttgaccaatgattctcaaatgcttaccatagaccataatttttccccacatgacactgcttcatatttttaagttttttttcaccaaatattttgttttactatctccaagccctgaaactttttttctccctcaaacatgacttcaactttactatcctggtccctttctattgaatgtgttttgtttgtgtctatatttcttatagtgtcttgaactgattgtacttacgatatgacttgactagcataagatagaatagggcagtcatcttctttgatctagactagatgctatccttctattaatgcagttgctagttttgtatttgcttgctttcaatttttttttttcagattttggtaaccactgttacttgactcgtatcaaacttatcagtagctaaaacccccattttccctcttcctgtgcttatttgactagttttgttgcgctttctgaaatgtttctcacttgtttttgaccaaaaaaataaaaataacaaatgccattgattctgtgtctatactatttgaggcagttaggcctttacttacttcttccaacattttaagcagtgttgcattcaatttgaacaagaggaataaaaaggcttgagaaatcttagggaagtgtgtctcaagctttagcaaacaaacaacagatctgcaggagatcttgttaaaatgctaaattctgattcagcaggtctggagtagggtccaagattttacatttctagtaagtttctatggattatgttttgagcaacaaattcttagagtgtctgaaaggtttttaaaataactgatttcccttcaaaatcttcttcattaggagtaaaatatacatcttctcactctgtaaatcagctctgagatcttctataatcttagctgaggtttgggtatgcagagttttgaaactcttatttgcttaagagaggagccatgtatgatcttcttttgggtttccccattgtctggtaaaatgaggagcattactaaacggcactcacttttactgagtttgtttggatcccacagagaactgaaaaagtcaccattatggaagccttatcagagagatggggacaagtcgccccaaagcagttgtcaatatctggaagatatttttctagttggccttatatttcatttctattttcctcagttctaattcagtttatcacaattaaaaagaaaccaatgaaaaacataaatattggagatcatttgatttcattggaggctggaaaggatagaaaggctgaaaagtggccgggtgcagtggctcacgcctgtaatcccagcactttgggaagccgaggcgggaggatcacctgaggtcaggagttcgagaccagcctggccaacatggtgaaaacccatctctactaaaaataaatacaaaaattagttgggcgtggtggcacgtgcctgtagttccggctactcgggaggctgaggcaggagacttgcttgaatgcaggaagtggaggttacagtaagccgagactgtgcctctgtactccagcttgggtgacagagcaagacagagtgtgacagagcaaaacaccatctaaaaaaaaaaaaaaaagggaaagaaaaaaaagaaaagctgaagggtgtgctgggtcctgtcctgggtgagggaacaacttgtggaaaagtgaattgaggcttatcggaatgtttggggctcctcaataatgttggcactctgagatacagaccaaaagtgaggtaaaaagcgagtgtttcctttttttcagaataggactttactccagattttcttactcttctcttgattccttcaccatccttgatcgacattcacctcagatgcccatgtcccttctccaccggcatagcttgttttcttcttaatcttcttgtgttcatctagcctcacattgcatttgtcacacttcgttgaaaacctactgtttgtcaaagtgtctttctagtaatccagatatctcttcccccatgcctttggtgtggtttcggtagagtcatacagagcagcaatgccttatgaaaacgaattttacagaatctgcctgttcatcaaaggaggccagacaggaggtgagaaaaaccaggtgtgtcccacaccagtctcaatgaagccttttggggtgtcttgtgctcttgactaaatctcagatggtactgaatgaataatcaccaaaggcgtgagctgttaaggaatcccagtttggctggctctgtgcagtcagatgtagccagccctgtttatgtgtgaaaggattgggttttccccaagctgtttggtaatgttgcaagaacagactttcccctccctggctccctggagtaaaatggctgccaaagtattttggaacagaaacttagaaatgtaccgaccactagaagagagtaacaagggtcctttgatattttccgtgttcactatgatcaagctggcatcgtttccttctgagctaaagattctgagctatcattggctgatgtgagcttgtgacctagctacttctgttcacaatacactgtggaggggcagcgggggcagccctatttgggttgagagtctttaaggagagctttacagatgagttctagtgaagcccatcagggagaagaaaatcaaacacaatgggaaatgtttaacaattaaaaccaggctttgcctgtgtggtcctgtgttttaccacatcactctatggaaatgggctgttggaaggaagactgtatttctgacagtttgcagagccaaaaacctgttgaaggctttttgtaaggtagtggagaaaatggcaaaacctttaaaacttaagggaaattacttgatagttctgatgaccacaggccaccagactgctgggtcatggaattatagctacatgacaaagaaaataggagggtgggctgagccagactcagaaactattccaaaagtactatgactttttaggaagctagttctttttatttgaaatattttgtgtttttttgcatgagaattagcctatgcttcttaaaaatatcataaaatgtcagctagtagaaaaataaagagtttaatctccactccgactacctagagtcaacccttgttcatactgcagtacatttttttcttttagttctgttctatgctttaaataaaaatacaattaggtccatatggcaatataattttgactccttttaaaactgtagcttatatcataagtctatttgatgttgttttgaagttgtcatgtacattttgtcatacaagtttttaatgactgtttttatggggttgtgccccaagttacttattcattcccatgttatcagatattttgttctttagctttttttttttttttttttacattataactaatgaggcaatgtgtcttgagtattttgaattaactctctagaatcgattcttggggaggttatttactttgaagtgatggacagagtgtaggagatttatgagtgaactcttgtctgatttggaaatatagagttgtttaggctaggtattaccaacccaaagttgacacttgagtcacctaagttcttctctactccagagacttggccctgcctggcctgatcccaggaaaagagattttagggattacagaaatgggaacaagttgtgggtctgagcacagcatgcaaattaattcaacacagcccctgggacaggcccatgatcagtgagctgaaactcccccttcaagtgctttcatgattagactccagcctaggaagcttgtctattagttgtgtaatcttgaaaaaatctctgacacttttccctctgactcagtttccccatctggcacccaatcttttacagtgttatgaaaaatagggaaaatgtagaaaggaagaacatggcacccaatccttaatggacactcagtgaaagctggctatcatcatcatttttggggttgttgtgttctacaaatgtattttcccaggagttttttttactctgtctcctctttccttcatatacccccagcctgtggctggggtcttgcttcaaccaccatgcacctttctgaaacccaagttttactccctgataaaggtattgacctcttgttggtctcatcctccagacctacctatacttaagaaaatgacatctctttaaactggtccccagttcacttgttttccctaacattttaattcacaagattaatcacttcccttacaggccagtcttactgcagagttgatttttataattttgggcctgttggtctggttgtacttttctctttctgctggtctgctagttatagcgggtcttgaaagcagtgatatgttatgacattgtcatcaccctcattattgctctttatataacagtagcagcataactgtgttttgatttcttgtacaaggcataaagtgtgctagtggctcactattcacatcaatctcatcagaaaatgttatttcctccttttgttgatcatgatatagaggcccagtgacattaggtaacttgctcaagatcacacatgtggaaagctacagagccagacttggaactgagtccattatatcttaatcccactgcactccaaaatttgttgaatgaaggaatagataaacgtatcatgattttgatgttctgactaattcgtagccagtactttattgctatcggagcttaagctttaagtactggctaggaaatagtcagaactttatttttaaggaggagcatataattatgtatattttatacctgtagtaaattgggaactatagaaaacatgtagaggattgtgtttaccaacttcatgtagagtgaggatacccgactctagcttgctggtagttaggtaagtcagacatgggcaggggataaaccaaattagactatttccatttgactaagccatataatcaggtgtaagccacggaaagaaatctggaaagacaggtgcaatattagaagatggctcatgatagtgatcattagaggttcaggcttgagaaagccaattggaatcaagaaggcctaatcctggggttctgtcacagaaaagaaggctggtagcaggaagaggacatgtaacatgaattacatgattagatttgtgtcataataacaaaaacaataatgataataacactaatagcttgttatatgccatgccctgtactaagaactatacgtatgttatcccatctaaatcacatttaatagattcccatttttctcatgagaaaattgcatcatacagagatgaactaacttgctcaaggctatagacctggtaattagcaaagcagggatttgaatttagatgtatttttctctgaaggctgggtttagataaatggatctggaagcactgggaaggatgaattaatgggatggagtgcaggggatgcagagtgcccacttatggaatgatttcattcaagagagacaggagggtcagaggtaagaatgctaccgctgggacagagaggaaggtacagatatgagatatggtaagaaggtatactacaacagtggctcccaaatctcaatgagtagccagttctcatggaggttttgtttttatttttgaatgaagattcccatggcataccttgaatattctgaatcagaatctctggaatacaacttggtattcttataaagcaccctaggtgatgctgaagctctgccaggttcaagaaccacagctcgatcagcctatatttagatgtttggggtggagaatgagagaaagaaaagattttagggtggcatccaggtttctgaattttgtgactcagtgaagtttttggagggtaggtaagatgctgagttcagttttggatgtgttgagatggactggtcctgtggatttagttggatattagagtctaacgcttagaacagaggtcaaggctgtagatttagatatggaggacactggtgtttgggtggtgatggcgctatatattacatggaattttcaaaatactcaaaacttcagttttccctcaataattaatcactttacatctttgtgatcttaaatctctttctgaccattgattgaaacttttgcttttaaaatttacattacctttcttaacagttccttaagattcatgcattgttgtaagtagttacttgcaccatttcattggattcacaccaacaattgttaaagtaaaatttatttttcctgtgttttagatgaagagatttaggcaggttatgtaacacacccaaggtaatatagtcaaataattgagccagaatttgagcccaagtctctttctgactctaggcttagagctttagggctatttcacaaaagggctgttcctaggtcaggcatgacaacttctatattaccttcgtaaaagaagcaatataatctaccactattaaattttgcaggttaattttatattatgtttaaatacagaaaactttatttaaaactcagttgaatttctcttgagaaattggccatgtagtaaattatatttaatagaagagtttgtgtacttcccagggagcagagtattggcctgatcaaagcacctttcagcctttgtctaacagcatgtgggtaggctacattttttttactctcagagaaagggggtgggcaggggtgtgatatgggtttttgtctctgggagttctgttgcatgatttgacctcccaaattgttttgtggggcatatccaactttgggttgaaactaaaatgggttcttggtaatcccagattgaaaatatgtctcagcagtaacattgtttatctttaggtttaggtaaatacagacatttgccatgtcttcttggtagcactgtaagaatgagtagggctgtgaaaaatgcacagggcattcattatgaagactggctggttaaaactgatacactaaagaaattgcattcttttccacaagctgagtcatacagctgaaattgtggaatcatctgagccagcagctgtaatatgatacttaatctccataagtgacagatatctaagataacacgaacacccagacgacaactcaggcaaccccagcacagtgttttggtatgagaacaggagaaatgttagtagagtgaacatttttccacagagaactcaaatatggtaacattctcatagctttgataatccccaataaactgtggttactaaaatgcatgacaaaaagaacttctatctataaagaacttctttatacatttccaatacttgggttatgatcaaggagaaaaaagtttatcagttaattaagagttaggtagctagtttgcccacagattaatttgtatgaggtaaaggaaatctcacctaactgggaaaaagcaagcttaccctcaaggtatgcttatcccaaccccaccctgccaagtgcattccttattcctcaggtgtgcctgtttatcccaaggacctagccacacctacatcttgttctggccccacaccaaggaacatataaaagttccctctctggccgggcgcggtggctcacgcctgtaattcccagcactttgggaggctgaggcgggcggatcacgaggtcaggagatcaagaccaccctggctaacacggtgaaaccccgtctctactaaaaaatacaaaaaattagccaggtgtggtggcgggcccctgtagtcccaggtactcgggaagctgaggcaggagaatggcgtgaaccctggaggaggagcttgcagtgagccgagatcgtgccactgcactccagcgagggcaacagagcgagactccgtctcaaaaaaaaaaaaaaaaaaaagtccctctctttatatctcagggtatcttggagtcactactgatccttgacctccctcctttctctgaccatgtctagacaagtgtccaggtctcctgtgccaaatgtctatttgttgcctggattaggttttgacttgtttttctatttctttgcatctcgtagcccatttctttgattcaatttcacaatctcttgattttgtccttaagtatttggcaacacaaaccctcgagaggcaggatagttcaacagaaagaagatgaaccttgggggtcagaagattcaaacttccagaatttaaatcttcattctgctattactagatttataaactttatcaaatcactctcctactctatcccttaattcaacatatttaaaattggaataaaaatctcaatgtggtagagttattattgagatgaaaatcagaatagatacaaagaacttgatagccccaaggagcttgatcagtgtttgtttaatggcccttcctctcttctcatatctcagttcagatcctactcagccatttattttattctgctccttttggagtagagaataaagccaagaattatgcttaaaaagtagcataattaaaagtatttaaaacacaagtaacttgagaaaggtgagttggaagtttatatctaacctcagttttttttggagagaaatttacccgtcagggccagattaaaacatttacaagtcccaagcacacgtgagatgaagatgcccctcacttatctcacatgtaagttgaaagttaaaaagtgaaaatgtctactagagttcaataatattctttttttcccatgacttctctgaagcttttagaaaatatgaaattcttaaaaacaataacagtaacccacatttttattgccctggtttgccctatcttatctttctcctgctcacagggtctgaggcagctgggataggggagaatgattaccagccaatcaatattttttgaaccccagagattatttatttatctatccatttatttattttgagatcttattttatctggaatcttaataaacgattagtttccaaactgtatctactgtgtgtattttatccatatggcccagatttgtattacttatttgtgattctgaataatattttttccaacattaattatcagcctctctgtgcccctccagaattgttacaacctatgttaatgcacactatggcaagccatgtgaattgcctacgcagggaagttttcttcatacttccttgccaagagaaccccattattggtcagttactagtcacatgatcttctttagcccctccttagcccctgtagtgaatcaggagtagcctaaggccatggtggtaactcccctttttcttggaaatgtttgatttagatatggagaagaggtgcaactttgcttatgaaatgggagggcaaatatgggaaactttaaggtaagttttctttccccttgaaggggaccaaaaagttgtggtttatactttcttgactctggtcactgttgggtgaagagttggtgctatggaagccatcttcagaccatgaggggacaagtctgaggatacaattacatgctaccggtggcagaggacagtatagcaagaaactggatccctgatgacattgaaccattgactgaatctaccctggaaccatcaggaaataatccttagttttttaaagatgcttttagttgtgttttttattacaagtacctgaaagcatcctaactaatcaatgctaaatgcatctctcacagtttatgcttatttttcagaaatgcctagtggaaatttctattgctgattataatatttgtcctaaataaattgaatagactgtcaatcttttgaaaataaaagcatgacttgattagcaattgtttagtctgatgttttcctaatttctgtcatttgcataccacttctttgattttgtcatatccttgtatcatctgcactaatagaaatatttttccttaagttgtctctcctttaaaaaattatatccatttattttgaagagaaactttttcactaactataaattgaaaaccgatatcatttgccttaaatagaagattgtcataaaaagaaatgccatgagtgaaataatgttattaaatatttgccagatatagtttcctatgaagactctgagcttgtggcttgctgtctctgttgaaaggagagactagggagtgttatagaagtggtaaaataatccttccactgactgagactatttccttgccacaatcagaagaactaaaagaaaggaggatatctgttaatatatgaatttatctaaatgtcatgcagtgacttctaaaatcatctggtgtgctctgtttccccttggaggtgacttaggcctggcatcccaaacaatacatactggagtgaagctccaggaaaccctgaggagaagagaagggcttaaagagcaatcagccttcgattgctgggattatgaaaggtcgtaagaagcgaatgttgcaatgttttattatacttgatattgaagcaaggacaagtaataatttattattctctccatgtcagtggtatttacctttttggaatcatgtgccccattgagaatttctggaaaaccatggttcttctactcaggagaatgcacaattgcacacatacacaaatgtgcaagcacacacacacacacacacacacacagaattgccacagaaggtcagtaggttcacaggccctaggctaagaaccagcattctgtatattttacatgtgttctcttacaagttaccgtgtgattcagttcactccaaactgcggttaagtgcaaaacatggttttgaatatttctatcaattagtaagagtggtatgttaatttaaatacaccaaagtggagaattactgtcctctcaatagctactttaaatagacataagttacagtgatattgccttccaggaggcttcaagaaatgagatcaggctctataaaagaaaatcacccaaccctataaagtcatctttatgaactttgaaacaccactgtatgtacctagtaaaaattattcctgggtaagcagactcccaggcctgggtggagttcacatgagtccctttgctaaaataaacagaagtgactgggaactttggattgcctttgtctgaacttgagtgtctggatggatcagcatcagcagcataccacacacctgcttgtccagccaaagagaaacccaaagacttggcatttgttttttacattgtcaactgtgcaaaaatatcacgattctaatttatgagggtccatgagttttaaaaacaccccctgacatttttctagccaaataatttttcctttaaaaggcacaggatgagcaacaagattaggtagatcacttcaatctctaatttcaaaagataatagttaaaaattcaactgtaggactaacacattaactatgtaataagacccagaatagtctttggagcaaatttcagtggatacttgatcaaaataatgttgaagacaaaatcttgaattgatgatatttatctgatacaattatttacataacaaatgttaaaagaattagaaaaatttcataggtaagatgttcattatcttcaagtgaagttacttgctttatattaagaaccacaaaaacttactaaacttttttttttaaaagggtctcactctgtcacccaggctggaccggagtggctcaatcacagctcactgcagccttgatctacccagattcaagtgatcttcccacctctgcctcccaagtaactgggactataggcacatgccaccatgcctggctaatatctctcttttctttttttttccccttattttgtagggacaagttttctccatgttgctgaggctggtcttgaactcctgggctcaagtgatcctcctacctcagcctcccaaagtgctggagttataggcatgagctactttgccccctagcagacgtcttacttttttttttaatttggtattagattgagccaatgactaatttcaaacatttataaattactaaattcttttttttaattatactttacgttttagggtacatgtgcacaacgtgcaggtttgttacctatgtatacatgtgccatgttggtgtgctgcacccagtaactcgtcatttaatattaggtatatctcctaatgctatccctcccccctccccccaccccacaacaggccccggtgtgtgatgttccccttcctgtgtccatttgttctcattgttcaattcccacctatgagtgagaacatgcagtgtttggttttttgtccttgtgataatttgctgagaatgatggtttccagcttcatccatgtccccacaaaggacatgaactcatccttttttatggctgcatagtattccatggtgtatatgtgccacattttcttaatccactctatcattgttggacatttgggttggttccaagtctttgctattgtcaatagtgccacaataaacatacgtgtgcatgtgtctttatagcagcatgatttataatcctttgggtatagacccagtaatgggatggctgggtcaaatggtatttctagttctagatccctgaggaatcgacacactgacttccacaacggttgaactagtttacagtcccaccagcagtgtaaaagtgttcctatttctccacatcctctccagcacctgttgtttcttgactttttaatgatcgccattctgactggtgtcagatggtatctcattgtggttttgatttgcatttctctgatgcccagtgatgatgagcaatttttcatgtgtcttttggctgcataaatgtcttcttttgagaagtgtctgttcatatccttcacccactttttgatggggctgtttttttttcttgtaaatttgtttgagttcattgtagattctggatattagccctttgttggatgagtagattgcaaatattttctcccattctgtaggttggctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtataaggaaaggatccagtttcagctttctacatatggctagccagttttcccagcaccatctattaaatagggaatcctttccccattgcttgtttttatcaggtttgtcaaagatcagattgttgtagatatgtggcattatttctgagcgctttgttctgttccattggtctatatctctgttttggtaccagtaccatgctgttttggttactgtagtcttgtagtatagtttgaagtcaggtagcgtgatgcctccagctttgttcttttggcttaggattgacttggcaatgcaggctcttttttggttccatatgaactttaaagtagttttttccagttctgtgaagaaagtcattggtagcttgatggggattgcattgaatctataaattactttgggcagtatggccattttcatgttattgattcttcctacccatgagcatggaatgttcttccatttgtttgtatcctcttttatttcattgagcagtggtttgtagttctccttgaagaggtccttcacatcccttgcaagttggattcctaggtattttattctctttgaaggaattgtgaatgggagttcactcatgatttggctctctgtctgttattggtgtataagaatgcttgtgattttcgcacattgattttttatcctgagactttgctgaagttgcttatcagcttgaggagattttggctgagacgatggggttttctagatatacaatcatgtcatctgcaaacagggacaatttgacttcctcttttcctaattgaatactatttatttccttctcctgcctgattgccgtggccagaacttccaacactatgttgaataggagtggtgagagagggcatccctgtcttgtgccagttttcaaagggaatgcttccaggttttgcccattcagtatgatattggctgtggttttgttatagatagctcttattattttgagatacatcccatcaatacctaatttattgagagtttttagcatgaaggttgttgaattttgtcaaaggccttttctgcatccgttgagattatcatatggtttttgtcgttggttctgtttatatgctggattatgtttattgatttgcgtatgttgaacaagccttgcatcccagggatgaagcccacttgatcatggtggataagccttttggtgtgctactggattcagtttgccagtattttattgaagatttttgcatcgatgttcgtcagggatattggtctaaaattctcttttttttgttgtgtctctgccaggctttggtatcaggatgattctggcctcataaaatgagttggggagaattccctctttttctattgaatggaatagtttcagaaggaatggtaccagctcctctttgtacctctggtagaattcggctgtgaatccatctggtcctggactttttttggttggtaagctattaattattgcctcaattttagagcctgttattgctttattcagagattcaacttcttcatggtttagtcttgagaggatgtatgtgtcgaggaatttatccatttcttctagattttctagtttatttgcatagaggtgtttatagtattctctgatggtagtttgtatttctgtgggattggtggtgatatccccttttaattttttattgtgtctatttgattcttctctcttttcttctttattaatcttgctagtggtctatcaattttgttgatcttttcaaaaaaccagctcctggattcattgatttttttggagggttttttgtgtctctatttccttcagttctgctctgatcttagttgtttcttgccttctgctagcttttgaatctgtttgctcttgcttctatagttcttttaattgtgatgttagggtgtcaattttagatctttgctcctttctcttgtgggcatttagtgctataaatttccctctacacactgctttgaatgtgtcccagagattctggtatgttgtgtctttgttgtctttggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgatttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatgagatgggattcctgaatacagcacactgatgggtcttgactctttatccaatttgccagtctgtgtcttttaattggagcatttagcccatttacatttaaggttaatatgttatgtgtgaatttgatcctgtcattatgatgttagctggttattttgctcattagttgatgaagtttcttcctagccttgatggtctttacaatttggcatgtttttgcagtggctggtagtggttgttcctttccatgtttagtgctttcttcaggaactcttttagggcaggcctggtggtgacaaaatctcttagcatttgcttttctgtaaagtattttatttctccttcacttatgaagcttagtttggctggatatgaaattctgggttgaaaattcttttctttaagaatgttgaatattggcccccactctcttctggcttgtagagtttctaccgagagatcagctgttagtctgatgggcttccctttgtgggtaacccgacctttctctctggctgcccttaacattttttccttcatttcaactttggcaaatccgacaattatgtgtcttggagttgctcttcttgaggagtatctttgtggcattctctgtatttcctgaatttgaatgttggcctgccttgctagattggggaagttctcctggataatatcctgcagagtgttttccaacttggttccattctgcccgtcactttcaggtactccaatcagaagtagatttggtcttttcacatagtcccatatttcttggaggctttgtttgtttctttttattctttttcctctaaacttcttgcttcttttcattcatttgatcttccatcactgataccctttcttccagttgatcgaatcggctactgaggcttgtgcattcgtcatgtagttctcgtgccttggttttcagctccgtcaggtcctttaaagacttctctgcgttggttattctagttagccatttgtctaattttttttcaaggtttttaacttctttgccatgggttcgaacttcctcctttagcttggagtagtttgatcatctgaagacttcttctctcaactcgtcaaagtcattctccatccagctttgttccattgctggtgaggagctgcattcctttggaggaggagaggcactctgatttttagagtttccagtttttctgctctgttttttcccatctttgtggttttatctacctttggtgtttgatgatggtgacgtacagatggggttttggtgtggatgtcctttctgtttgttagttttccttctaacagtcaggaccctcagctgcaggtctgttggagtttgctggaggtccactccagacgctgtttgcctgggtatcagcagcggaggctgcagaacggcgaatgttgctgaacagcaaatgttcctgcctgattgttcctctggaagcttcgtctcagaggggtacccagccgtgtgaggtgtcagtctgcccctactggggggtgcctcacagttaggctactcgggggtcagggacccacctgaggaggcagtctgtccattctcagatctcaaactggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgttttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatggtgatgggaggtactggtattacaaaaagcttctcccccgtgggtcaaatctaagctgagtgttgagacataattgaaattcactagatagataggagataggggtagggaattctaatcagagggaatagcacatgtaaggcaaacaatacagtgcatctgggaaagctatacaattttattgttataggacaaatgttggggaatgttgagagatggaactggagagtgaggcagaagttagcatttattcatttattcagcagacctttatctattacctacattgcactaagtactgtgtgagcattagagagaaaaagatgaatgagattggacaccattcgttcattcctgactatgaacttggcattgttctaggtaccagagatataataatgagaaacagacatgctccctcccctcattgaggttacagcttagtgtggagacacacagatgcctaacgcactatggtatggaaggtgctatggacacagtgctcaaatccatgatctacataggtatgagagtgacttttctacaacttaaatctgatcttgttattccctgcttaaaatcctgcagtagctcccagtagtgccttctggttaaaatacaagatatatagtatgacctctcaaggacctttgttatttgtctctggccacctctccaatttttcaccatgaccctggccctgtcccactggcattccatctccaatcacacggaactatgtggagttattaaaatgccctatgttatttcaagactcagagatttagtgcctcagcctgttttgttccctctcccctcctccacctggccttctccagctcactcatcaatctattagactcaggcatcatctgcttgccttcgtaaccctccccaccccgctcaccttgctggattctgtgcctttgcttgctggttcccagagatccctgcccttatttttctttgcctgctggatttgcagtgttgtgtcctatatggtgtagaaaaccagctcaggctcccacttctctgggcttatgtggtcagatgcagacctgtcttccatccataccaaaggccatcagggagtttcttttgtcctcttcaccagcccattcttaatctttctgataaattttctgcactgtgtgcgcgtgacaaattgggtcaaggtgatggtaatttacagcatgagatggtgaacttgctgcctgtgctgatgagcccattggatttcccctaactagtctgtttccctacccaggtggagaacttcagtagaggaagtggcaggaatttgggaatgaggagcacagtgattaaactggggccattcatatgagagtttaagaactcagaccagtgacttaggtgagtaaaaatatcagaaaaagggaaagaggataagagcaacttgggccataattaaacttgtcaatgaaatgaaggtctgttattctaatgcctacattttgccaaacctttgtgcttataacttcatcatttgctgtgattaacaaagttgaaagaataataactacttacaaggcccacatcacctccttataccactagcttttgctttccgtacagacatagctttaaaaagtgcaaatcctattctgtacctgagccacaaccctaaaagggaacttgtttacaattctaagaataatattgtcctttaaaggtgaaggctcgctggaaaacatgccattcatgtgataaaaagcaggtagcaggtagtgctaaagacttactagactgcatgtttgtgctttctgctgcattcctctaatctcaaggcagtataaggagataacatcttcacagccctttcagccctgttgcaatttctttgaccctggcctgatataaaaggcaaacttggtttttcactgttctagtcatgcagtttctttgtggttccctttagaaagacttgaggctatgagtcaaagcttttacgtcttgctgatagttcagagttgtgatgtgaagcaataaataaaatccctccttccacatacttgtctccttgattagaatcattctgggcaaatttagaggctcataaagtccatttagatatttagtgaaaaaacaccagcactcagaacagaatgttgataatgtagatggaatatctttctctctctgtctctgtgtgtgtgtgtgtgtgtgtgtgtgtgtatttatatatgtgtgtatttatattatatatgtgtatatttatatatgtgtgtgtatacatttatatgtgtatatgtatttatagtaaatatatcacatgtatttatatatagtaaaaaagaggggactataatatatctttatatgttagcatttattttaaaaagaaaacacaggaatatctaaaagaaactattacttataggggttatgggaaatgccatgggcaagaattttttttttttttatcaccatgctttctgaaacaacacgatatgtatcacctttataaaaataaaataaaataaaaaatgaaaaacaaagtccacttgtaaccacatgtcagtagcatgtttgctttcagggtacatcaaatgcattctatagcacaggatgttccagtcactctaacaaaagatgtcctgtttggaacaccaactctgtatcagttacttcagacactttctctcattgagtcccttcagcaagcccttttaggtttatgttcttagatgaggaaaccaagtcttagaaacattaactggccaaactaagatcagagagttagaaatgtcagagcccagaactggcatcttctgacttcagatcccatgtactttcccctacactgtgctgaccacacctccattactacagatgtgttgattacatctaggggccaaagtacacattcatccaataaatgcttactgaatgcttaccgtgttcagggcactgtggcaatcttttgtaatgcaagaaaaataagagtagtgaagacagtcaaggaaacaaagaagcctaatactaggcaagaagtgcttttgatggaattaagcacaatgagggtgttagtacagaaaggacatttaattgaactgggaaagttcatggcagttttcccagagatgagtcttgaaggacaaatggtatttagccaggaggaaagggggtcaagtgtattccagggagagggaacaacatgtacaaaagcacagttttgaaagaacactccatttttgaggaatagccaatagctgggcacgtctagagcatagggtagtagagagaaaggaggccggaaatgggaagagacttgaatgccacattcagttatgtggacttcatcttgtagcaatgggagcctacaaaattttaagtagaggaataaaaagattccatctaaaacttagaaaaattactttggcaggataagagacaatgaattgacggggagctgggtttgatagcaagaaactgtttgggagactgttctaattacatattttcttgtttttagatgcacatatacgtacttttttagctggtcatttctttctgaaattggaatgaatcttacaatcaatggcatgttataatttcattggcagcattatttgtctcttaagggcccccaaataatagtgtgtcacataactgatagcatctcaaattagatgaaatacagtagtccaggcaagaaatactgagatggtggggtggtaaagagggaaaagatttgagccacatttagatcctgatgtggtattaattattaagtaaaaaaaaggaatgtgcagtacatattcagtatgccacaagttgtggaaaaaaggtgtgcatggatagatgcacatgtatgtattcataaagttaatgtggatgcataaagcgtctctagaatgatacacaagaaacaaataacacccgtggcttttagtggggggcattgggtggctgagggagaacagcggtaggaaaatttttcattgtgttctattttgtacatttgatagtttgaactagtcgtattatgcacttcaaatatgtaaaaagataaaaagtaagagatatttagaaaggagcattgacacatttgttgacagattggttatgggataaaggcgatagtattttattgactatattttattcttttaattattcctctaatttcttaaaacaactttattgaggtataacttccacggtataatttcacccattttaagtgcatgaattcagtgatttttagtagagtcattgagtagtgtaaccattcctacaatggttatagcacatttttatcatcctaatgagatccttcatgctcatttatttaatctccattcccatctccatccccaggcaaccataatcttccatgtttttaaaatagctttgcctatttttggatgtttcatacaaatggaatcatacaaaaggtggtgttctgtgtctagcttctttcccttaggataatgttttctggtttataaatgttgcaaatgtcagtatgatacttcattcctttttatttgtgtctacaaaatactctattttatgtatataccaccttttgtttttctgttcatcagttgaagaacattgcagccgtttttgctttttgacttttatgaataatgctgttataaacgtttatgtttaagtctttgtgtggaagtattttttcatttccttgggtagacacctagaagtaggatgttgtatggaaaattaatgtttgactttttaagaaactgttttccaaagtggctgtaacagtttacacttctactaacaatgtatggaggttcccacttctccacatctttgcttacacttattattgcctgtctttttggcagacttaagcctagtggttgtgaagtggtacttcattgtgggtttgacttccattcccctaatgaccaatgatttcggacatctttcaagtgcttattaaccattcacgtgtcttctgtgatgaaatgtctatttgaatattttgcccaatttaaaactgggttgtttacctccctattcttgacttgttaggattctttgtatttttaactttaatttgactgaggataatgatccaccagtaaagagatgcatttatttctgtatttatgaaaatctttaaaattcctctacctttcagagacacccttcaacagactgcgcttcttattttcagagtatgtatttccatgataacacaagtatcaattataaatattaattacaactttccctcctcactgcagactcaaccaagagttataaatctgtgtattactttcaatgctcataacaatcttcttaaccaccataagcagactgaaaaagtcaatctagttgaattgttttactttataatgcttttataagatactcagtctgaaactgaaagataggtagctctagaaatgtgataaatggccacagaagtaacaacttttaataaattaaattatggatgttatgtcaattttaagtaatgtctcagttttatatcttgttacctgacctaaatatcattccctttagtaaaatatctattaaagctttgtggcaaaataagaacagaaaaatggtttttgattttcagctttctctggtgaataatttgttttcttttatttttccttctaaaataatcacacgtttcattgcaaccctaaccctcttcaacacacacacacacacacacacacacacacacacacatggcttctagattctacatgtacaagagtgcaaatcaaactaccatagaaaaactaagaagagaggcctagaagcaagaggctgatacactatctcaggcttcaacaaaatatttatctctgactataccaaggatgggcagagcttgcatgtaagtggcttgggctagcagactgggttttgaaggaggacaacatggccatgttcttggttcggtcatgaactgtctatggcacataccttaaatactgttggaaggatccgttagctccagagactgcaaccaactgcctatggtcataactcagctctcagacacattttgttgtgcccacagagtgctgtttgcctgtttggtttttaaaccaacacttaaaatgcagggaatttaagataaaaatttgataaaaatgggaagatttggccgtattgggctcatggtaactgagatgcatctgaatgacaggcattcctttgaattgcacatttgctcttgtttttactataggccactctcactttctgtttttttccccggctttgaaacgatcagttttagtactgaaaaattatctaggatactaaaaccagaatttctctgctagatggcttgctcattacattacctacatgattctgtgtaagggattgtgtaagttttctatggttgccataactatcacaaacttgatggctttataacaacagaaatgtatttacagtttggaggcagaaggtctaaaatcaagacttctgattttagtctgtccaagagcctctgctggtagggccatgctctcggcagaggctcttggggagaatctgttccttgcctcttccaccttctggtggcttcaggtgttttgtggcttgtggctgtatcactccaatttctgcctctgttttcgtatggccttctactctgctcctttagtctctcctttaggctgtttcttataagacactcacctaaaacccaaaaacaatctaaaagattttgcaaatatgaacattctaattaccttagagttaagattttcttttctgctaagtgagggcatggtgcagagagcaggaaagatgtgaaactagatagcatacaaaaataggtgttcatagatctgggcctaacaagggtgtggccagcaactctgccctgctttatcagcattagaaagccagtcctctcagaaagtgcccagttagctaaattcatgagattatagactattaaggtggaatggacctcagagatggtccttgctctcatctgaggcttcagttgggccagtcagaaatgtgggaaaattgaggcaggtcaaataaccaggagtacaaacaaacacaatctatccagaaaactagaaatcttactagtgactattcacaggttactttctgcattctggggttttcattctagaacagatgtgtgtgtgtgtgtgtgtgtgtgtgtgtgtgtgtgtgtgtgtgtgtggtgcgtgaagagaggggaggggtgcccagaaaaccatacccactttcccacatatcccaactatgactgggcaattatgtcattatcaccactgatatatagctggaagagtttagtgttgccctgctaagatctggattttcttttctggagcttggctattggggcattgagaagtccagccaggaggttggtcagaggctaacccaaaaagctttgcttaactctgggctacagctgggggttgccagagagaagtgcctggcattcctgcatgctgacatcaagcttcgaagttgctgccctctggtgagtcagcagcaaaggcccacatcgttcgagaatgctgcccaatcagaagatgtgatgccacacctcagaaatctttctaaacctcagcattctgtagacttcaaacaactcctcctgagaaagaatgtagaaataattaaatttataagattaaagttataaaaagcatagagcctataataataacagcaataagataaactccacatttgcttttaaaacaatttatttgagtagacagccaaccccctgtattgtactcctttaaaaaatattttaggctttttaaatgctgaggcaaggggacataccaaacactaacaggcacattggggttttctggctattgaaataaaaatgtccttacataacactgatgtactggaatagcactgcgttccagtgacggttattgcaactcagccagcatatctgtagcttgtgagcttttcttatcagaattttatctataaatatacatatacgtaaattctattgtgaaataaaaataaaatgtagaatcttctcatctttcttattagtcaatattgtgctactctttaataatttctctcaattttttcattaagcagatattactagggaaatatacatgaggcagaaggcaaattatttgcttagtgcaatgcaaacttgcttaacaggtaagagcagagtcccttccatagcattgccaccatatggcattgccatatcgtggaggccataaagaggaatgacattgtaaagattaactggattttacttggcaaggtcaggcacctagatggcatgctataaaatggttagaagtgcaaaggaaacctgtagctagaggccatgtgagattatggaagtgacttttcttacaatcctgccatctggtttggattgtcaggatcaaaacatttcacttgcccaagtgaggatgctctctacatggttttggggatgagggagactcagaaataatgtttgtggtactgtagcaccactaggaaaagagaaaaattggacctgacatgaagaaaagcatgcagccagccactaagactacttcccacaggactggaaatctctaccaccgtacctctcctacatgctgggtataagaagttaaagggaagccagattatatttacctactctttcattcattcattcactcattcatttattcatccatttaccatttgtttgttttttgttcatttacttatttaataaaaattgtgttttgcatattctaggtgccaggcattgaagaaccactgttattgttctcaaatgactgacagtttagaggagaaaatggaagaataaatagacacttgtgatgcaatataatagtgctctaataagagcaacatatattgaataccactgaatattaaataccagggactttgctaggagctataaattaatctccacagtacatctaagatagaagttttataattactctctttaggaggaaataggggtctatagaggttaagtctcacagcctggaaggagtcaacaaaaaaatactcagccttaggtattctgactagaagcttgggtccttaaccacctactcaccaatttgaagaaagatgattgaaactgcaacagctacactgactcttgaaagcaaagtaactcgttaaatgagggtatgtgtatactggctgggatattgtgggctcatgatgacttgtaggccgaggcagctgcacatatgaagactatggagggtatatcatcagcggaaatgaaagtgattagtgttggaggtttcagtgcatattctggttttctattactgcataacaaatcaccctaaaatttagtgacttaaataaacatgatcatttatttagctcatgaatttgcaagttgtgcagcacttgggtgggatagctcacctttcttccatgcagtgtctgctgggactgcatgattgcatgaagcggggctgggcagctagagctcttcatgaatctctatttttgcatgatattttcacaaggtctctcaagcatgggagcttcaggtagcagaacttctgacagggcagcttagtcctttgaaagtgtatgtctgaaaagagagactcaggcagatgctatattgccttttgtgaccaagccttggaaatcactagtctctcttgtgttgaggtggttataagagcctgtccaggttcagtagggagcataaatttcacctctgaatggagaagtgccaatgtcctgaaaaagcatgtgggcccagaaatactgttgtggcaattttttgaaaatcaagtgtgataaagacagcatagtgtagtcataaaaaacagattaggagcatgatgtgctttgatttcaactatgggctttattacttactaactgggttactttggttaagttgtttgactcttgttttttgagatggagtcagtctgggagactccagctctgtcgcccaggccggagtgcaatggcacgatcttggctcactgcaacctctgcctcccggatacaagcgattctcatgccttagcctcccgagtagctgggattacaggcacctgccaccacatctggataatttttgtactttttttctttttcgagaccgtgtctcactctgtcacccaggctggagtgcagtggcatgaactcggctcactgcaacttccacctcctgggttcaagccattctcctgcctcagcctcctgagtagctgggagtacaggcacacgccaccatgccaggttaatttttgtattcttagtaaagatagggtttcagcatgttggccaggttggtctcaaactcttgacctcatgatccgcccgcctcagcctctcaaagtgctgggattacaggcatgagccactgtgcccggcctaatttttgtatttttagtagagacaggattacaccatgttgaccaggctggtctggaactcctgacctcaggtgatctgcccaccttggcttcccaaagtgctcggattataggcatgcgctaccgtgcccagcccaagttgtctgactcttaattctcagctttcttatttgtaaaatgaaggtactagtactaatttggagagttgttaaagattaaataatatatgtaaatgccttggcataagggactggcacaaagtaggcacttcatatataaaagctgtgattattgatgaaccagtagtgaggtacataactggggaaggagaaggggccagtttgtgggaatgcttttttagttattaatagtaaggtggtaaaataataatagtaataataaccaaaagttactgaaaactaaatacagtgctaaactctttaaaaggagtatctaattggatcttaacaacaaagctatgaagcaggactaatgttatctcattttataaatgaggaaatgtaagatcaaacaggttaagaaactttcccaagttgatcagtagcaaagacaggattcgaaccaaggtaattgtcctatcagaaactgtactaggatagtctgcatttcatggtaaagactatcagatgccactaaaactttttaaaaagggaagtcttgtggtcaaatttgctctttagaaggcagtatggagtgcagatcagatgctggcagcagggagatcagttagaagatggttgctctaattcagttgagaaatactgagacatctgaaatattgaagacatcagtagtgtgggtgatgtgaaagtggttctaagaaactagcggcaatcatccttcattactgattgggcgtggagagaaagagaggtagcattggtagccgttagtcaactctgagtgcaggcactggcatgtgcattattacccagggctctaagtggagaaagaaaacaaccccagggtgtcttcaaacctaaagcatatttcctaagcctttgcactctcagtctagactaaaaacaaacaaagcagcctcctctgaaatgctggaaactttccccacttgaaactctcagatctcttaccttgcaattctagctttcaaattccaagctgagcttcctttcccacaccccgagtccttgtactggggattacaatgatcatttgtatgtactaggtgattgttccttccacatcaggggccttggagcggatgacctaaagctgctttctcctgtcctgactttctccacccagcactgcaaccatacatacaattttctggtcttgtagagaatgactgactggtcattatagtcttccaaaaggataagagattagtgtcatgatgtggccttcaggcagccagggggaatctccatatgaggtacttgttgactgtattacttagttttaggtgaacttcctgtggagggacaatatgtgcttagaaggacagagaaggaatgtattaggtaaggcattctacatctcagataaagaacttcaatgaattgttgggtcaaggtctaagaaacaaaccagccgtcaatgggaaagttaactaaaatgaagaacccaacatacaaccccaaatcctagtttttctgactatgttttcttaaactgaaataatttctgagattaaaaagaagttgctgtgactttgtctgatagatgtatttttttgttatatattagtttgggccttctatctctcctactttgttttctttataatagaattaatctctgaaaagtaactttactgtattctgatgctccattttgaataagtcagttcttctccgaatgggctctggagattggcatttgattgaacagcttttgtgtattgattgttttaggtagactgggtactccatttaacttagtatttctgacaataaatcagtcgagaagggagtattactctaacggtttgaacacttgtctatgcacattgcttggtcattcaataagtagttattggtgagatcgggcacgttcagggtggtatggccatagacaataaatggttacgactctgccttcagctgtaccagtatttaagttataaggtagttaagttacaccagtgcaaaatcatacagtttggtcacagtcctacttgaggatctcaaacctagctccccttaacaaacatggaggcttaatcttggctttgcacactgaattattcctttagaaaaatacttggtgtacaactcatccttttcatttacaaagaaacaaatttgagcagtttcacaatttaaaaagtctcccaaatggattatatttaattgtccatttccaatgaaactcactaaattggtaaatagcagtgagtgaataactgatgaggtcatactttcttgttttggactactacaaacaccacggagcaacaacagattagaatataaaggttaagcaagggtttagtttttgttcaaaagccgttttgcttgttacaaaggctaccaaacctttgaacatcagaccaaaccaaaaacaaaacaaaacaaaataaaaaaaaccccaaaactgaaagatgaaaacatagtttgataatctaagctgctcttcctttatttaaccttgaatttatgagattatttttttccccagaagaaaaattctcttagggacactttcagcaatttaacattttctaagcattacagcaaataagaggcgatcatcattcttcagtcataaagataagccaaggaatgaaagtgttttgcaggtcatgtcacctgacagaaactttggactggtcctttcctggttcaagagttcagccataatacctactttccctatcagctggctcaagctgataaggtcctgaagcaagcaaagcttctttatgagcttttatttaattgtccttgccacataagggttgaggggattcgtctgtacagagttacttcttgttggtctattttttctttggaataaatcgctgtctcccctgactggatagagtaaatagagtttgtttaaacacttttcatcaaattcctagtgcctagtacagagcttttaaccctaatacgtttcctgcgtgtacttattgaaggaataatgacaaactctgccttagattggtgactggctagggagaaacatggttcaagagctgaataagtaagagcaagtattttattgtatgcccatcaaatgtattcgatgctggtgatggaggtaagagtgtgatagaggctgagttctctgaaattacatatgagatgtcatctgccatttagtattagctgtgtctgtcttttttccaggaatttggccttaaaagagatcattcaaaagtattacccaaatagtgatttatcaggctttattgtggggaacctaaagtggattgcaactgctatggtccctttgaagggagctggtgcaagattttccatgcctaatcacactcattttcccttgctctcccaatgacctcccatctttccttctatttggtctgataaacaccaacaataggatcctttctgcagcttccatcctaacttgtattctagccttaacactgcaacaaactcactgttacctagaagtcaattgacttccctgaatgttagcttctttagctgtaaataagtaattgtatgaggtgatggttaaggtgatttactaattttacaattctattattttatgaatagaccctagttaggatagtttgaaatagatacttaatccactattattctctcttctaagatatagttactagttgatcatacttttccttaaaggctgaactgaattctctgatatcagcaactaaacatctcatatttgtcagtatgaacatccactgggtgcctgttatttaaccaggtagaattcttagctgtgattgaaaatctaggtatctcttctggtactatcacttggatgagtaaagtttgaaaaccattaagttgacatttctaataggactgtggatttaacatagattcccagaagtcttggaatacaacagtgtacacagatgaagatacagtactttttggtattttctttttgcaagtgttacaaatatctgcatgtcataacatcatcactatggatcccatcttttaatgagagcttagtatatgctacacactgtcactaaacatgtaggatcttgtttagttttctcaaaatgttgtagttactatgattattttttgtgtcttgcaatcattgtgtataagtgcgtaaaccatgtatctagagtttatagaagaattaaaattcaaaaaccctatactcatctctcatttttaaaaaataccattttacctgtctttagatgccctgtatttcctccccaatctcatcccgctcctactcttgaaagtgatcactatccaaattttgtgccaaacattaacttgttttctttagctttgccatctatgtatgtatccctaggtaatacatggcttagttacacttgtttttaaatttgatgtaaatgtaatcctatagtatgaattttctaagacttgattaatctatgaacattttattttgagattcatcaatattgatgtgtgtagctatagtttattcattgctgttgctgaaaaatattctattggatgactttgctacaatttattctaccattgttggatatttgagttgttcccattttatttatttattttatttttttgctgttatgaacaatgtggctttgaacattcttatactacctggcgtgtatatgtatgtatctgtctgtctgttcatcttaagatgcactacaaaactgaggcctagagtcaccaagcaacttgtttaatgtcagagtgagttggtggtgaggccaaagtctgaattcagcagtctgttaccatagttttcatccttaaccacaatactctatgaatccttattttaaaaaggaaggtctggagaatttaaaataacttcctaaagagcagggattcaacaaagctcagtctgactaatgccttccatttttaaaaaatcacccaaagcacatattatgattctatttgtgaagtattagctaattacaagagaatgagttcatacttggcactactatctctttcttacaagtgatcagatgtcaaaatgtgaaaactatacatttcacattatccatatatatgtgacatttttcctttaggaatatgagtagaaatagaaagacaggtttttacagtgaaatagattttttttctctctctttagcctaccaaatctctttcgcaatacctaacacttataaatgcatttaatttcagtgccaattaaagaaattcgaaagtagataataagtgagacaagcacccagtaaatgtttatgatgtgacactgacaaattatgggctgctataatcaagatagcattaaaaattttaaagtgtttgtatgaacaaaccattttggaaggagtgtttggtgtggcagtgagcaaaacaacccagtaactatggcagttagtgttaaagctctgattttgacatgaaaggaataaaaatggaagtccagctaaatcacaagtgtcctggagaaacttggatgagtttcttggctagaggtttttcccaccacagtaagtattttcaaaggaaaacaaagtaaaatttttctcttgtatgagtcacatctctgttggttgtaagtggctgaaactcatcttgaactaccaaggtaagagaagaaacatactggttaatggaattccagaaaggactgaacaatcaaaccattttgaaggacagcatagagctggactctagaacagccaaaacaaggggttaaaccactgcgagggatctctctccaactcttgctcaggcttttctccctggcttgactttcttctctttcactgtagattggcttctctcacatggcaagaaacattgctgctagcacttcccgagttctacgttctacaacatccaccactggtgagagattaacttatggtttttctgttgaaaagtcaaaaattacctgggaaaagtctgattgtctcagattggagatgttgcccatctctggaccaatacactattatgtgtggctgactatataaaaacatggatattttcttggaatcacttggtttgactgggagaagaccattctcaaaacaaaggaagtgcaatttatagaaggtagtagaataggcagataaaacaataattcttcactatattgctcaaataatccccatgacatttttagtatattataaagagagttctaaagtgtttccaaactattatagcaaaatttaatcttataataatttcttcttgaactatgtataatttacctgaaatattttccaaaaagcaatcaatgtgagaaaatgagagccctgtcttcttaaaaaaatgagtaaaagtccacaagttcagaacaaaagaaaatgaggtaaggcctaaaataaattgtgctaagaaagctaaaattctagacaaagtcacatcggcaaaactagaaggttggtactgtgcttcagtttactgcttgctgtttggttaagaggaggggtgatgtgataaaaatagtgacgaagtgagaaaactgacgtattagttttctattgcattataacaagtcaccacaaacttagaggtttgaaataacgcccatgtattatctcgcagttcctgtgtgtcagacctccaggcactgcgtggctcggctgggttctctgcttagaatctcacaggtcaaaatcaaagtatcaatgggagctgcagttctcccaagctggagcctgtgtcccttttaaactctcaggctgctggcataatttatttccttatcaagccatccatatgatcccctccatcttcaggccagcaatggcctgtcaaatccttctcattctttgaaaatctctgacttccctttctgtcacagctctgtaacttcttttctcttctgccaccagcagaagaggcttttaagagtttatgggattagattacatccgtctggataatcttttacttaaaggtcaactatgctatataacatagccaatcacattcgcacattgcagagactagggtataaaatcttcggggtcattcctagaaattctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattggggatacgaagctctacacacttgaagatggtgaaggaatataaaaatgtaagtattgcttttataataaatgtgttcctattggctgaaaatttcaatatctgatacaaatagtcaactttctattttactttttctaattatgcaagaccttgtaatcacaaatgtaaaaattgcaagccacatgcccctaaggccaaataaaaatttgtaaaattctcttaaaaagactctatagagtccaaatgaaaatacgtcgagtccttttaaaaggatccaaccacatatatcaactgatatacatggtaccaaaaacaatggaatcttttcagattctctaattggcctttggaacttatgtagcatcaggtatgcaaatgaacaacttcagaccttgattactccaacctcctctcccactgtcacagccacttctgtcatgacctagttgttctcagaaagttccctcttatacctggtcaaacttctcttacaatcacctgtgactttccctcttggtcttggatcaaatcatcctaaatacattaaaagtcctgattcttcctgtcccttaaatatatctctacttgaatcactgtgttagttcaggtcctctgagagaaagatgttaagatgaaattagatgtgcaagagattcgccgaggtaaaccttgtgggagaaaatggagaggtacatagaggagcctgggcagactgtgtggctactatgtaagactcatccccatgaaggagaaaggagaggaaggcaaagaagaaaaaccttaagatttcaattctaagaacgttttgacaaagctgattaggagtatttaaggcaaagctgcccaccagaagagtactgcatctttcaggaacggacttgctttagtacatctgctgtgcttagtaattggctgggagcagccatagaaagcatggactcagtacaaacttggtgatgaatttcagaggcagcggctaagaccatcagtctattattttccttgcaatagctgtcataattactatcagagcaaacaattttttgtgtgtgaattcatgagataatggtcttttctttcctgctttcaagagccatgtcattgaaagagctaatcattcaaatttatgctgcattactgactaaatactttcatttatcatactttattttaaaatactttaactcatggcccgatgattttcagttaaccaaattctcccttactatcctggttgccccttctgtcttttccttagaaatgttattgtagtatttgcaagatggcctgaatcctgaaccccccatcttcaatgagcaccaaatggtaattatagattcccagctgtagagctatgtcagacaaaggaaacttcattagtatgtaccaatgtttggactccaaatgcttttgtgtctgagtcacaaggactcctcttccttggtggcttaaagttaggctgaagaagatttacattatgttgtgcatgacctctttagtttggttctacttatactttcaaggagggaagactggggaaggtgtcccttagtgagcatattttgtacaaatgaaaacagggtactaacacttatgccaggacgcatgcataaactaggatggttctgagaaaactgcgatatatgatcactccagggtctcccctctcagaagcgagggagacttaaaccttttacatcaccaagtacatggaaagaaagacagcagggaagtgattccgaagagaaacctgaaaaaagcaatgtggaaagatagacactttagccttttctttcttctcaaaacttcacattccttttcactctgcttcacttaagctgccctagttccagagtgtttcctctcttgggtgaagatgggaacaagtacatggggtagcaaggggtgggtgggacctgtgctcccattaaggttcttccagaatcatttctatgtgattatcagcttggatcacatggacttggggattattggtggttttctagggtaaacagggcatattgtgctggaggacatattttatatgtaacaatttggggaaattttcttttatattaaataaaactgagatatgtaatgaattaggatgaaaaattcatattcatctgaattttataagtgaatcatgagaactcaaagatacttagcccttgggaccattttttactcctgttcggatcccttcagctaagcatgattatttactattttcagctattagttatgtcttgttgaaaaagtatgaaaagagctgcccaataaattagagtgtatgctcaacattctcttagcttctttatctctttccaaaattggatcaaatgacattggacatgatcaacttcttactgttttgacaaacatctgaggatacttttataattgataatttggactagattatgcaatgtgtgatgagacacaaggtagtctgtactccccatgatatgtatatctgtttgatatactcaaacggtgtatatcaaacggatataagtttgagtaggtatggagatgagccagggtttatttcttcaactagtatttactgaatggtcttatgtgccacaactgttctggaaactgtgatacattaattaacagataaagcctttccctcacaatgcataacagacccaacagagtatgaatgtacatacaaactagtaaataagaaaacaaataaaagtattcagatagtgctataactactgggatgaaaatcgagcaggaaggaaaatatagcctgcttgatgtggaagacagggatagcctctctgaggaggtgacatttgacccaagacctaaatgaggagaaggagacagtgagatgaaaatgagggaaacagcaatggcaaatacagagaacttgagacaacttggcccattggagggacagagacaaagccaatgtgggaccacaggggatgaaagggaggctgattggagaaataggcagtgctgaggccataaaaggtcctataggtcatggaaagacatttggttaccattctaatgacagtgagatgttactggggagttttaaactggagaatgtcataactgtccagatgtaaccaaatagtaaaaccattcttcctgaataacttggctaaaaggaatattatgactacagatgtacatgaagattaagcagaacatggaagaaaggcctcaagtaaacttgacctcacataaatatgggaggaagatcaaatggaagctgggagtgttgaaagaatgtaaggggaatgacttctaataatgaacaaaaagctgttattttattatgaagaaaaatgttatgcatcttatgcatgcagaagaaattcccattcaaaagacttggaaaatgtcttgggtgtttactataataaaccttttaagatatagaaaattcacatatttagagcttaatttctaaagagctcagacttctcagtttattatatgctatgaaattttgtttatttttaatttaacctacttgtgtgcaaaatcaataaggaagcttaaggaatataaacaactatttaacatggccatttaaatagattcaaagtaaagaatatcagcatagtgtttctttgatatgacaacccctcctcccagggcacttaaatgaagggttgggggggaatcttaacctgaaattgaaaaccctgaaatcatgtttccaaggaaggagaaggaaaataggaaaaacaaaaacaaaaagcagcaactcatttggaagctcgtgggagaggagaggaggattcatacatctcggactggtttgccttagcaagtgaatcatttaaataggaaaaaacagggggctgactcagcttgagcaaactcttgctatcccctgctgaggtccgcacttgctgtggcccctgccgctctcctcggaccttgctgccctcctcctttgtcactgtggagaaacaggaaggaatgtttattagcaagactgactggggtcacacccaaggcaatatcaggtttttacctctcccaggcctgggaagaggttcaaggatcaaggacaagctcccggttagagtgagaggcaagttcaaacctttgaaaaataaactcacaaccagcatttggcacaggcctctggagtttacagaatgtatctgcctgtgtgtgatttcattagttcctcctgccaatctaatgagattttacgtcctgtaacagtgaggcaattggagtctcagcagggaaaggaacttgcctaaaactgcaggatgggtagcgcttggatcctgactttctgactcctaggactgtgctgtcttcagatgatcacatgccttcttggcagatgtttctaacaaaggagagagttgcccagggtggggctctgctagctcccttgtcatgagccattctctccacattgccttttagttgcaccacatagtcaccttcaattagctgtgcgaataggctcactcttatgctaacatgtactaaaagtgaaaatggggagagagagagagagagagaaagagagacacacagagagagagactcatattatggtatgttccctgccccaccccactccactccctctcaacagggagaaagtacctgaagaaaatcattgctatgaagggcatagccagctaaatgggtgtcacttagtctgaaaaatctcaaagatgtcaataagccactcgagacaacaaggaacctgttttcctgtcatcattccttctcagtccttggctttgggaagggtaactttatggagagagaagaacctctgtggagttaaaaggtttatgaacttttttccctgcaacaaatcagtgacagctgttccacaggctgatggttttccctttacctttcgttttttaacagctatgtctcacagtccagacttggagtacaagtaataagaagaataaaacttaatcccttaagtagattcaccataagttagctcagagcaattccagtgcaagtatggtctgtgatccagtaggtgagtgactctgctgctgaaattcacatgtatgtgaatttcacagtggcctttgctttgtagcatgctgtaatccttttgtccattttcatcacacgaactgctgaatataggattgttaaatggatggggagatatcatgaaaatgattaaagaagaaagttcttatttaggggtgcatacctgcctatctgaccattgtacttaggcaatcgggatcttgctttaagaaaaggtaggcattggagtcaggctgctggagtatgaatcactatgctatcatttttcatttgtttttgctctgttacattaggaaagttatgtagaattttgtgcctcagtttcctcattcaatatgggtgtaataactgtgcctgtcttgtaggattattgtgaggcccaagtgcaataatatatagtacactgtgtctggcatctagtaagcattcattaagatgacatgaagataacacagatatatcttaacatgtaattatgattttgcttattcaaggccaagcattccaatttaatggagttaggcaaacacagtaaattcattgctctttcctttttatgctacttcctttgaagaggcagtcaagttccatttgactgattcggaactttttagcaatgtatattatgctgacttcactcttatgcgctcttggggctataattcatcaagttaggcgagcaaagaagtgtgttggtgaaagagaaatgaggaagaacaaggaagaaaaaaagggtcatgagcttattcactgccaatatttattatatggaacaatgaccatccttcagaagtgtttgttctctattatactgtaggtgtggaagaattatcattgctcaatagctgtctcagtcactacctgatagacttgggaggtctggctatttcagggcgcatttgacatacagtgacatttttggattaaagctttcatgatgagtgccagtctgggtccaaaagggttgaaagctgtcgccatctataggctagttgtttgtagtaaaatactttccctcactgcattaggttcttggtaccatttatctagcagagttcttcagtgggcttgaggcttagcagtcaagttaaaacaataaccaacatcccaaacccagtggctgtcaaatttcagtgaggtggcatagaactttagcatgaacttgagcttgggttcagctagactttcatataaatccttgtttgaagttagtagctgtgtgatcttgggcactgatattaaacctttatgagaaagttatgtctgaaatatgggaaataaaccttccacttaggttgttgtgaagattcaatgagttgtaacgattgtatacactataatgatctatattacagttgtttcataaatatgattgccttcattttattctttccttgtctcgttcttcccagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagtaagtgctttgtaaaatgtcaggggctccaggattatatggtattactgtcactattgtaagcacttctaccttttttttctccttttacaggttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatccccatgttacatatgaagagacagaagcataaagaagttgcaccgctggtaattggctgggatttgaacttaagcagtctaaccttagagtaatgattttaacaactatgctatatacatacaaatttacaaaataaaactgggctcagacaataaaaacagctctcttttcatgttataatactttttcaccccataacacataatcactaatgttttaaagatcaaaacaatgcacataaaatgtactggttttaaaaaaaagaggaaatagccacttacctcaaccaaactaacttggagatagattagattgataatggcaagggtgatgggtagatgggtagaggttgctcaaaaagaaacacaaaatatatcctcttttaaggatcctgatgctttgctcaaagtaatttttattcttttaaaactaaaaaaaaactgtacaaaattcatagggtacatagtggcgctttgatatatataatgtatagtgatcagatcagggtaattcgcatacccagtcatcctatagtgggtatagaacaccagaacttattctttctatgtagctataattttgtatcctttaacaattctctccctatccctcccttccccctacttttcctagcttctagtatcctctgttctactttttacttctatgaaatcaactttttcagcttctgtatgtgagtgagaacatgcggtgtttagtaggaaatttctgttcctggcttatttcacttaacacagtgtcctccaagagcatccatccaggattttattgctttttatggcttaatagtatttcattgtgtatatataccatattttctttgtccattcctttgtttttggatgcctggattgattctataacttggctattgtgaatagtactgcaataaacatggtctgtagatgtctctttgatataatgattttctttcctttggataaattgctagtaatgggattgctcaatcataccatagtactattcgtagttttttgaggaacctccattctgtcctccatagtggttgtactagtttacgttcccaccaacagtgtataagaattcccttttctccaaatccctgccagcatttgttatttttttttttttgtctctttgacaatagtcatcctaactggggtgagatgatacctcattgcagcttcaattcacatctccctgatgattagggatgttgagcattttttcatatatttattggccatttgtatgtgttcttttgagaaacgtctgttcagatcattttcctactctttaattagattgtttttactgttgagatgtttgagtcccttatatattctagatattaatctcttgtcagatgagtagtttgcaaatattttcttccattctgtagtttgtatattcactctgttgattacttcctttgctgtacaaaagctatttggattgatataatcccatttgtgtattttgtttgtgttacctatgtttttaaggtattattcagaaaatttttgcccagaccaaggtcctgaagcatttcttctatgttttcttctagtaattctatttttcatgtcttacatttaggtttttgatccattttgcaatgatatttatatagggtgagagacgggaatctagtttaattcttctgcatatagatatccagttttcccagcaccattcgttgaggagactgtcctttacccactgagtgttcttgatatctttgttaaaaatcaggtggttgtagatatgtggattaatttctgggttctctattctgttctattgatctatgtgtctgtttttataccagtaccatgctattttgtttactatagctttgtagtatactttgatgtctggtagtgtgataactccagctttgttctttttgcttaggattgctttggctgtttggggtcttttgtggttccatataaattttagaatttttttttctatttctgtgaagaacgtcattagtattttgatagggattgcattgaatctataggttgctttgggcagcagatatctttccatttgtttatgtccttttccatttctttcatcagtattttgtagttttagttgcagaggtctttcacctccttggttacatttattccttggtattttattgttttcgtagctattgtaaatgggattgccttcttgattgctttttcagctagttcattgttcatgtatagaaatactactgatttttgtatattgatatcgtattctgcaactttacagaatttgttattagctctgagttttttggtagagtcattagatttttctgtatataaaatcatgtcatctgcaaacaggaacaatttgacttcctcctttccaatttggatgtcctttatttctttgtcttgcctagttgcttgggctaggacttccattactgtgttgaataagaatgttaagagtgggcatccttgtcttgtttcagttcttagaggaaatgctagtgtagctgaggagagaaatgaaaacagaataaaaacttcagtagaagttggggagaaatgtgtttgcaccaaaagaggtgagggatggaactgagggaggtctcgaggggtaagagaggccaaagagctggcaggtgctgctattaggatggccaatgatccagaagtaatgatgaatgagaagatggattaaaaaaaccctgacattgtttaactagaagaagaagacagtcagagagaagtgagggcttacttttcatgtttaaagtctgttatgtggtaaagggattagatttatctgtgttgttccaggggacagaaataggacaaatggatgcaaatagagtgaggaagatttaaaacaaatggagaagacattctaaaatcaactacaatgagcgtaaacaatgacaacggaaaggactatttttgcaattatgtagctcttgttctctatagatagatgtgtaagcagacgctgaataaccatttactgaaaatataaataaaaacaaagcaaattgcaggcaataaatattgtattagttctcattttgtaaaacttatacaggtatcatatgcatagacaaatacaccaaactgatgaatatttgccttgtataatctttttgtagtttttttatgaacatatattactcaaacaatttagaacatttggcaatatatatatatttcatttataaaaggttaggaagattaattacactttctgaggtcgcaactaaaagccaagattttaatccatttctatttgatgtaaagtctggtcttttttcagcaaaccacaatcccacattttaagggcattaagaaagggatgggtagacaaaatgtagaggtagtaggtacagaatacaaagtttcaagaaattaaaagcttctaaactaacaaacagccaatttgtggagtgtcactggaaagtgacaaagaggacagttaagttagttggaactgaactgaggccagacagggctgtgggacaagtcagggtgtggtcattccggtaagcagcgatgcagaatcaagacagagtagtttctccttctctctctctctttaattgtaacgccttttataacaaacaaatattatgcttatttctgtctttaaattttttgtagtaatttctcatcacttaacctctattttttaaaaaactaacttttctcttgtttttctagttgagctatcattcatatttattatgtggaactagaggtagtcctggctacttgggaacagcgtggagtctagccatgtcagggccagaagtcgtctcagctaagttagaatgtgataccattgtttacacaagtgtggcctgccttcaagatagggtgaggtgttttatgaccacaggctttatgagttatagctataaaacaatcaatcttttaaagcaaacacaccacaatgtctacacgcaaatgagaattgtccttcagggctgtgaccttgggaaactcttcacacatactagcataaaacatatttaaactcttcactgaaaatattattcagacctagtttctctctcagtctctctctatgtttctctctcacatgtacgtgcatgcacgcacacgtgtgcacacacacatatgctcacatcattttaagatacatctcatttttaaccaaaaccattttatcttgcttgataaccaattttatttgttagatgacttggctataaatgcctttggctatcaggaaaatcaaatcaaaattaaaagacactgttactactgaagaagtaaaaaaagaatgggctgctgactctgaagatcatacccgaagtagagctgcaaagatatttggaatattggtaatatccaataaagaatgaccttcatgctattttgaggagatgtttaaatgtcgaattattgaaatatttataaaatacaaataaactaactctgcttcatattccaacttgtgtatgacacttcttaggctatcatttcattccaaatttatggtcactaccctactgtcattcctcatactaaccatatgatcaacagttgaaaagcagccactcgcagaggtaagcaagatatatggtaaatactgtgttgacaaaagtatgcagaagcagtcacatttatacagtagtgaaggaaatgtaaattggacaaactttttggaagataagttgagaatgtcaaaaatcaaaacacactttctgttttattcagcaattatgagccctttgttttacagctatgctcacaaatatatacaaacatgtatgcacaattatgttcactgtggtattgcgctagaaaaatactaaaaacaaaccaaatgttcatcaatagggaaattgttcaacaaattacagtatatctaaaaaaagaataatatataacaactgaaaaaataaaatagttgatataagcagatattccaagatctgccagacatattgttaaacgaaaaatctagatacaaaattgtttatagttctctttcatactatagccaaagaaaattcagaaaaaactacttacagttgatccttgaataatgcagcaggtaggggcaccagcttcctgcgcagtcaagaattgcatataacttttgactcccccaaaactttgctaatagcctactgttgactggaagccttatcaacaacatcaacagttgattaacactggaaaaggaggggttggtcttactgtctcaagggtggcaaaggcggaagaaaagccacctataagtgaacccttgaagttccaacctatgtttttccagggcaatcatacatccatgtccatattcatgatgaatatgtgaaagggtacataagaaaatgtgatagtcgtttcctctggagaataaaatgagaggtctatcataggtgagaaaataattttttattatatattcttttgtaggtttatttttttgtcatgtgtatgtattcttttcaaaataataaaaacaataacaacgattaaaatatacaaggggaaatgcattggccaaggtttagttgagagcaaagtttgcttatctttcgaaagaggtgaactaagcttttcctttttctctttgggtatacttgaatggggatggagtaagtggattctttttttttttttttttttttgagacggagtctcgctcgcccaggccgactgcagtggcgctatctcggctcactgcaaactccgcctccggagttcacgccattctcctgcctcagcctcccgagtagctgggactacaggcgcccgccactgcacccggctaattttttgtatttttagtagagacggggtttcaccatgttagccaggatggcctggatctcctgacctcgtgatcagcccgcctcggcctcccaaagtgctgggattacaggcgtgagaagtgagtgaattctaaggagtatcgagaacagtgattaaaacagaaggtggggaggtgtcataagcttatttgtaggtgaagtattaagactagaagaatgacattatgcatcaaatcttttacattgtttgatctcttttacctaaaaacaaaacaagatacttttttgttgtttgacatatgaccaattagcagccagttggagctaaatgttttcttttttctttttcttttctttttttagatgtagtgtcactctgtcgcccaggctggagtgcagtggcgtgatctcggctcactgcaacctctgctacccaggttcaagcgattctcctgcctcagcctcccaaggagctgggattgcaggcacctgccaccacgcccagctaatttttgtagttttggtagagatggtgtttcaccattttggccaggctggtcttaaactcctgaccttgtgatccacctgccttcgcctcccaaagtgctggtattacaggcatgagccactgtgcccagcctaaatgttttctttaaaagcaaggtaagtatgcctagatgcactgcctcttagtaatttttgaggatggattattcattaaattgcttccctttctcacagctggtgaattagaacgatagtgagcttacaagagctttaacgaggaaaagatggtcattgtttaacagagaaggatggtttgggtgagcatttttgtgtttttggaggggaactttgagggcaatgagtgttgcacctgtgtccactgaggatctctgggcggggtaaaaggaaggcagggatgagagtgaggaagggagacaggagggtcccaaatacgaactttgacttaacgaggatgattactagaagggaaagattgtggattcattgatgagatgttgaaccatgaaaactctaattgtagaactcacttcagactgaattgacttggctttcagtagcagaagccctttgtctacttctctagtattgaagtgaatgcaaatttctcaatgtaagaaaagtagagtggtgaaataagagtgtgggttccagggtcagacaactgggtgcataaaaagggtaaggatgctacaactggtaagccctgtgagaattatttaatccttccatgtctcattccgctcatctggaaaatgatgatcatactaacttatgagatgtgtgtacagactagatataatattaaaacatttctgatacctatgcattatattggatcaatatatatttgcaataaatgatcaactttttattaatgaagttagtacttatttcataacgagattgtttacttctaatttactagtattgtcattattactgttgctgttatactgctactgctgttgctactaactctttatgaagtacctaatatgctctaagccttgctctaggtgttgtatatgaagtatttctaaacctgaaaactatctaagatggctcagtctagcccattttatagacgaagactgaagccaagagagttgaaataatgagtaaagttgagatttgactttgtcttccaaacaactagaagcataaagcaatggaccaggttccaaagtgacagggaggggcattagtttggcccataggctgcagagcctgtgaccacagagccctatatattccagtggtgaattatgtttgggaatgtggcagaccatatggctatggcatcgttagacatgaggtggagagaggcagatgtgtggttactcgattgagttgagagatgccatggaaaggaggaagaagagcctgagagagcaacttcactcatggggagagaagcttatgtggagataagcttcacttcactaatggggagataagcttcacttatggggagacaagtaaggaagcagggatctccagaggatgtggagtatgcctggtactttcattgttctttttccttattcttctttattcttttcattattttacctaggttagatgttaaacacttcctgttgtttagtcaggcttccttttctaattataagactaaacactaagatttcatttgtagatataattattagagaattttgataaaatttccaagcagtgttccctctgtttatcatcgtgttccctgctgttattagttcacagtttggtctggaattactccagttaatcttggggtttcaggagagaaattgtgctcagggtacatgagaagagaaagtttagaaagcgaagggcttccctgtctagtttctagctcagaaaagcaaagatattctactttcatatgtatgataattggagctgagctgactttaaaaacagataatttttcttttttatccctaataaataatggtgcttacagcaatgagtgttgctggtaacagattccaccaatgggtgtggtgtgaagtttagcatttgtggattttgcagcttctgctattgtctacagcatttcctctcttgtctcggaggttcatactttctcaggcaaggacacttttaactccagataaatgtctgggttttctcactccaaggataagaaggtgggggtgatggagtggtggtggtagttgtggagttgtcttcctggcagggatttcattgtgggggaaagtctgtctttagaaaagaaatgtaaactgggcaagtagtctcatcagttaaatgatttccttgttgacataaggtgaggaaaagaagaacaacttttgggaaaagtaactgtgagaatacaagggaagaagaaaaataaggggttgaacattgaggaagacttatgagacagataaagtataaaggcaggtaatttgttctttcaatttggcatggggacagtaaaaattttttcttactaaacaaataaagcccatgtatttcttctgctctgggagcaccaattatattgagcctctaaataaagaaagtcaacatccacaagtgttctaaattccatctcgtagtgagagtcctgaaaattgcaatagctagagtcaatacttggagtatatgcataagacgtggtgtctcaaataggattaaggcctactcttggcatcttctgttattggtgttgtttctctgtattgattggtataacgttagacaaaactgcaggtcatctttgagaaaaactcagtataaacaatgaaaaaaatgtgtagctgcacatgtaatttgcatgtaacaaaaccaaaggatgctttagatagtaacagcagcctgtactttactccaacccattagttttatgataaatgtggtctggggaagtgctcgatctaggttgttcactttgtgtttttgtttctttctatcattcgggtgttgagtcacctgtttgtctgtgtcagtgtcagagcactgggtcacatcctgcattgtccaggttttattggtccctttcttaaattaaagctgattttccacttaaagagaattctgtctccttctgcaattgttcaaagtctagcatctcaagtgcagactctaaactgtatgtatatgtattgtgcaggctatctatcttcttagctttgaattctctagaaatattccagaggtgtgattcctctgttattcaagagtgatttccaaattgcctcagccaatgtgcctgcacaagttgtttgtaactcagggtgtaatgggaaatgctttagagccacatttgtggcttttgatgggaaaaaaaaaaaatcagtgtcctcctaagacttatacagtccttgaagccttttaggctattcctgcatctcatgttgcatccatacggactatttagccatattcaacaccatcctcttgctattttgttaagatttgactgttgttgttgttgtttttaaatataaatgtgtgatcacatgcacatacacagacaatgatgtgtaactcataaacatgaaaagtaaaaatttgaattttaactgaagaaaaatcagcattattcataaaaagctggtaagatattctaaaagtggaaattcatgcagaaaattgattcttaagcacttactaaatgccaggaatattttaccagcatattatcatttaatttttaaacaagtttgagagatagagatgtcttattttatagaagaggcaactggggttctgaaatgtgaaataacttgcaaaggctatggttaagggcagggccagccacgtgtctagtgtctctgacacctgagatcacacactgtatgctgggcttcaattaatttgcagctacttgttgcattaaattcacaatccttgctttcatcataataaaaacaataataatcatacaacacaactattttcagtgagctctggctaaggccatttgattcagagtcaaaaccttctatttgtatagtattttatattgtcaaaatctaataaggatagttttcatatctgacgtaaaccaaactgatctgtctccatttgatatagtgacatatcaaattgttactttcatatatcttagtcaacctctatgtttatcattctctatgttttagaaagtaaagaatttaaaattacttcagaaagatttcttcttcataaacataaaatgattagatgtcccttttaaaggcaacagcttcttctttttcttttttcttttctttttttttttttttttttttgagaaggagtctggctctgccgcccaggctggagtgcagtggcgccatctcgactcactgcaagctccacctcccgggtttaagccattctcctgcctcagcctcccgagtagctgggactgcaggcgcctgccactacgcctggctaatttttcgtatttttagtagagacggcgtttcaccgtgttagccaggatggtctggatctcctgacctcgtgatccgcccgccttggcctcccaaagtgctgggataacaggcgtgagccaccgcgcccggccaaggcaacagtttcttaatgagagagtagaaatgagaattcacattcataacaaagagtttattgtctttcctagtatactgtactatctagtagctaatctgtctaaagacatgtttcttatctattaatagtcctattaataatgtaaagtagctttagatatgccaagctgttactggctggggaactaaaaaagcttccagagttatatctagaaagtctttggggtttcttaatgttatgtgattagcaactaaaactgtgacaggaaggaagtccacatgaattgagcatctactagtttcaagatttatcattatgcacattacttataataactttgtgaagctgatattaactttacaatggataaaaagatagatgaattagtaatttacctccagtggtgcagacagcaggatttgaatttagtctgtccaacaccaaagcctccgtacttttcattaccctgcatccatctagtttaaaaaataaatgtactaggcatagtggcttgcacctgcaatcccagctgcttgggaggttgaggccagaggatcacttgagcccagaagttcaaggctgcagtgagttatgagcacacaactgcactccagcctgggtgatagacagaccccatctcaaaaaaaaaaaaaaaaaaaaaaaaagagagagagaaaataaaagaaaaatcgaatgtattgcatttcatgtctggaccacctgtatgagaaaattgggcactttctctctgaagtaactcatactaaaaacaaacaccttcttcctcccaggagcttcccaaggttgaagagaggaaccctgaagctctaatatgcctaagatgctctctggtgttatctaaaatcaaaatatatcacctagagcacttatttatttatttatttatttttgagatggagtctagctctatcacccaggctggagtgcaatggcatgatctcggctcactgcaacctccgcctcccaggttcaagccattctcctgcctcagcctctgggattataggtgcacgccaccatggccggctaatttttgtatttttagtagagatggggtttcaccatgttggtcaggctggtctcgaactcctgacctcgtgatccgcccaccttggcctcctgaagtgctgggattacaggcgtgagccaccacgcccggccagagcacttttttttcttaattttttatgatggaaaatttcaagcatacattaagtagagaaaatagtataatgaacaactgaatacttaaatctggcttcaataatttctaattttatgttctgtctaatgttgacataaagtatagtttgtatgtatttggtggtgagtacataatgggccacatgatttttaccttttaggctgtagttctacatcagtataagatggttgtttttttcttccaatacaaaatctaaagcgttgtcggcagtgacatttttaaaaacacaatatgagacgcaacaataaatcagttattaaaataagataaagtaggtatataaatatttcaccttggaaataaagcaaagtcagtggaagagtgtgaagactgtgaagattaggagcatgaaaataaacgactattgggagccattctattcccatgagtgaatgtgtattggttccattcaatgtagggaagagcagtaaaagggaataaccataaggataagaccactggattatctgagagccacagttgtcctttgccacatggagcatctgccctaggtattacagctctgtgagaaacagaggttcaaggaaagaaatttgttatttttcaattatctgcataaattctttggaacaggggcatggattataaaagatgtaagataataaaaagcatttgtatttgactttggaatgtattgtacttacatttgtctagaggtgtgtctattctggctattctctttaaaggagccattctatcgtgaacagatcctgttggagctgttttcttgttctaccaaccttcagccacctctctgtctttcatattacttattggcagggtttcaaaaggttttagtccttacttaatataaacaaaaatgtacaatattgacaaagtttcagttaagcagatgaaattctaagagttaagctgggattttccaaaataatcctgttaacagacttgaaagcacttatcagttctgtctaatgaagacattagaacaccataacctttccggcccattttctttgtcaataagcgttcttgccctgtcagcagctcacctccagctttagttttctcatgacagtaagtctattaccctcctgatctgtcttctggctcctcctacccaggatggggaaggtttttgactttactgatattctcagaacaaattttgggaagtaaatataaggttttccagtcgggtgcagtggctcacgcctatgatcccagcgctttgggaaaccaaggtgggtggatcacctgaggtcaggagtttgagaccagcttggccaataaggtgaaaccccatctctacaaaaattagttgggcgtggtggcggcacctgtaaatccagctactcaggaggctgaggcaagaggattgcttgaatctgggagccggaggttgaagtgaactgagattgggccactgcattctagcctgggcgacaagagtgaagctccatctcaaaaaaaaaaaaaaagatgaggttttccttaagagcactaacctagtatactgcacaggtgcctgtattcatgcatcccacacagaaagagaaaatacttgtctgaacttgtccataaattcagaatcctgccccttaacttgtatgccaggtttctggcatactcttatctgaaaactcactctattagaaaagcaaagcacagtgattttcccatcctgattacctggcactgttttttatttcagtgcttctgtttctttgccatgtaaatgcctgtgatttgccaggtcatttgtcctgattttagttgaaacagtgcagtcatcatacttgcagaatgatacaaaataatataaaatatattgcctttgtactaaacagaagtgcctctctgttggtgaaataatacatataaacaaaaataataattagtgatacttattgtgtgttcactatctactagcactgtattgagtgctttacctgcattgcttcattttctcctcacaatatccctattaggtaaattcagttataattcccattttacagatgggggcattgaggcttgatgaggttagttaacctgcttcatggtagtaaaagcagagcttggatttgagcacagcatgaatgactccagaacttacacacacacacccactcacacacatgcaaagagagagagagagagagagagacaactgctgaacatagacccaaggcaaaatatccttgagtagaggaacagtgtgagagtgaagctgtagtgctggttggggttaatcaggatgggctcactgggcaagaccaggttgtggggggcaaaggagatggaaaattgtgtgaagagaagaagggtggactaggtagataaaggtagtggactaggtaaataaaggtggtaattcagacatccactttaggcttcaaatcactttaggagaagtggtggtctattgctttgccctttagtagcaacatgcttattatacaatttaataagattctatccaatacactgttttaagggctcccatctcccggattagagctgagttctaacttccttttccaatgataatgatctgagaaatttccttcatgttgcactttttttttctgaagacttgacattgatggaaagaagtgaaacccacctatgcttttgattttggtgactaatattaattgtcatgtattactaatagtgaatctgcatttttaaagtcttgttggaaagcacattaggtgtgtatataaaggtattaaccttgaaagtatgaacgtgttttctataattagtcctatgataatttaaaatttaacatgtgcttgacacatttgataaaggctttgtctactatggttttatttatggttgttaattaagtaggagcagcagcatactacttgaaagtatgaaggtgtcctctatagttagtcctatgataatttaaaatttaacaggtacttgacacatttgataaaggctttgtctactatggttttattggaatagacaacttatcttttcttaaagtatattttaccttggtaccaggaaacttgagaccaaggtaaaatgtaatactttaaaaaatgcctaaataggaactgtcatatatagttatatttagggttgattcatattttgaaatatattctagaatataaaaactactatattttacaattactttaccaagctctctaataatacctgtttacctttaaaatcttggtctttcccacagaggacaagttattatatttttaattgttaagccttctgatcatatgaattcttttcatatttcattgaaattatataaaacattttacttcaaaggaaaaatgttatgaatttataatgcttttagaatttaaaaatctgtttcctattttgttgattaagacagagaagcattgcttgtgaataaatagcatgctatgttgaaaagaaaattaaggatcctgatgtttctctgccagataggacaaaaactaaggacgccacaggaatttttcaacatttttaacctcttgacaatatgtgggtcgtataaaggacaaatgaatgtttggatggactgagaatgccaattttaacagattgtccaatcactgtagataaatatttgtgttcctggggattatctgattattatcaagcaaattgaattggaaacatagcatgtattaagtcattactacttattgtctagttctttttctcatagaagtgtctatgtactagaagagcactaagtcatcagttagacatgatctttatcatatccagacaaaaataaaaaccttttaagaagctactttacaagacaactgcatagctttcttcacaggaacttgttaaataaataatgattattaaagcaattgggtcagtctcttacactaatttaacaagagcagttccaagatgtctagcccattccacattccgtgtgactaaccatggtatccagagcttggaaaatatccaggcaacccacagtagcttttcttaaatgcattatggacactggaatgtaaggaaagtgatagaactaggtgaacaagaagagagtctttaaggcatacccattgtcagtgtcgtaaatggcctcaattgtatgttgaacattgttcaaaagtacccatggctgaaacagtgtagatttagctcctatctgtattgaagttgataaatgcataaatcttaatcattgacatggaggtttattgtattcaatgagacagatatacttggagttttccacaaaccaccaataagagtctattgtgaattggaatgattagcttttaaagatgtatacatgttaaccacccttttatattaagttggtgcacaagtaattgtgctttcaacggcaaaaaccacaattacttgtgcaccaacctaatacttacagttatgccaagataggggtagaagcagaaggaaaatttagagtgagaagatagagacaagagatagggaggacaggaattgagtcaaacaaagattctggaaagtctgtgattaattctgtggttgttaattaagtaggagcagcagatattataaaactcaatatacaagtggtcaagttcaggaagagccaaggaggagaccagttgatattctaggtccatgtttcttgtaagcaaagtttggaaaccagaactttggatctgtttcaagagcccaaggtaagaggctttagaataaagtctaacccaggccaagaatctgggtaacagaaccagggatctcctagggcactagcactaactggtggccaaggcaagtacttctacatttcctgctttgagtccaaacttgtgaaaatttttagaaggcctgagcccacagatttattttttcatcaattcatatttattaggcacctatatgtgccaggcactgtattaggagcatggactattggtgatctcaatggacatattatccgtttttataaaggagatgtatcgtggaccagtaaataaagaagtgaacaaatagcactagaaggaaataaaaagggcaataaatcagataatctaggggagggtgttttagatagaatgatcagggaaagcctatccaaagaagtgatgtttgagaatgagaattaagtttgagaatgagcagatacatgaggagctggaaggaggacactccaaagtctaggccaagtggaaaggcttggaggggagaaaggccttggcatgttcaaggcttggaaggaagtggatttagacgctagcaagcagaaaagagagggtgtgacttggggcatagagaaattggtaagagccagatcaagcagtgggaggggaaaagccacttagctagagtaagggatggaccaagtactctgtagaacagatatgaaattattcagtgtttttatagctgtaaactggaaaatagattacagggacttaaaattctccctaagtactccatgcattgtgaagggtttactaatgaaatcttcttagagatggaaacatgaggcagaccattagtgctagatcatggtggtcatattagttctggggagtccagggttaaaaaaagtagcttcagggcaaagcattgcagttcaagagagtggtggtaatagccagagagttttgcctttggatgatgaaactggttggcaaatgacagtggagcagggtagtgaggcacccagggtgggctggtttgaaacagagcataatgtgagtgaacctgggatgcacatgaataataagatggaagaaacataaagcatcatccttcttaggatttcctttcttccacagagtcagctaagttataggtgccctgaggaggtcttccaaatggttaacagtatattatgctcttcctttgaatttttagtttgaaaatttgttaatagccaaacaatagtaatgatatccttaccactctttggattgaatgatgtcccccaccaaaccaaaacatcagttaagtcctaatccccagtagctcagaatgtggtcttatttggaaacagagtcattgcagatgacattagttaaatgaagatgaggtcatactggaatagcatgggccatttatccaacacgactggtgtctttacaagaagaggaaatttgaacacagtgggaagatggctgtataaagatacaaagatggctgcagtgagtcatggtcatgctactgcactccagactggacgacagagtgagaatttgtctcaaaggaaaagaaaaagaaaaaaaagctaggcatagtggttcatgcctgtaaccctagcactttgggaggttaaagttggaggatcacttgagcttaggagtttgagacaagcatgggcaacatagcaagaccccgtcttcgcaaaaaataaaactagccaggtgttgtggtgcatgcctgtagtcccagctactgaggtggctgaggtgggaggattgcctaagcccagcaggtcaaggttgcagtgaccagtgatctcaccactgcaatccagcctgggcaaaagagcaagaccctgtcaaaaaaagaaagaaagtagaaagaaagaaagagaaaaagaaaacaaaaagaaaaaagacagatacagagctgcagaaggagaatattatgtgaagaaggagacaaagattgaagtgatatatctattatcaaggaaatgctagggcatgatgcctgtcatcacaagctgggagatggcatggaacagattcttccttagggccttccaaaggaaccaccactgccacaccttgacctcagaattttagcctccagaactgtgatataataaatttctgtttaaagccacccagtgtgtggtactcattagggcagccgtagaaaaggaaaactaccccttcccattcctcttgtcgtattcttttccaccgttttgtctcacacactacaatcgatgaaaaccaaattgctttttctaccacttgtactctttcaacccagaatagcctcctcttttttttttttttttttttttgtctccagggacctattttaaaataagaaaaaagtttttaagcatagtacctgatagttttttaatcttcacccacacccaccccttccccataacttttttgattgattatgaaatatttcaagcaaacacagaaaataatatgacagtattcttctaaaatctacattcatcagattacaactttttgccatatttgcttcaaatcactccttttcaccctaaaaagaaaatattactgagagagagaaagtctcctctcttcatactttctttcacttcactgttcgcatccttaatttttatttatttatttttaattttttttttagagacagggtctctttttgttgtccaggctagagtgcagtggcacaatcatagctcactgcagcctcaaactccttggctcaagcaatcctcatgtctcagcctcctgagtagctgggactacaggtacatgccaccatgccccactccaattcttatttatttttaaagtggcatcactttgttagtaaagccttcccattatcactcagatttacttaactctatcacctattcccacaatattttatacacaaattatattacaggaatgatcatattgtattttaattgtagtcactttttctctataagaaaaaaatgacttggtcatttttaatcatctagtgcctatgcaatatctaactctgggttaaactgaattttaatataatagtgtttacatcgaaccgtttgaccttcaaaagagccctaagagtcaggactagaattgtcattctttattccagaaatggcaactttatgaattttacgtgtttaatgtggtcgattattgtttgtcactgttggtgaagtttacttccttgccctcctgatgttgggcttggccgtgtggtttgcttaggccagtggaaggcaggtggaagtgacaacatgtcagttccaaactgaggctgtaagaagttcacatatttctgctttcttctttgtgcttctgacattcaccgtgaaaacattccctgagtagctgttggtcccagaatgaagagacagatggagccaacctgaacccaacttgaaggctgaatgccaacaaacatagcaggatcacagcaaacctgaagtgaatgctcgctgatgtcagttaccaagatttggggtggtggttacccagcattagcatagttgaaacctcactaatacacctagatggttgataataaaggcagaactagaatacacgttatctgattagcaatatagtgtctttttactaaattattctgttattcatctgcacattcaacaagtatttaatcatatatttactgtagaaaacagcacatcattaaacagacagactgtggtctctgcccccaaggagaatatgtttctagtgagggaaagagatacaaattcataaatctaaactatagaaaatggcaaactctatagcacaaatgtcttttgagagagaataatgggtgaggggaaggaaaggagatgaatacctttaaggtggcaggggtagagctctttgagagactgcaaagcagagaagatgcttcaagaaaaagaagtacacatttctctccctggaatggtctcagtggtctcagataatggtttcagttttccatattcctttatttatgtagtgtcaggccaacagtgtactttagctccaggctaaccagttgtccttggtttgcatcccgtgtattcagaaagctattggattgttttgtaagttcttaaagaaggactgaaaaaggcttcattttccctttttccaaagggagcaattacatactgtcactggaataataaacttaagtcctaggctgcgaatgaaatttgatttctctcaggtgagaggtattttgtatatggaaagctaaggaaagaaatgcaatgttttttttttttttttttttttttagcaatccagtagggaactgtggccagcattgagctgataaagacctttgttttccatgttttgattggcccagtgagaagcctcgagcagtttgcacacccatctgtgtccatactggtggggcagaaaagtgctgacacaggattgcagattagcccctgcagcttgccagggtaaacttgtgtaatgcactgtacaccactcctaacaacagtggtccttttgtcacttaaacagaggttattaagaatatgagtcattaaaaagagctttagaaaagcaggcaacattttccaatacagtggctttaggggatctttggaaagtatcagaagttccggaagaagtaaagcatctcattaataactaacaatagacacagaatcaaaatctgaattgatgaaaaaaagtaatatttaaaatgtaatttttgaatgttgaaaagagcccatttttgtagagaattggatgaggattaacttagatattttcttgaatgtgtataaatattacatataagaatactttcaagtcttaaattggcccggggatctccagcttgctgataaaaacaaatcaaagaaactacctttaggacttctttttcttatttttgaaacattaaaaagttgcaagtgccggaataatggggaaaaagtctttattctattatccagacaaaaagctggtcaacattttaatgctgtttctgctggcatttttctctacaaatactttctatgtagttaagatcatatggtatatgtaatcttgtttcattcattttctttcacttttgttattccttattcagtgattggaaaactatggtttataggccaaatctggactactgctacacgtggaacacagccacatgcattcatttacatattgtgtatgactgctgtctctgtaccataatagaattgagggcggctacagagcttaagtgactcacaaagcctgaaatatttgctctctggacctttatagaaacagttttccagtttgtgagatagattattagagtcatatgaacacaatagaattttacaaaaatataccaaaagtttatacagccattgatactttaactagcattgtctgatgaaactgttttattgcctataacaatatatatggtaaatatatatggttatgcatatataaccatatatatgtaatagccagctatatatatatatgtataattttatatgtatacagttttggattttaatagacatagaatgttagtgtatctcttttttgctttaatatttatttctttgagtagcagttagacaaaatgattttccatttttttagttctttaattttctttatcttcaactgccttcttatgacgtttgcccctttttaaatagagggtttttttaaaaataaatttgtaagggctctatatagatgcggaataccaactcttattgtttttactttgactatattttctcagttttttaatcctttaatttgagagatttttttgaaacttgaaagttgtttaatcagtgtaaaatttcctctgtgattcctttccaagctccaatatatcatgctgaggaagtatcttatcatttttaattttttaaaaatttataaggattgatattttatgaaaggcctcttgagtgtctatttttaaaaacatactttgttcttagaatagttttggacttacagaaaaattgagaagatagtacaaagggttctcataaactccacagtgatttttccctgtcattaacatcattcattagcattttgtcattagtatctttcattagtattgtatgttcgttacaatcaattaactaagattgatgcattgtcattacctaaagtccatattttattagaattgtttaagtttttacctaatatactttttgttctggtatcttgtcctagataccaccattcaaccattcatttagttgttatgtctccttatgtttttcttggcttgttatattttctcatagttttttggtttttgatgaccttgacaattttaaggagtattgactaggcattttgtaaaactcctttctattagaattggtcactgtgagcagtccacattttaggaataggaagttttatttccccatcttgagggtgaagttgttgcataaacttttggggattcttctgcatgggagattttttctacttctccttttatttatttattcagtcatttagtatgagctcatagatattaattttatactttgggttataatctaatacttttttattattttgttgcttacatacttctagatttggccactgggagctctttcagttgacttccgtatttctttgacataccttggcaaatgtaggatttgtgtgtgtgtgtgtttattagcacatttttcatttctggcactacaagatcctccaggctcatcttgtttatttcctgtgccagtcctaggattagtcatttctacaatgtgccctgattccttt

SEQ ID NO: 616 - DNA, 40001 bp, Homo sapiens
agaggcaaactttgttcctgacttcttcttcatagctatgaaaagaattgtcttaatcattaagtttaacaaaccactgaaaatagtattaaaaaattgaagcacaagaattctgcaagactttcttatttagttcacaaaagtagccttccattcaaatattaatgttaccaaagtctattattgtagacatgtactacttactaattttattggaagccttaggaatttttctctaaacgatgctatacactcatttaattagaaatgtttgggttcatttgagaaatcaaagctcttgttagcacgtcttttgtgcaaagaacaacggcgtttataatagaatataaaattgtatacaagtcagttgagaaagtgtctacaaagatacataaacttaaaaggggcacatatgctctggattttccctgaaataaccacaaatgacatggacaaatgtgtataaaaaatacaaagatatttttaaaaccctgtctccactaaaaatacaaaaaactagccaggcgtggtggcatgcgcctatagtccaatctactagggaggccgaggcaggagaatcgtttgaacccgggaggcagagattgcagtgagccgagatcactccactgcactccagcctgagtaacagagtgagactccaccaaaaaaaaacaaaaaacaaaacaaatatatagcctttcacctgaaaaatcatctggttggataccttctttaaaatttcaggtcctctttctctaccagaagatgccttttctttcctctaaacctcaccaaacaagatcccttattgttatctgtcttcaagtattatattcttaagttttattcttctggaaataataatggcaccttcttcatctgagtgtctaccacagtaacaccaaacagtgaacactaaattctttttatcttatcattgtcttcttcataatcataatcatcaccaccaccaccatcatcatcgtcatcatagtcatctttattctcataaacctttcatttgtttgttcataagtctttcattttcaaagaattttcaaatgcttgttgaaaagggtaacacaacattttcaatcagattattaatttttaagaggataaagaatagcctgaggtacttagaaatacgtaataataaaatgtttcctgaacttaaggtgtttaaatttcataaaaacaagaactgaaaaacatatgcttatgggctttctgataggatttgcaaacatatggcttaattttcagtaattctttaccaatactccttgaggtatataagatttttctcttctaaatttccttctttaacaagtcacctaagatgaaggtatactaattgaggtataataatatgaaaagagtaaaactctccttataacctctttttttagccctcaaataccccactgatcctgtgttagtaaaaaaaatgctcatgcataaaagtacagtcaaataagtacagtacaaataagacactgtgttaatgttatatcttttaatctttaccatttagaaagatagatgttattgttttctatttatccaaggaaattaaaaaatcaaaaattttaaaaatctggagctacattcaaattcaagtttagtttttaatcctctctaaatcctcagtgaccaaagaatccaaatgttaagcaaaacaaaattaaaactaacataaaaattaaaacgtaggccaggtgcggtagctcacacctgtaatccaagcactttggggggcccagtagggcagatcacttgaggtcaggagtttgagaccagcctagccaacatggtgaaaacccatatctactaaagatacaaaaaattagctgggagtggtggcacatgcttgtaatcctagctactcaggaggctgaggcaggagaattgcttgaaccccgggaggcagaggttgcagtgagctgagatcacgccattgcactccagcctgggtgacaagagtgaaactccttctccaaaaaaataaaatgtaaaaatccatttatgcaattaaagcacaacataataaaatcttgggctttttaacctctttgcaatgtttggattaaacacataagatggaggtttaatatgatgaccaaatacatccatttcaaaacagataaagagttgtctctcagtaatcaaatgttaattgagtacacaaaatctatatagtaacaggtgtttgagattcagtagttagccatgcaatttcaattaaaagaggctacctaaaatttcatgatataggaagaagtgacaaatgtcaatttagtgtcatatcagaaatagcagcaatggcaacaaatatagctttaagaagcatgtgaaatcctgatgttctaaagcttccttatttgcttaagaatttaaacagtaaccttttactataattactcttgctccaaatttatgtccaacataaaataaaaactcttttacgtatcataagtcattgacctatgcctttatgcattcacatctcatgtaagacgtcccccaaaccaatgagttacgcaaaatatattcagagatattgaagacaaacaacatggaaatcctaagacctttggggaactcatgttgcaagctatcttggctaagcatcaatgaaaatgatagtttttatcacaacacaaatataatgttaatcatttcatgatattcaatctaattctatttttatcatatcaataaatttaaaatctagcttgaaagaccaaaaaaatgacttttgtttatacatgaaacaatgaccatcatgtctgccgaccaaatcaaatcacttcaagctgaaaggtcaggcggtcttgacagagttggagtcagaaaccttcaagttaaaaattcacatacctaattctttctgttgcccctgaaaagttaaataaataaggtcataaagaattaaagtaaacatagtagtgtcaaaccttgctgtcatttttaatatgtcatacacagaagctgaatcattaggttctgaaattgtattcacttataattcattttagaacctacttaattaatattcataaacatctctttctgtcctttgtttctaaaattaacacaattctaaaactggaactcttatgtttgcctaagagtttaaatctgtgttattttaacttttgcaaaatcaacagaactatgtaactatccaaataaaccaaaatcagttttcaacacttttatgtaatgagtaagtgaaaaaaaattttagacaaaaaaatgtataggtaatactttcagttctttattttaaagctctgaaacttggtatagtgcttagaattgagtacgatggtaggcagaataatggacccctgcagatgtccatattttaatccctggaacctataaatacattatgttacatagcaaggggaaattaaggctgcagctggaattaggttactaatcagatgaccttaaaataaggaccttattctggtaataactaaggagattattctgactcaatgtaaaatcaagggtccttatatatgtgaaagagaaaagcaggagaatcaacgtcaaagtgctacagcataagaatgactccactagctattgagctgctattgagctcttggatcatcaccatgatccaagaaactgagctgcctctggatgctggaaaagtcaaagaaataaattattccctgcagcagcagtctccagactttttggcaccaggggcaagattcatggaagacaatttttccacaaatgggggatggggggacggtttctggtagaaacgtttccacctcagatcatcagccattacttagattattataaggagtgtgcatcctagatacctcacatgtgcagttcacaatagggttcgtgctcctttgagaatctaatgccgccactgatctgacaggagctagagctcaggcagtaatgctggctggcctgccactcacttcttgtatgcggccaggttcctaacaggccacagatctgtacctatcagtggccagagttggggacccctgccctagagccttcagaaaaaacatattcctgccattccctctattttagtccattgagaccaatttcatactcgcaacatcaagaactgtaagataaatttgtgttattttaagtgaccacgtcggtggtaatttgttacagcaggaagaagaaacgaatacaaacacattttgtaaatatattactagtagcaactggttggtttattgatagcaacactcctaatacctaacacagtacctggcacattgatgaaataattatatttaactgattaccagatttaactttcatagtagaaaatttaaccgcacagacacaatatattgagttcacactttaattcctataagtcacatgtatagtatgaggagtttggaataataaaaaaaagaagacaagattttgtcctgaattttatagttttttttttttttcatagagacagtaaagtttcacatggaaacaaaacaaacaaataatattgcaatgacatatacctatctataacaatgctgaagcaatgctactgaaatatcaccaaggtaaggaaacccaggactaattttgtgggaaaaacagaacattatttcagaaaatctgtcagaattatgaaagcttaaatgaaatttataatcttcatttttaacagaagtcagctaaacactaatggcaattaataatgccttctaaaatgaacctttaaaattggtatagttatctatataatagaagtaatattttcatgactggtaattatgaggcaaaattctccttagaaatataagtggcttcctatttcatagtcaatcctgcaatgaaaatgcatggattgataaaaaataaaatttttatttattagtttgtcagtaatacatatatacactatatatatatatagcactattttactaccctcaaataatcttaatgaaaaaaataatgcagtggaggaaagagtcaatagtcaggaatcataaagaaaaatgtttcctatcattctttttcacaactaacaaagcaaaattaaagttaatatatttaatttgggggcagggaagaggagtaaaattatattcctagcaaaaataatagttgtgatagaacagagatataattagaaacaccagaatgcatcttagccattctgttggcctcagacacctgaataaaaataagacattagaaaagatgaacatataaacctcttaccctactataaattatagaaaaagtgttgtttgtttttgtgttgtatttaaacaaatcttagtcaaacagtacctgtgttgaaattgggtaaggagccaagttgtgtttcctatagagtcctccaatgtcttataggtcctatatcaaatttgctaaaattccccaagtaaatgagaaagctttgcctttgtctattctaggtttcgtcagtatccacaaaatgccattatttctaagaaaaaggtcaaactaactgaaaagaatccaaatccattatgatgggttaaatcgataaaatcgaaggattatttatttaactctgaagtgctggcaagtataaactaactgaaattaggggagcagtttaagtggagtatgaagggagtgtgagaaagtaaaagcagattttaatataaaatgataaatttcatttaagtaatagactacaagccaagcttactcatgagcatagatgcaaatgtcaaggttttagagagctaaattcattacataggaaatatagtacaccatgatcaatccaggtcaatccagtaatacaagggcggtttaatatgtgtgggttttttagcttcttggcaaattaaaggagaatactgtatgatcatctcaatctttatagaaaataaaattcaatacattcattatgaaagttttcacaaagtgtaaactagcaaaaatgaaaaagagctagaaaaagtgttatcttcctaaaaacagaccttttaaaaacaaaatatggtaaagatgtacattataattgcttctatttcacatgcttttggaagtcttaccatggtaaagaaagggaaaaaataagattattagaattgtaaacaatataaaaattattattcacagatgctgtaattactactttgaaacatcaaaagcattacagaaaaaagtgtagaaataataagtttaacaatatgcctgaatacatggcatcaatatactacaataaaattaaattctgtgcaccagtaggaaacacagaatatagtaatcatcattcatcatcatcatcatcatatctatcatgtatcattgctatcaaatgtaaagcacttaagaaatttctaagaaaacatatgtaaatgctatgtaaaaaatataaaattttattgaaatatatttaaaatgtctcaaaggatagatcactctcatggactatgagatctacaaatttatatatagattcaatatatgaatcaaagttaaatatttttagaaactgacaagttaattctgtaatttataccttaaaaaaggcccaaaaagagacttacacaaaatattttatctacatgaaagttaatccatggtgaaaaaattagaacattggctgcctcatggaatggtgcacaaattgacatggggggaggcattagagaactttctggaaggatggtgatgttctgtaagttgacagccatttgagtcgtgcaacaggtgtatgcatatattaaaactcatgaaatggtacacatatggtttgtgcattcactgcaaatttttacctagaaaagcttacttaaatacatattgaactcaaatattaatctgaagtatctggtgtcaaaaagtactgatatcctcaatttagtcagagcaattgaaaataagatgaattgatggatagagggatagatagattggagattggtgatcaaccaattaagtatatattttaagtgatggtaagtttctagaactttgggagctggagatgagaggatctcttgaggccaggagtttgagatcagcctcatagcaagaccccatggtgaccaaaaaaaaaaaaaaaaaaaaaaatagctggacccagtggtgtgcacctgtagtcccagcaacttgggaggctgaggcaagaggatcacttgagtccaggagttcaaggctacagtgagccactgcaactccagcctggatgatagagtgagaccgtctcaaaaaaaagatggtaagcttacagattaccaagaaatcttacataacaatcaagtgaaatggtatgatcattttgaaatacaatataacacgatcttataaaattgaaaccacaaaccctgtaattatatgtttttgaggtaaacttgtactaattgttctgaatagtacaagatacagcagagttcccagtagacaaacagctgaaaataagccacaaaaagctaccagattttattatatttacataatggaatatcttataacagtaacaataaacacaaaacatgcaaactcatggacacattttagaaatatattgagcaaaaataatgtaaaatattcaagaataaaatattgtttgtatacatttcacaaaagcaaaataaagtattttagggaaacttttatatatgatgaaagcttatttttaaagggagaatgataaattcaaacttcaaattaagacacccccgaccatgaggcagaaagatggtgtattagttcattttctgttctttgtaacataatacctgaaactgagtaattttaaaaggaatttatttattacagttctcgtctggaggcaggcaagaccataaaggagtgcatatagtgagagctttcttgctgctgggatctctctgaagagtccccaggtgtctcagggtatcacatgggaaagatgctgagcgtgctcatgtgctaattcaggtctcttttttcttataaagccaccaggtctcctttcataataacccattcattcattaacccattaacctatgaataacctatccatgaggacaaagccctcataattcaatcaccgcttagaagggccacctctcaatactgctgcattgagaattaagttttgaaataaattgtggtgggggacaaatattcaaacaataccagatggaatagcaacagacacctagctgatgaagcagtgtttgctatatcccagtttattaattgggtgataaattcacaggtgtcaattttactattatggttcatatctagcatagatagatagatagatagatagataaaatacacactcatgcaatactaggaaataaaatgtaaattgcaacaccttacaaaaaatttgcttttaataatcaaaaatgaaaagtccaacaagagaggtgaggaaattaaatatctgagaacgactcctaccctgtgaaaaagctgcatgctttccacatatggtactgcacttgctgccactgaaaaggcatgtttgatactttgcagaagagtttaatattcacttcctcaatttatcctcacaactctagaggtggtattattttccccactttccccatattgcacatgagaaaacttattttaagagaggcaaagtgatttacccacgattgccaatcaagtaagtgaagacagcagaactggaattcaaagttgcctaactctagaggccaagatttatcacattacacctagtaacctccacagatttccagggatcagttgtctcatccaaattggacatattataaatttattataggaataccttttaagaaagccctcaacattatgaagttccaaagggattgaaccaaaacacagttaaattgcacatctaaaaattttatgtagtcaacaaataataaagaacagattttttttttttttttaagactgagtctcactctgtcgcccaggctggagtgcagtggctcaatctcagctcactgcaacctccacctcctgggttcaagtgattctcctgcctcagcctcccgagtagctgagaatacaggcacgtgctgccacccccgactaattttttgcattttagtagagacaggatttcaccgtgttgcccaggctggttgagaactcctgagctcaggcaatccgcctgcctcagcctcccaaagtgctgggattacaggcgtgagccaccgtgcccggccaagaacagatctttaataccaatgtaccaaattgaacaatatgagatattgcaaaagataataacatttagctttttgtttttttacagtactatttgtagttttcctcagatagcactgatgtttaaagaatgatcagtgtcctcaagacaagaatttaatactgctttaatttccagcaggtaagaaatgaccattctagtacataggctcgtaattcagtctgaaattgtcatatcaaagtgaaactatccttaaaaataaatgcattaagatataatcatcacagttcaagtaccaatgttcatctttgtctttggaaatcagattttctgtagttgcaaggaaataaaatagatgccaagaatctagcctattctagttgtaacttttaaaaaaatcttttatgtctaagaacagaaatagattctttgttcaatttgtacataaacattgtttcaggaaaacataaatattaacctcttttattttaaacctcagcctacctttatatgaactatctcttgactgttctccaaatttgctatgaataccaatgattcaaaaaataagaaaagtgtgagtgaagtcacttggtgtatattcctgcttccacaaaccaccgtaaatcctacagtaggaagtgacacaaaactatcaagcatctgggttgaagataatccttcaatcatttagaatcatgtatacagtttcaagtttacttggaaggaaaatgtagtgttcgaccttaaaaacagtcagacctctgctctttattaaagtcaatgacttcattgtttttgtaatgagagaaaccacttccttccatctcagctgatgatttttttcttcacactttgtcaagaaaataggggaagaaatgaagaccttcagagtccctccaataaatctgccttcccacttgtatctcgttacatactacctgctctcctttttaggtcaaagactgaaatgtccctgcttcctcctaagcccaatccactccatacacaggtttccatgctctttttccaatgtcctcttttggagaactttagtcttctattcatgagctcttccttcaagatcatcaatctgcccctctccattgtatcattctcatcatttaaaaaacaaaacaaaagtaagtttcccttgactatccactcacaaaatgatattttgttgttgttgttgttgttgttgcttaggtggtcattttaaagaaaagtctttaaaaagttgttcataattgtggcatccagggtccattgtcacactttccaatctttcttttcacctgaaccactgagatcattttttgtcaatgtcaccaacgacccctgcgatgacatatcatggttgcttctatgttctcttcttactcagcctctccacagtatctgacacacttgataatcccccattcctcttgtaggatcttgacattcacgaagtatcacactcctagttttgttctatctcacgagacgtaccttctaacttttcgggctttggcatctctagacaaaatgaaaatatttggaagttcagggccccttctcttttacatttatatttactccccagatttatcctaccctctatgtgctgatgcacaaatttgcttatctacccttatctattcctgagcctcaaactcctgtatccaagtagcaggatatatctccatgtctatgtctaaaagcattatcttgattttttcccttggtcctctgctgcttatttgccacagagcagtcagattgatgttttagaatgtgaaattacattatgtatttccagtgctcaaaaccaatggcttgatgtcacattagagtaagataaaaacttcttacagtttacaaggcagatctggttctcagctacttctcctacatcatttccagcacatttttttcttccctctgctcactacaattttctatctttttcagatttgatgaaaagcagcacataattttttaaatttcttatactgatacatttcacggatccttcagattttccttaaaactgcacatttttaattgcccatttttaatttttaattaatttgtattaacttaattgctatattttatttttttatcgctcgtaatattgttgcaaattatcatcactgattcttccaatatttctggaatttgatgaatggggttctgttttctttttttaaaaattctttttatggagaaaagatcttattaggttgcccaggctggtttcaagttcctgggctcaaacaatcctcctgcctctacctcccaaagtgctgggattacaggcgtgagccaccacatccagcatgaaggggatttttattactacttttcatatcatgattattttagatcaaagattaaaatcttctgtggagaccatgcagacatgtcagtgagataagtagatatagcagcagtatgttcttcaggtatcctgattttcatcacctctccaggatatctctgccattttttttctactatacataaaaatttatggaaaactttataagaactacagtttccaataatgggtgaatccaaatttttgttttactgtaccataaaccaagatgatgtttatggctgcattttctccttataagaactaaatgactgatcaattacaataaacattttatttcataatgatacctattttccctctatcttgttttgtttctatttgacattttggtaactgctgcatttaattatatttatggcaatctttgtaaatacttttgcaagtaagtgggatatacacatttttagtatataaagtaaactgcaggacagtgttgggctgcttatcagcagctctgttaaaatggagctcatggttttagtaaatgaaaagttcaatgtatacctacgctgtgtgattttttttaaaaaaactattttaatctaaagctctgttaatagaaaatggtgttttaagaggagaaaatcccaatgtattctgtacttattagaaagcactgttcaatggaaacataaagcagcccacatgtatatttctaaatattcttgtagccacattaagaaagtaaaatggaaaaacttaattatattaatatattttatttaatccaccatatcccaaaaggttatcatttcaacatgtaattaatattacatggttaatgtgatattttactttttcttcctaagtattttaaatcctgtgtgtattttgcacttacagcacacctgaattcagactagctatatttcaaatacttaaaagccacatctggctagtggctaccatgttggtcagtgtagtattagacaatatctgtaagtacataacaatctaagtcatgggtacatttaaaaggatcatagaggaagcaaaccacagattaccatgatgtgaaatacatggaaagtttaaataataaaaactgaaaacacatgtattcatttcctctgaattctagtgatttcacaatatagcattttaaatatttttattcaaataaacatgactttgtactttacctcctgctgcaacaactttaaaatgctgcaagtaaaaaccagctaaaaattacaaattgccatctaagcctccctgccttcatgatgataattagtcctatttttgaaggaccacagattattgccaaacaattagacacatctctagaaaaactcatctctttcctttcaaaatacatttttggaagaagagaaaagtaatgttttcatttagagttgaatttgtgaatcttcacttttacattgtctctaatattaaatgagttggtgaaaatttgtatacatcaggagaattaaatagaggaagagttttgtgcatgtaaactagaaaggctcaaaagcagtgtctcacagcggcatgcctatactatgactccattgcctctttaagtgtagccttcttatttcttttcatcatcccaattaattaacctatgccagaatctgaaaagacattttataaaacaaaactaaacaaaaaaacagtaaattatgctggatttaaataaatagtgtatacacacacacacacacacacacacacacatatatatatatatatatatatatggatctaaatatctatctatctatatacagtttaccttcattcaattatttctgggctttccaaggcagtgacagactatttttgggatattaactggcactaagcacaatgcttttcccaggacaggtgctcaacatacatttcacaaatgaatgattgcttgttttgttaataaaataatggatattttaaaatattttcaatctcttatcatatgtatgttcgttgagacctgttctccataatactagactacaacctgttaaggcgaactattttatttcttttcctgcttaagacagcaggaggaacacatccatgttcaaaaattatgtgtcagctgggctttatgcttcatcaatatccacgtagaccaatcgagcaaataattctcattatgaaagacttactttcaactggcacaaaaagtaataagaaaagtagttcatataaattgtacatgatagaagcagtaagatatgtaggtctggtggacttagaagtaattgaatttagttttctttggtgaatgttgaatacctacaattaaagagtatatccacaaattttataacatataacactcagatattattttaatctctttagagtagtgttttagattaattgctttgatcatcttgagatagaaccagttattttgaatcaataagataaggcttatttctggtataatttaaaaatcagttttaataaaagttatcttaaatattgcttcccttagctttagcaaatccttttcatttttatggagttgtagattttcagtgcaccttcacgttcatgcatctcatttgattttctcaacaatactgtgagttgatgttactatgctataagcaaagttattaagtttagctgatttttcctactccaggaaagaggaaatcctgagattcataaaaatccagtctttctttgcgtaagtgtacaccctctctgatcagcatcttgcagacatagggatagtttgccatctctacagaaaacccacaattccttctcatcaatttaacaatcctgatgttaagcccgatataaaaagagagagaattgttttttcagggttgtctttcgcatgctttatatcctcaggcccaatataattttttctctttgtaatgtttgtttttttctttccagactaacctgagctttcaggattattgggccatccttttatttatcccccagttgactacattttaaataattttcattaatacttgcacttttaagacagcaaatcagttaatttaattcatgatttcactcctttattgaggagaaatgactttacccagtctacctcccttaaactcattttttcctctaaattatcagctccataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgccaaattgtaaagaccatttctggtaattccttaagaatttatatgtattagcttgccttacaccttacatcatttatttgaacctgcccttgaaaacaaccctccctgtatcatttatatattgctacataataagcatcaccaaaacatgacttcaaataaacatgctacaaggttaattatcaactgtgagttcttctgagtagtgccttactgagctgacctctgcagggcttgctcctatctatgtgatcaactgactggttgtctgggtactggctggttgaggacagttggttggttattggctggggcaacagaagtgatcagtttacacttctttcatccagcatgctagccatataagcctgttcatatggtgatgacaggactccaaggaagactggaagtgtgcatggtctcttgagtcttagacaccaactgggacatcatcatttccactgcatttggtggaagcaagtaacaacaaggagtagggaaaaaggcttcacctctttacagatggaattgcaaaattactttacaaagacaatggatatagggatggatgaagaattggaccattttcttacttggatcctatcacattttcttaacctctttgtagtactaaacttttcattctttcgtcaaatctatcttccctaggtctttaagaattacaatttcctggatttttccttatatttctagcctgctctttccaatgtccttacttgggtttgttctttaaatatatatttttctctaattcattattggcttttatctcttataactgagcatgtttaccccatgattgtgtcatcttttcctacccccttgcttcaggctctgctttcagagaaaatgaattaagaaacctatcgttctccaacagtttgaaatgtgttcaggccttattacctcttaactgaactattgctctaattcgtttcctggtatttccatctccagcttctttctcctttcctctgatgtagagctggtggagttacttgaatttaattctgtgaatgttgaatacatacaatgaaagaatatatccacaaattttataacctgtgtgaacccaaagtatttgagacaagtctcaatcaatttagaaagtttattctgccaaggttaaggatgcatcgctgatacagcctcatgcggtcctggtgacatgtgcctaaggtagttgggcatagctgggttttatacattttggggagatatgagacatctatcaatatatgtaaggtgtacattgtttcagcctagaaagtcaagacaaatcctttctagatggaaccaagcggaggcttccaggtcataggtagataagagacaaacggttgcattattttgagcctttgatcagcctttggctgaatacacaatttacatgtgtgaggaaggtggaggaatagtcacttatgccttagtctgactcagcaaatcttcatttttacataagcagtagggcagtggaagcaatcagatatgcatttgtctcaggtgagcagaaggatgactttgaattctgtcctttgtccagcatctgtgaagataagctatcaatttacattgccagggtaaaatccaacagaagggttttaaggtaaagatctgaggcccacaaggaatttccttgtggacaaattgtgaggaaagaatgtagctttttatctttgtagctatcttatttagaaacaaaatgggaagcaggtttgcctgatgcagttcccagcttgacttttttctttggcttagtgattttgaggtcccaagatttcttttcttttcacacatttaacactcaaggtattatttcaatctctttaaacaaatgttttaaattacttactttggtcatcttgagttatttttatctggcctgcctgtgtaacctttcttaaaactacatctgatcatggcacctatgtctaccatataattctaagttaatcacctgctcaaaaaactttgatttttctccattgaatgattgaattttggaattcaaggctttctactatttgatcctgcctactttatccaacttatataaaatcctatatatcttttatttcagtcatataacagtctctttaatcctagagcatccctatacatctctactcatatctcttactcatgttcccttaggcttgaataaacattcgatggggcccacctacttgatcctctttctgtcttttaagactcatctcaaataacatttcttcctagttaggaaagttagtattttctccctgatttcccattttctattatatgtctgtatctctgcattgaatgtcaaacacttcaaggaaataaatggtctcatagatggcattaccaatggtcagggattttatgcctaatttattaaaataataagcaataaaaaactgggaactactacaaaaggagagagacacggaggaagataaaggttaaaacactattgggttatgctcagtgcctgggtgatgggatcagtcataccccaagcctcagcataacacaatatagccaagtaacaaacctgcacatgcaccccggaatcaaaaaaaaggttgaaatgattaaaaaatgaaaaaaatagctgtggaataactttttattgaatcattttaaatatactttcttaacttaagaagtaatatcttagtatatttccaattgtcaaaacctaagtttacctatgtacattttgagttagttaaatcaaaaaagcataaagctagattatttttaaggagatcaaagtttgagatgtatccttttgttcaatgaaatcttccaaatgcattaaatataatataaattaaagcataccaacaaatgtcactaacaatcatcactatttatatattgcatcaatcaagacccctacaggaagcagatggcacactcaaagtgaactattttaaaatagcttaataaagagctatttacaaagaattgagtagggttagggaaagcagaagagatagagcagtatcccaaagtcaatattacctgcaatgaagaacttcacaactcttcggcctgaaatgttaagggggtagtctttatcagaatccagagacagagggttccatagacaaggcagatttgcaagagctgggtcctttggtagaagaatatggccaacccagggcaaacccagcctaacattctttcctccctctctttgaaactgcctttgtaaaattgtaactgaggaaattatgacagcgaaagaagtcagacctaaccgactctatcttgcttctaacctttaagctgtccttgttcattcctgggtgtaggctgaactacgggaacaaatgcggttcatggtttgaaacaaaattgataacagccctttcccaaaaagacctccttcttgcctagggtccagtctgcctttgcagggctaacaaattagctacaagattagaaattacagtttaggggtcatgcagcctctggcttcaacagtctgaacctccccaaattgctcctgggggtaacatcactattgttaaatttaatatctgtgcttgagatattttgcagaccctgcactccatggatcagctgacactacccagactgataatatgacccaatcagttctgccatcccacccaggaacagaagacattaaaaaaaaaaaaaaactaacttcgggcggcgcgcagtagctcacgcctgtaaccgcagcacttggggagaccaaggtgggcagatcacaaggtcaggagtttgagacaagcctggccaacatggtgaagccccatctctactaaaaatacaaaaattagcctggcgtggtggcacatgcctgtagtctcagctacttgggaggctgaggcagaagaatcacttgaacccgagaggtggaggttacagtgagccaagatcgtgccactgccctccagcctgggtgacagagcaagactacgtctcaaaaaataaaataaaataaaataaaataaataaaaagaacacctaacttcaaccccctatgattccctctgcaacctgaccaatcagcactcccgctttccaagcccctacccaccaaataatctttaaaatctgatccccaaatactcagggagacttacttgagtaataaataataaaagtccagtctcccacacagctggctctgcgtgaattactcttttctccattgcaatttccctgtcttgataaatcggttgtctaggcagcaggcaaggcgaacccactgggccattacatcttctcctgttagtttttcctaatggcctaaactaaccagaagccaaccttgccctgcaacccaagaagcaagggggggcagtaatatataaatgcagactagggtaaagagaatggagactgaatatggaaggcaaagatttgatatctggtagttatgtcttcgacattttttttttttcatttggctttgcttttaggctgctgaacctcagcttcagaagaataatttataagaatttattttatcaaaaaagatattggttttgtaaaagtgtgaaacttctttttagttaaagggagttttcagatccaattattttgcatttttttaaagaaattcaacatctgcatcaataatatttttaaaaacactgtagaagaaagtggattcagaaacctttttgattacagctttctgcttgagtacataatcaacttcacagtcagatgttttcaagtcttagaattattagtattactgatgtgccttattaaaagcataaaagtgcttttattcttctcagaaaatgttgtgaagcacatagattcaataatataacctttgagatttgcaagttaatttggtagccttcttgtacttgacagacacaaacttgccctaggttctcacctgaaatatataaaaggctgagcaaagaaatatacacccaaaaattctaagaaattctttctcaaccttaagaagcagtcaagaggacaaatcaaataaaaagtccaacgtaactgtaatgactaatactttctgtcctaaaaaccaagggacatgaagaaattatcccctagaaataataattttctttccttggtattatactttaaaaactaaagtgcaagtacagatataatacctaatttaagtctcataacaaacctaattgtatatacatttgggatacattgttttccaatttttatacttgaaaaactttatagagagattaaataacattcctaaggtctaaacctaataaatgacaaacacatcaactgagctttctgactcccagtgtagtgttcttttgactctatgaaatatttgtgagcacatgctgtagctacatcagaccaatcttatttagcttttaggtaacaaagctgaggactgtttctctgttgctatagaccctcaggctgaagatttgtaaggtgagcatggccagatgaacccagcatgcaagaacataggcagggggtggagtggaggaagaacctaagtgctctgaccaaggagcaggaactgaattaataattgagttaagaagcagacactgtagggtaggattcaggatccaatcagatggcatcaaaccctagcaggatccagtcagatcatgcctaccagaatcaccccattgcaagatccagtcagatcatgcctcattaccctatgcttataaaacttgactcacccccactgccctgggaggcactgatttgcaagctctccctggtgttttcttacttgttgcgaataataaaatccccttgctaaatcctccttggttgtgatcatcgggctgtgacccaccaagtgaccaaaacctgttgtgtgggtgacaatatcaaaatgtgtatatcatttgctatactaagaacataaacaaaaagaatacatttaaaaaataagaaaaataaatataaatagaagatctaaattttttcacctctgccccaacatacatgactgccctcctgttttttgtttttttttttaacttttgagatagggtctcgctgggtcacccaggccagagtgcaatggtgtgatcactgctcactgcagcctcgacctgccaggctcaaacaatccttccacctcagcatcttcagtagctgagactacaggtgtgcacaaccacacgaagataatttttaaatattttgtagagacaggatctccctatgttgcccaggctagtcttgaattcctgagctcaagcagtcctcccacctctgcctcccaaagtgctggggttaagggcatgagccactgtagcagagcctgtctgccctacttggaaaactattggtctgtagcatatacctcagtttatcctctgaactaaaataaactggtctttctcaatgctcaccttataggaaataaaactcaaaagtccttaaagataacatagttccaaaatgatgaaggaaaaactgtaaaagacatttttgagtcaaaaattataggatttgataaccatttaaatataagaatgattagagaagatttccagaatgtgtgttagtccattttcacactgctaataaagacatacctgagactgggaagaaaaaaagttttttaatggatttacaattccacatggctgcggaggcctcacaatcatggtggaaggcaaggaggagcaagtcacgtgttacatggatggtggtaggcaaaaagaaagagtttgtgcaggggggaactcctctttttaaaatcatcaggtctcctgagacttattcactatgcaagaacagcatgagaaagacccgccgccatgattcaattaccttctactgggcccctcctgtgacacatgggaattgtgggagttacaattcaaaatgagatttggatggggacactgccaaaccataacagaatgacttctaggttttgttttatcttcagtcattaggcaaatgctgagtatttaagttattgactacaagagatgggatacctaagtttagttttatatgaatattaatttgaaactctttccataggcttactggctcctcacttattctctaatataaaagactcgttaagtcttttgtctttttctgtatggggatgactttctatttcttatttgacttacattccttctcaacatttctagatattagattttttacccattttatatttttcaattattttcatccagttcacattccacttagtttatgctggcttttgagaaaataatttatttttattggttgaattcataacctcttggtttcaggtatgtgttgtttaaggaatgttttatcattatggatcataaagatattctccaatattgtttcctagaattttatcaaacattatctttcaaatttaagactttataagttaaaaattatgtatttgatgtgaggtaaagggcaaaaataatttttccatagggataatctatttttacagcacttctattgacaagtccatcttgattccactaaacctcaaaggtaattctttcataaattaagttttcaaatatatgtgggcatagttctgagttctccatcccattcctctggtcttctcacctagccctgcaccaaaagatactgaatggttataaataggttataataagacacagctcagaaatattttttttcttccataggttctaattttttttgaagtcattcttatgtacccttcctgtcagtgtctctgcctaccaaagaacatccactatcctgatttctcatatcatagataagtgttaactgttttgtactctataaattgaataacacaatatatgttttttttgtgtctggcttcttttcttcaactttatgtttgtgatacacgtgtatttttgtgtgtcattgtagtgttcattctcactgctatataatattccattttgacatatattaagaaaattccctaactcaaactggcttaaacaataaggaaatgtattttctcacataactggaagcccagaagtagaataaactccagacacaaacaaagctgcaatgacatttttaagaaataagttttcttccatctccccgtgctaccattcctaagatcatatgaaaactgccagggcactactgagttcagcaacagagagggagaacttctctcttaaccaaagagcatacagttgtccctcagcatccacaggggattggttgcaggacctccccacccaccctcatgccaggataccaaaatctgcagatgctcaaatgtcttatataaaatgccatagtatttgcatgtaacctacacgcatcctcctgtatactttaaatcatctctacattacttataatacttaatacaatataaatggtatgtaaatagttagtgtactgtattgtttttatttgtattacttttattgttgtattgttatttttattgttttttccaaatattcagtttgttttttaaatacatggatgtgcaacctgcagataaagagggcctacctgtacattgctctctttagtcaacttgagccaagtttgtaaagagatacatttccatcaaataagtaggcaaattttgaaagatctactactctgtgcctcccaaaataatctatctatctatcccaaaaagccccacatgtgaaatttaccaaaatatatactccattactatttaaactgttctgtaacaaaagtgaaaaaaaaaacttttatggaataagtatataaccatagttatgataaagactacaaaattaggaaataacagagcaatcacatcattcttaatagagaaagcaaaaaacattcctattaatgtcagaaaattttttggttattcaccactattacttaattttatttttttctggatgtgttagccagtgacattgaaaatgacaatcctaagattacagaagagaaatgtctaaaaattggaaaaaaaataaagtgaaacatttatgctggaaaaagttataattgtaggcctgaaaaaatttaaatataacttaaaaaattagcttaaacaataagataattcagcaatttgactgaatgtaaatctttaaaatagttttcttctatagtgctaaatttaaacaatgaattagaaggtataatatagaaaagataccatttgtattagcaacaagaaagctagaatatttagtaataaaattaattaaaatgctcatgatccatatgaagaaaatttcacaagcttgcgagtgagaaagaaaagaagatttgaacaaataaagagacaaaacctgtttttggatggatacattcactattatcaatgtcagttctctctaaatctttacatttaattggatccagataaaaatatcaacaacacatgttggagttgtttgtttgtttgagaaagtgtttcactctgtcacccaggctggagtacagtggtgccatcacagctcactgcagcctcagcctcccaggctcaaacaatcctcccaactcagcctcctgaatagctaagaccacaggtgcataccaccatgcccagctaatttttaaatatttttgtagagacagggtctccctatgttgcccaggctggtctcagacttctggggtcaagcaacgctcttgctttggcctctcgaagcattgagatgataggcatgcactaccacacccagcctaagacattttgttttagactattttaaagctttcatctaaaaacatgcaaaattaagaaaacttttactaacaaagagtactgaggggcattaacattactatagattgaaatattttataaagttatagtgattaagcaatatggtacagctacatgaatagattcatagaacaaaataaataataataaacagaaataataaacaattatacccagaaaattagtatatgattaaggcaacattacattttattaaggaaaggataaattagtcagtgatgatcaacagataccccttttatataaaaatacttttggatctctataccaaaattagcatcaaaataatttcagataaatcagatatttaaagagatatatatatgtgtatatgtaactataactattacacaaatccacaaataataaaagactgaaaatatgaccacattgacattaaaagattaaaagcagcataaattcagaagatttcagaaaaaaatacttacatatcactcctacaaaaaaataagttcacattaaaggaaatataaatttccttaagtatagtctgcatgaatctcaacttctagaattttaccaaatggtgatcctagcttaatctcagttgtaataggaggcatgtaatttaaaacttaaaatgtgattaagttttccatctgttatataggcaaaatgaacatttggtattacaccatgtggcaagaatatcggaaaacaggcagtctcaaagattttgggtgaaatgtaattggtacaaactctgcagagagcaactgatagactcttttgcattaaaaatctgcaagctttaaaaaataaaaacacatttacattaatttattacagagacatgtgtacacatatgaaataagaaacatacatatatatgtaatgtagcatttctactaagagcaaaagctaatccaaatcaataagaggaatgaggtacctaggacggtcttgatttggaatgatgtccaagtaatattttctgctcatgggtgtgtggggaatctacagagtgtgtataaattcttttgtttgtttgcacatgcaagcacttgtattcatgcatgcacacatacagaaacacatataatttttaaaagaatatataagatagtggtatcgatagtcccagctatctggcttggacaactgcagatatgttagttctggccactatccaagaacattcatttacggtgcaggtttaaagatatgggtatatagattttcagatagttgctgagatagattttaatattttcttcctttagccatataagatagtgcaattgtattgcatatatgttgttatcttaatgggaaaattaagatagcatttcaatgaacatattttggagtaaagaaaaccctagtacctttgctcagcattacgttatgcagtggactaagtgtttatgttgccaccaaagttcgtatgttgaaactctattcccaatgtgatggtatttggaggtgtagcccttaggagataattaggtcatgagagtagagccctaagaatgagatgaatgaccatatatggaaagacgagaccacagctctctctttcagacatttaaggataaaagaagtcagcgtctgcaacccggaagaaggcccttactggaaccctagtctactggcatgctcatctcatacttccagcatccaaaacagtgagaaataaatttctcttgtttataagccacccagtttgtgatattttgttatagcagccccatctaattaagatatcctattttgttgtcctatattatctccttccggttttgaaccagccttcttcaactatttgtttctgtgctcattctatttctaagcacatgccttctttttttgtatgttattttaaacaacatacttagaaatgtgaagaatcagcaaaggacatattaataaaacttagtatcactaacattaatatgtgatcattacaatttatttaaaatattgaaaaattttaaatataatagaattataatagtattctgctattcaccaataaagcctccagaacttttgaagaccaagtttaatcttggaattagttgaatccggaaatgtagcacagtgaaagttaacacacagaaatcagttatgtttaaagaaattgtaattaacagactgatactgagaaggatagcaaaagtaaataggtataaactacattgttttatcatacaagtatacttaagtgttctaattatactctgaaaaactgaagcatccctacatacgtatatattcaagagggcaactgaagaggtcaaagccttctttatagcacaatatttagtaaaatttaaattttgtttagggttgaccaatattttgattttcattccctcacaggccaaatgtttaagttttagagttaaatggttctattagacttttaattattacacattcacattcaattttgtttttttttttttgttttttttttttttgagacggagtctcgctttttcccccaggccagactgccctgggctttctcggctcactgcaagctccgcctcccaggttcacgtcattctcctgcctcagcctccggagtagctgggactacaggcgcccgccaccgcacccggctaattttttgtatttttagtagagatggggtttcaccgtgttaaccaagatgatctcgatctcctgacctcgtgatccgcctgcctccgcctcccaaagtgctgggattacaggcgtgagccatcgtgctcggcctggttaactattcttgataaatgaatgaagaatactcaactagcgtgctatgtaaaatgtgagtttcttcaaaattaagttgttgacaaaaaaggcctaaaggatgctgggctaaaaccctgtaaggtctctttcagctccaaaagttgtagaattgtggtaggtaatagataagatgaacaaaatacattttccctcaagttttacatttagatttacacacagaataatgcttactacttataggctctaaaccccatatttttatagtatacaatttttaacagatagttcatacttataggaatgtcctatacaaaatttactagctgtatttccttacttattttaaatatagagcaatatctgacgttttgtattcataagaatggtgcataggtgaataaaaaaagtcagattttttttcaatctacaaagcaatcattatatttctatttttaactacattatgtagtttcaaaaatactatactaagacataaaatattttaaaattctaaatagatgacagcctccatttaaggtggttgtccataaaaatctgttctcccattcttccattacaatgaaattatagctggaccaaagattacacaacttaactacattttttagcctcctttaaagttaaatggtgatgtaatgatgttgtactgacagaacgtgaggggagagatttatgccattttcagatctgggtatgctgcctcccacttatagttacttttctcataaactgaaacctgggtatggtaatctgtttctaccatgtagatgaagcaatggcaaggcagaggcacaccataaaaggagtctgagaccccaaataatcatatgggcacagcttcctgacaccctgaagcaccctaattagagtattttgttagagaaaaaatagttgttttttacagctactgaattgttgggtttctttttatagcaacagagtcttcaccataactaatggcaaagccattaagtttaaaatacaatagaggttgcacagttaaaatgatacaaattagagttaaagaaaatacagaaaaacgtaaggccaaggaaactgtgtatcacttctaataggggcaaataatggattggataagagaattaaatgatttaagaaaaatgttaggctttacccaattatcaggaataagattagcttactaaataccacaataaaacgacttttttaagcttttcaatatatattatcacttttacaccaatggaaaaggatactacgcattgaaaattcatgtgtgtgtgtgtgtatgcacacatacatatgtcttttgattttacatctgagtatttttctaactgatatttcaggaatccattacaaatagaaaaaaaaaagaaaatgctataaagcccctggtgaatatgagataggttgttgtcagagttcctccctcaaataactcagatttttagggtagaatgcttatcattcagacaagaatcaaggaccaacaaattcacggttctttttctcaaactgtctctcaagcacaacagatgtttgagaatgttgatttaaaaacatacttccttaccaacacattttcatgaaatacacaaagactacactggcaactaaatagattctcagtatgaattttatactaagcattatctgctttggattaaacacagtgtaatttaattctgataactgaggtattataattatcttagtttaaggattaaaatttgaaatttgatcataattcttagaaagtcagatgtgagtgtagtctgtttccttgatttttaatatttacattgcataaatatattacatactacttgcatatctgacgttacacaagatagatactcaaaaattaagtttatagtagacaaaaataggatttttaatttatcaattcatcagtaaatagaaatataaacaaattttgccattcatgaagattttccaaacattttgtgacaaattctcagtaaaaatctatccctttcctaaaaatctagcaaaagagaaaatggtcttttggcactgggatcaagggcatgctactgataatttttcagtatatactgttaatttagtttagtaaataccttgatattatctttatcatggcaatatttgtgaattgacaaaactatgtctaagaatatttaaacacgacaaaaaatgttttcaagtatttttcaaatattcataatattcaagatgtttagcaaaaaagcttattctacgatctacgtaagtactccttttatattgctttcatttcctaatttttttgtactagatatgataaagtgtacttttgtgagtagcagccataaaaaatgtttattaaaaacatgccaataccccctcactaaattcgtttgctaagaagatatacatttttgtcacttatttctataaactgtaagccctgttttcattggacaagtaatctgaaagaatgaaaagaaaatgtcattgtaataaggtatggtacatggcagtttttgtttattttagatcaaactggatcctagatcaaactaaaatttctagattagcgataaatatcctggtaacttttattgcccttcgttaatgaataacacttgacaactaagtaatgaagaggagatcatcgtatatcctttctaaaatcaactgcagattttaaagcctcctctacgagaggcttttctaaaaatcaactttacccatttctttaattgctacatattgtgatataacgaaacctttcacattactacatgatgctttatcagttaccagcagagaacttcatcaagcttgaaatagacattagctttaacccaacctatgagcattttattttcagaatttgcaatgccttttaggaattatgctcaaaagttaccctcatttgtgtgtgtgtgtgtgtgtgtgtgtgtgtgtgcacttacatcctattataaaaatgttttcaccagtaacatttacaatttttagcattcattcatatgtacatattttaagacaaaaagtgtttaagaactatgtaaactaaataatatggttggttgttaaatatccccaattttgcgacaagtggtaattattttttaacttatatttcattattcttattatataggtttttctctcctatttgcttctaagtagtaaaaagtgtcaatttattccaaatttatttatctttgctaatacatgtaaagtcatatagaagcaagatacagaaagcaagggaaaagtgtaagaaaaatatgcatctacaattctcacactttggattataattctcacagatattgaacttacttttgtcaggcctctgagcccaagctaagccatcatatcccctgtgacctgcacgtacacatccagatggccagttcctgcctcaactgatgacattccaccacaaaacaggtgaaaatggcctgttcctgccttaactgatgacattatcttgtgaaattccttctcctggctcatcctggctcaaaagctcccctactgagctccttgtgaccccactcctgcctgccagagaacaatccccctttttcctttacctacccaaatcctataaaacggccccacccgtatctcccttcaatgattctcttttcggactcagcctgcctgcacccaggtgaaataaacagccttgctgctcacacaaagcctttttggtggtctcttcacaccgaagcgcatgaaagttggtgctgtgactcggatagggggacctcccttgggagatcaatcccctgtcctcctgctctttgctccatgaaaaagatccacctacgacctcgggtcctcagacccaccagcccaaggaacatctcaccaattttaaatcgggtaagcggcctcttcttactctcttctccaacctctctcactatccctcaaccactttctcctttcaatcttgatgctacccttcaatctctcctttctcttaatttcctttcattttctagtagagacaaaggagacacgttttatccgtggacccaaaactctggcgccagtcacggactcaggaaggcagccttcccttggtgtttaatcattgcagggacgcctctgattattcacctatgtttcagagatgtctgaccacccaaggacgcctgccttggtccttcacccttagtggcaagtactgcttttctggggggcaagaaccccccaaccccttctctccatgtctctaccccttttccacttttctggagggcaagaacctccaaccccttctccttcacccttagtggcaagtaccgcttttctagggggcaaaaaccccccaaccccttctctccatgtctctaccccttctctgattttctgggggcaagaacccctggatccataatttccacgccccgacctcttatctctgcaccccgatcccttatttctacgcctcgacctcttatctctgtgcccaacccctttcctgcttttctggagggtaagaacccccgaaccccttccctccgtgtctctactctctcttttctctgggcttgcctccttcgctatgggcaaccttccaccctccattcctcctccttctcccttagcctgtgttcttaagaacttaaaacctcttcaactcacacctgacctaaaacctaaatgccgaattttcttctgcaatgccgcttgaccccaatacaaactcgacagtggttccaaatagccagaaaatggcactttcaatttttccatcctacgagatctaaataattcttgtcataaaataggcaaacggtctgagatgcctgacgtccaggcattcttttacacatcggtccctccctagtctctgttcccaatgcaacttatcccaaatcttccttctttccctcccacctgtcccctcagtcccaaccccaagcatcgctgagtctttctaatcttccttttctacagacccatctgacttctcccctcctcgccaggccgagctaagtcccaattcttcctcagcctctgctcctccaccctacaatccttttatcacctcccctcctgaaacctggtccggcttacagtttccttccgtgactatccctcccccacctgcccagcaatttcctcttaaaaaggtggctggagctagaggcatagtcaaggttaatgctcctttttctttatcccaaatcagatagcgtttaggctctttttcatcaaatataaaaacccagcccagttcatggatcgtttggcagcaaccctgagatgctttacagccctaggccctaaaaggtcaaaaggccgtcttattcttaatatatattttattacccaatctgctcccgacattaaataaaactccaaaaattaaattccggccctcaaatcccacaacaggacttaattaacctcaccttcaaggtgtacaataatagagtagaggcagccaagtagcaatgtatttctgagttgcaattccttacctccactgtgagacaaaccccagccacatctccagcacacaagaactccaaatgcccaaaccgcagctgcaaggggttcctccagaacctccaccctcaagagcttgctataagtgtgagaaatctggccaattggccaaggaatgcccacagcccgggattcctcctaagccgcgtcccatctgtgcaggaacccactgaaaatcagactgttcaactcacctggcagccgctcccagaacccctggaactctggcccaaggctctctgactgactccttcccagatcttctcagcttagcagctgaagactgacactgcccgattgcctcggaagcctacaggaccatcacagacgctctaggtaactctcacagtggaaggtaagtctgtccccttctaaatcaataccgaggctacccactccatattaccttcttttcaagggcctgtttcccttgcctccataactgttgtgggtattgacggccaggcttctaaacctcttaaaaactccccaactctggtgccaacttagaagacactctttttgcactcttttttaattatccccacctgcccagttcccttattaggccgagacactttaactaaattatctgcttccctgactactcctgggctacagccacacctcattgccaccttttcccccagttcaaagcctccttcacatcctccccttgtatctccccaccttaacccacaagtatatgaccctctactccctccttagcgaccatcatgcaccccttaccatcccattaaaacctaatcacccttaccctgctcaatgccaatatcccatcccacagcatgctttaaaaggattaaagcctgttaccactcgtgtgctacagcatggccttttaaagcctgtaaactccccttacaattccatttcacctgtcctaaaaccagacaagccttacaggttagttcaggatctgcgccttatcaaccaaactgttttgcctatccaccccgtggtgccaaacgcatatactctcctatcctcaatacctctctctacaacccattattctgttctggatttcagacatgctttctttactattcctttgcacccttcatcccagcctctcttcgctttcacttggactgaccctgacacccattaggctcagcagattacctgagctgtactgccgcaaggcttcacagacagccccctttacttcagtcaagcccaaatttcttcctcatcagtttcctatctcagcataattctcataaaaacacacatgctctccctgctgatcatgtccgagtaatctcccaaacctcaatcccttataaaacaacaactcctttccttcctaggcatggttagcgcagtcagaattctttcacaagagccgggaccgcaccctgtagcctttctgtccaaacaactttgaccttactgttttagcctagccctcatgtctgtgtgcagtggctgccgctgctttaataattttagaggccctaaaaatcacaaactgtgctcaactcactctacatttctcataacttccaaaatctcttctcttcctcatacctgacacgtatactttctgctccccggctccttcagctgtactcactctttgttgagtctcccacaattaccattgttcctggcacggacttcaatctggtctcccacattattctggataccacacctgaccctcatgattgtatctctctgatccacctgacattcacctcatttccccatatttccttctttcctttttctcaccctgatcacatttagtttattggtggcagttccaccaggcctaatcgccactcaccagcaaaggcaggctatgctatagtatcttccacatctatcattgaggctaccgctttgcccccctccactacctctcagcaagccaaattagttgccttaactcaagtcctcactcttgaaaaaggactacgcgtcaatatttacactgactctaaatatgcctttcatattctgcaccatcatgctgttatataggctgaaggaggtttcctcactacgcaagggtcctccatcattaatgcctctttaataaaaactctgctcaaggcggctttacttccaaaggaagctgcagtcattcactgcaaaggccatcaaaaggcgtcagatcccattgctctaggcaacgattatgctgataaggtggctagacaagcagctagatttccaacttctgtccttcacggccagttttcctccttcgtatcagtcactcccacctactcccccgctgaaacttccacctatcaatctcttttccacacaaggcaaatggttcttagaccaaggaaaatatctccttccagcctcacaggcccgttctattctggtgtcatttcataacctctcatgtaggttacaagccgctagcctgtctcttagaacctctcatttcctttccatcctggaaatctatcctcaaggaaattacttctcagtgttccatctgctattctactacccctcagggattgttcaggcctcctccctttcctacacatcaagctcagggatttgtccctgcccaggactagcaaattgactttactcacatgccctgagtcggaaaactaaaatacctcttagtctaggtagacactttcactgggtgggtagaggcctttcccacagggtctgagaaggccatcgctgtcatttcttcccttctgtcagacataattcctcggtttggccttcccacctctatacagtccgatagcagactggcctttattagtcaaatcagccaagcattttttcaggctcttggtattcagtgaaacctttatatcccttacggtcctcagtcttcaggaaaggtagaacggactaatagtcttttaaaaacacacctcaccaagctcagccaccaacttaaaaaggactggacaatacttttaccactttgccttctcagaattcaggcctgtcctcggaatgctacaaggtacagcccatttgagctcctgtatagacgctcctttttatttggccccagtctcattccaggcaccaggccaacttagactgtgccccaaaaaacttgtcatccctactatcttctgtctagtcatacacctattcaccgttttcaactactcatacatgccctgctcttgtttacactgccagtttacactgttcctccaagccatcacagctgatatcccctggtgctatccgcaaactgccactcttaactcttaaagtaaataaataatctttgctggcaggactatgctgaatctccttcgcactctctaattaaatgtcctaggtcctcccaattcttagacctttaatacctggttttctccttctcttattccatttttcaattcatacaaaaccgtatccaggccatcaccaataattctaaatgacaaatgtttcttctaacaaccccacaatatcaccccttaccacaaaatcttccttcagcttaatctctcccactctaggttcccacgccacctctaatcccgctggaagtagccctgagaaacatcgcccattatctctccataccacccctaaaaattttcactgtcccaacactttaccacaatttcattttatttttcttattaatataagaagtcaggaatgtcaggcctctgagcccaagctaagccatcatatcccctgtgacctgcaggtacacatccagatggccagttcctgccttaactgatgacattccaccacaaaacaagtgaaaatggcctgttcctgccttaactgatgacattccaccacaaaacaagtgaaaatggcctgttcctgccttaactgatgacattatctggtgaaattccgtctcctggctcatcctggctcaaaagctcccctactgaccaccttgtgacccccacccctgcctgccagagaataacccccctttttcctttacctacccaaatcctataaaacagccccacccctatctcccctcactgactctctttttggactcagcccacctgcacccaggtgaaataaacagccttgctgctcacacaaagcctgttgggtggtctcttcacacggacgtgcatgaaaactttgaagcaggcattttgctgtattatctcaataacatttttataacatgttgaggtagatcttacgttcattttacaaatgagaatactaagatgtggagagcttaaccaatttaagcctgaagttacaatttaatagcaggaaggtggacaaacgttttttccgttctccaattcctactgcctcctaaacatgttttacagacatgggcctcttaacaatgggacatgccctgagaaatgcatcactaggcaatttctttgttatgtgaacattacagtgtacctacacaaacttagaaggtatagcttactacatacctaggctatatggtagagcctattcctactaggctacaaatttggaaacatgtcattctactgaatactgccggcaattacaacgcaatggtagttgtgtatttaaacgtgtctacacatagaaaagctacaataaaaataacagtattataatcttacgggaccatcatcatataagcagcgcattcctgactgaaatgttggttaggcagtacatcactgtatttctttcattcttagaaaatgaagtgaaggggaatataatttattttcatatacctacctcttctcaacaagttccttatattttttggccataggggaagattctaatattcacatctgaatatcaattacctttaagcaaaatatagtgtcttcataacccagaacttgaaaaatcacaaaacttgttttcctggtacattgtgtcaggcctctgagcccaagctaagccatcatgtcccctgtgacccacatgtacacatccagatggctggttctttccttaactgacgacattccaccacacaacaagtgaaaaatggcctgttcctgccttaactgatgacattatcttgtgaaattccttctcctggctcatcctggctcaaaagctcccctgctgagcacctcgtgacccccccactcctgcctgccagagaacaacccccctttgactgtaattttcctttacctacccaaaacttataaaacggccccacccctatctcccttcactgactcttttcggactcagcccgcctgcacccaggtgaaataaacagccttgttgctcacaaaaagcctgtttggtggtctcttcacacggacacgactgaaacattgttttgtaatatataatatttaatacttttggactatgccataactagtatattttattcccttgacaattctattcatgattttttcccctgaaatgttttccatcattgaaacactcttggacctatgatttttttatcaggcacaatggtatcctcttcattacttagttggcaaaagtgttattaacgaagcgcaataaaagtaattttaggacatttattgctaaactagtcacttttttgtgccattgaaataacaactgagacttaaattactttgttaggggaacttttgatatacaagtaatttataatttcttaaaagtccttagtcaaaataaggcaaattatctacgtactaattaagctaattgaacattaaagattaaaataacttttagactacctaatctttagattattttaaaagatcactgttacatgaagctaaaagaacatgatagtttactaaggacaactaaaaccagatttaaattagtatattcataaaggtatctttttaaaaatataaaaatgtaacacacttcaaataatactcgccgcaacctttcagataatttttaatgcaccagatttatttaccatttcaaaagatcacgatataggcagataccttaaaaattctctgggggcaaacaaatcagtatatattagatgtacagggactgcagccaagacaggcatgagttcctaggttataaatatcatctttataaaaagtgggtattttataggacatccaagtaacaccgacttataaaagcaaacactgtacttaaaatgttggccacatatgaaagaatagctgaaggctttaggggattgaagaatggataaactcaaccaactaaaaacacattactcatccctcagaaccaaaatacaggaaaaaaaaaaatacaacaggttcgcacaacatccagaaaagttcagggaatatgaagtgtttcttggcacccagttctcgctgttttaaaatccgtcccttcgttgttggctaggcctctctccagggaaactagccggggcaagaggcaggggaactgtacatgtgggaggtcctgagggcccttgcacccactcgacctccaccaagcggatggccaagcgccacccggaagtgtccactggtgggggcgggaaggcaccgtagtccaaggtatccgcgggcagggagcgggccagggcgtgcgcgaggtcgggggtagctgggaacggaggaggaggggcccgctcgaggctccgcctctcaccggctgcggcctcggctacagccagggcccagagggctccgagtcccgggagcggaggccggagtcgggttcctgtagaggctgctcctccttgtccccgctcggacgtggtccccgctgctcgaggtgcagctgcagcagggcccggcggtacatggcttccagcttctcaagtcgggccctcagggccctggggctgcccggctcgtcctctcggccgctgtctctagccctccggttcgtgctggcctcttcagggacccggcgtgcctccgcgggcgtcccgttgccgccttcgccggggagccgcaaagcctgacggaagaggctgcggttctcgcgcttcagccgccggttctcgagccgcagccgggcgttctcctgacgcagccgcgcgttctgccggtcccactcgtcccgcgcacggatggcctccaagtggctcgccgccaggtcggcaaaccgctcctccagctgctgtcgggcgccgtccgcgcggcctcgccagcccacgccgccgccgccgccgctggggctgcccccaccacgagcccggccggagcggcctggccctcggccgtccgcagcaccgtccccgccgcagcaactcccgcgcctagtggcgccaccacgcatgcgccacatcggtcccatcccaaccg

SEQ ID NO: 617 - DNA, 40001 bp, Homo sapiens
aatgaaaagttaaaccagaagacattgaaagtatgttacgaatttctctaggagattccaaatggaaaaattataaggactttctttagcttgagttgatttgggtaatgcaacagagaatgtgcaattaatatctgtaagaaaagtttgcattcaaaacttataattcacaaataattgtcatcattttgcaatctaaaaatttgaatttgtggtggagttatattttatttttgttaaagaagaatataaactagacatgaaagaactaaatttttgtcttgacagctatcttaggtcaaaaatataaataattattagaatgctgaaacaggaaactaatgtttccttcattatttcattctaatgtattacacttattgaaaatatttgtacttggtttctgaggccaacttattaaattgtcatgtatacagttgtgagacttgtgcagtctatatgatagatgctatgcatcctcaagagtttatcgaacttgcagaagaaatagaagataataaatattaaatttataaacttgttttctttgctacttacttctggttcaacatagaagagttttctagaaaattatttactgtactcttaattccaattgcagattttcttgaaactacaaagtctatcaaatatttaataatcaaagacaaaacatgacagtgtaatgtgtattttcttgtagatatcacaccgaatgtgaattgagttcaatttgaagctcaaagaaaggaaaagcttattttttattcaaattgacagatataaaatatatattaaaaaggaacattttcaaaatagaaatcgataattttacacattttctaatgtaaatcaacatgcagatgactttagttgtgatttacagtgttttatacacatatgcatatggtgaatacaaaaatcaaagaccactctatgggcaattataaatttagagtttcatagttttttaatttttatttttacttatttttaaaattttatggacacatcatggatgtatatatttatgggttaccttagatactttgatataggcatgtaagaagcaataatcacatcatggaaaatgggcatccatccccttaagcatttatcctttgtgttacaaacaatccaattatactctttcagatattttttaatgcaaaattaaattattattgactataatcaccttgttgtgttatcaaatactaggtcttattcattatttctattttttttttttaatggagtctcactttgtcgcccaggctagagtgtagtggcatgatctcagctcactgcatcttctgccgcccaggttcaagccattctcctgcctcagcctgccaagtagctgggattacaggtgcctgccaccatgccctgctaatttttgtagttttagtagaggaggggcttcaccatcatggccaggatgatcttgaactcctgacctcgtgatccacccacctcggcctcccaaactgctggtattacaggtgtgagccaccgtgcctggccaactatacatatttttgtactcactaaccatctcccctcccttcccactcccccattacccttcccagcctctggtaagtatcattctactttctatctccatgagtttaattgttttgatttttaacacccacaaataagtgaggacatgcaaagtttgtctttctgtgtctgcctcagcctcccaaatgctgggattacaggagtgagtcaccacacccaggctcaatttagtttttaaaaaataattacatatgtttttaaaagttggttatattaatctacattttaaactgtatattttatgaatacaaaatgtgccaaatatctccaattaaaatttaacattgaaatagagatgcaccataagcataaaatccacaccagatatcaaagacttagtatgaaaattttaaagtgtcttaataatttacatagattgaaataattgaaagtatatggaaagaatttgaaaatattttgtatacttggttacataatatatatcaatacaattaaattcaccactttatttttactatttttaatgtgaatatcagaaacttagaattacctatcaggatcacactacatttctcttgaacatcacttccttagaacaaccgctaaaaaaatatgacaaagatttagagtaaataaggtaacagtggacctaaaataaagtcattaaaatattcaaataatacaagttcagggaaagaagaaaagaggagacaaatagactttattgattaaaagccttcaataaatatatttcaagatcctgacatttggaggatttctgtttctggacaaaaaaagaaaaatagaaaaataaaggaacacatcaaaatatatgcaacaatgtttcagaagactttgaattagacattagacaatgaaggacaatgatccttgagagatggaaaccaacaatttcagcactactgttgtctcaccttagtgtctaccaagagtttccatgacaaaacacagggatagagaacataggagactatctagggtgacaagatggatactagagttcagagagaccaaggtagctagagtttacagatgtagtaatcctcaccaatgcttgtttctgtatgtcttttggattacagtcattctggagggtttgacatgatatttcattgtggattcaatttttaataattaatgatgttgaattgaccattttttgtgcctacaagtcattcataaattttatttcattatatatttattcaagtactttgtgaaaattattgggtttgtcttattaggttatattacatatatggatatatatatatagttatatatacacagaaatatgtacatatatattcatgatagaatgttttatcagatatctgatgcaagtattttctcagcccattttgtagcttgtttgtgtattttttaaatgtgactttaaatgaaaaagtagtaattctgatgaagttcaaatatcaatttttaaaaattccatgtgatttggtgtcacatgtgagaaatctttgcctaacttaagattatgaagatttgctgctcctatgttttcttgtaactgttatatttaggtttataattgtgttggggttccctaagaccactaccaagtttggtgatttggtaggtggactcacaggactcaacataaagtcatacactcaagtaagatttgttacagtaaaaggacacaaataaatagccataaagggaaaagatacacggcgctgaagttcagaaaaagcaggtacaagcttccaagagtaattgtagaatcacagaggaggcatttaagtcctctaggatctaattgtcacaacacatgtaagatgttgcatattaggaaagattattacagatttatggcctatggtttttcctgggggcaggtattataatgtaacctgtccttagcatctatgaaaactcgagactaccagaaggaagacaagtattcagaataaattatatttttcatacaaaccacttaggcacattgagccatgcctatcatttaaggaatggtgagaatactcctgaaattcattctcaggcattagccaagggcccatttagcaagcatgactttctaatgatagtattctcaggcctgctatgttaactctttgctgcacaataatccactcgcgttactttttgtacacggtatgagataaagttctgatttaatctttttgcatgaggatatctaactgttccagaattattcattgaaaaaagtatccttacctactgaactgcttaagcacctttgagaaaatcaattgaccataaatttaaggattttttcggaattccaattctaggccattgatatatatgtttacacttttgtcagtatcatatttgattactgcattgtaagttctgaaatttgatagtgtaatttatctaatattatatttctctatcaagattgctttggctattttcagttctttgaattttcatataaattttggaccagcttgataacttttttaaaaacatcagttgggattttgattaaaaatttgctgaatcaatatattaatttgtgggaaatttacataaccccccaaatattacctttcccaatctgtaaatatatctctttgtttatttaacatttcataatctctttcaacaatgttttataggcttttacagttaactgttacagttcttctcttaaatttatttctaagtacttcattattttgatgttattgtgatttaattaatttcatttgcattttgtttattcttagtatataaaaatataattattttaaaaattgatcttatgctctgaaatacggttggccttgtggattctgcaggattttctatatacgaaatcatattgcctgttaatagaggttttttatttcttcctttataaacaaaatgccttctgtttcattttctttctttcttaccttgagagaacctccagtataaagttgaatagaaaaagtgattgtggtcatgcttgtcttgttcctgatctcaggggagaagcactctgtctttcactgttaaatatgatggtatgtgtaggttttcttattttattgttgttgatgccctttatcgggttgatgaaattccttttaatcctaataagttgatagtctttatcgtgaagagtgttgcatttgtgaaaggcttttactgtgtctattgagatgatcatgtgtttttttgcattttattctattaacatagtatattcattgatttttcaaatatatccaattgccttttggataaaaaataaaatttgttggttggtatacagagttctgcttgggctggtatcaacaggtctgctgagtcatacattgttactcttgccctttcttctctgttcttcagccatactggcctttctttagtagtccaagatagttttctcctttttatatgctcctctttctggctagaagatacctctagctagaagatacctcctattaccccacacttactagttaacttaaatttgtctttcagatattttcttaatcatctcttactgagagaagtcactttctctgttgtaagctcccaatgccccatgttgctttatcatagaatttgtctccacttgtaattatataatttgggaataattaattcaaacaaacactttgttattacttcacattgtatcactaatatctagtaaagtacccacaatgtgatgggcattcagtaaacattgtaaaatgtatgaatatatgagtcatggaccaagaagcgaaagatactttagcagtattttgaggtatctgataagttctaagagatgtgataaggcatattctggaaacttccagtattttcacatgtctgtgccattaagtttaggttggactgttgccagaaataaagctataattttagataggtattccttaatgaacctactatgtcatagtaagtagtattattgtatcctggttatttccagttattcaagcttggatattttagtcattactattttctctcttttaaatttcaaacttaactatttagcagtctttcaattatttttgctctacaatgttccttctataattatagtttatatttgcattattatagtcttctgctgttgtttcaaatttattgtctttacctttagattcttctacatcaatccttgtgtcatatgtaaaggtaaaagatttttttaaaaagggcaaaaacacttcagaaaacactaatagcatggtttgattgttgggtgagatgcatacaatggaaagtgtgaggcctgacagagatccaagtgacaacttaatcttgtcctccttagaagtttttatgaatcatacaaactatgaaggaaaaagtgaaatattttaggcaaaataactgtagtaaaaaatttttcactttcaggtataggaatattccaacagtataagtaattaatttaaaatagtgaagttaatagagaagtctgacgggaattattataacctgcctcggtttccttatctttcctgaattaatgtttgcagaatgctttaaacagagtttgatgctcaggaaagccttgacaatatcttctattattattcctatatgatatttgtattactgaagataatgtaaattactcaaagtttcttcctcaacaatgagtatggtgcattataagtaatgagctaatattagtgtctattccactttagctgcaattcaaaaccccaaatgttgtgaaaaccaaagagtaatttttgtcattcatttgatagccaaatttgacctaaaccaatatctggctacttccagtctttacttatccctctcagtgtaaaaattcatgtgtttcactgtaggaatataaattttaaaaataaaaggtaactactgggtgtgtcagataatgtaagatatatgcaaatattcctaaaataattctgaatttcaagataaattcagttccaaagactttatttatttatttatttatttatttattttatttatttatttgagactgagtctcactctatcacccaggctggagtgcagtgctgcaatcttagctcactgcaacctccacctccctggttccagcaattttcctgcctcagcctcccaagtagctgggattataggcacccaccaccatgcctggctaatttttgtattttcagtggagatggtgtttcaccatgctggccaggctgatctggaactcctgacctcaagtgatccacccgcgttggcctcccaaagtgctgggattacaggtgtgagccaccgtgcctagccccaaagactttaaataatgaattgtgagactgtagtatgttctcaataaatacctgtggactaattgaaaaacaaatcaaggataaagtcatggataaattatactcaaaggaaagctataaagtaggtactgctgttattgaccctctttacagatgagaaatgagatttaagggtaggtattatttgttcaatatcatttagtgtgtacagccatgactctgacattaaaatttatgttcctagcctatactttttatagcctgtgctctgtaccagcattcaagaagctgcaatacttttaaaatgccagacattatttatttgtttacaatactttatcttgaaaaaatatgtacactaattctatataatttggggagtttgaaaactagttattatttattttcaccttgtagtaaaatattatattatctgatgtcgaatttttaattcagtagttctaatgtttaaatatttataaaatgtgttttaaacattttgctgagccaaatatatcagatcacactaggaaatgcaaccctcgtggaagtaaataatgtatgctaatcatcctcttctatttctcgcagatggtgtcacattatctgtcaaattaaactcatgattgtgtttttattttaaattatgtacataaactatatcttaagaaaaacagtcatttcctttttgttatttttatgttattttccttctctttgcaaataccttgaatacaaggaagatcatgtttagcataaaaatcccaagtttaacacccaaaaagcaaaatactcattaaatataccagcagtaataggcttatatgcattgctactttctggatttcaatggaagggttttggatgacgtttttaaacatgaagtgatttgattagaaagtcaatgaatatagctcttgaattctataaaatgcatgtaagtacatgttgatatattaatgccaatgattcattctaaggaacaacaaaagtggatatttaacagatttataattttttccttcatgaaatgagatcattctaatctaatataataaaagatacctaggctagattttacataattatgaaatattataaattctcagaagaatagatttgtgtctcagaaacagtaaattcataagactactctgatattgatttaatccttttaatatattttatagaattcttctgcattcacttcccagcatctaagaagcattaagtttatgacaatttacctcaatgaaggtatgctgcttttttaaaaatgtacttaatactctccattatatttcatagacaacattctcaattgaattttatgttaccactgttctccattttctgccccaactcaacacattcttcaaccatttcaatcagatttctaatcttgctttatttgaaaagtagattaagttcatattgataaatccaaattgcatgactcaggtcttagtccatatatatatacatatatatatatatatatatatatttttttttttttttttttttttgagacactgggccttctcatgttgctaggctggccttgaactactgagcccaagtaatcctcccacctcagcctcctgagtagatgggactacagactcacaccactgcaacatcttatttcatttttgaggtatattcagcagtcaatacttttgactactctctctttcgttaaatcactgcgtttccttgaaatcaattttaagttcctggttatccttttaccttagtctattttgcccagatagttttggcatttttctcatttcttctcctctaacacttaaatgatgaagttcataggaccctatactcccttggtgatctcatctactctcatacctttaacaccatttatcatttactaacctgtatctttagtccagatttgccttctcagctataaacctgtatttcccactgatacttgtcatctttatgttttaggaaagtctcagccttaaaatttcaaattcaaactcatattcctttctttctgcaaagatgtgcccagttcattaatttgaccattacttattgttttcaaattgaaatcttggcatcaactttttaaattgacaaacaaaattttatgtatttatggtgcacgacatgatgttttgaaatatgtttacatcagccgagtgcggtggctcacgcctgtaatcccaacactttgggaggccgaggaaggtggatcacctgaggtcaggagttcgagaccagcctggccaacatggcgaaacactatctctactaaaaatacaaaaattagccgggcatggtggcacacacctgtagtcccagctactcgggaggctgaggcaggagaatagcttcaacctgggaggcggaggttgcagtgagccaagatcgcaccactgcactcatcttgatttctctcatttccatttcctacagacctgacaactgaatatatattgactctgtccactgtttatatcgtggtgaaatatacataatataaaatttacccccaatcataaaagtgtactattcaatagcattgagaccattcacaatgtactgcaactctgactactatatagttacagagctttttcatcacccctaacagaaatccatatatattaagccgtcactccccaacacccacttagtccctggccactaccaatctgctttctatctcttgaatttgcctattctgaatatcttatataaatgaaattatacaatatgtggcctttgcgtctggcttctttcactttgcatagcacgtatccacaatttgtggatatgtctattaaattcacttgcccatttttaattgggttgttctattcttgctgagttgtaaggattccttatatattttagatactaaacctttttgagagatataattttcaaatattttatcccaaagacaatcgtgtcttttcactctttatactgtcatttgttgcatattttttaaaaaatcgatagtctaatgtattcatgttttctattttgttgctttgtgctcttggtatcatatctagtaaattattgctagatctaaggttgtgaaaaattgcctaaatgtttttctttaagagttttataggcttagctctcatacttaggtgtttgattcatttggaatttttgtatttagtgtgaggcaagggcccaacttttttcttttgcatgtggatttccatttgtctgaacataaatttgttgaaaagactattcttttcccattgaacagccttagcaaccttgttgaaaataagttgactgtagatttaccatttatttctagaatctcagtcttatccattaatcaatattgtctatcctgtgacagtgccatactgtttggatcactgtaaatatgtaggaaattttacaaaagttttgtgtttgtcctcccactttgtttttctttttcaatattgttttgaccattcaaattcctttgcaattcaagatttcattcacctagaacttcagtttatttctgtgatgtcttatgattttcagtgtgtaagtcctgaatgcctttggttgaattcagtcctaagtatcttatttcatgatgctattgtggatggaacttaatttttcttttcaaattcttcattgatattgtatagaaacacaatttatttttgtgtgtttgtattatattctgcaactttgataaatttgcttattaggtctaataggtttttttcccctaagattttccttatataagatcatgccatctatgaatatacatagttttacttccaatttttactttccatttccatttaaattgacttttattttttatcttgcctacttcctctggctaggatttccaataaaatgtttaatagtactggccaaacagtcatccatggcgtacttaggaggaaagtttccaggcttttattattaattagcatgttagcaatgattttttaaagacgctttttatctttgaagcagttacattctatttcttatttgttaaaggttttaaaattaaaccaaaaaagagtattagatttttgtaagtgctttttctataccacttgagataacgatgtaatttttattcataatttcattggtaaaatatatgccattaatttccatatgttgaaccatctttgcatttctgaataaatcttagttatgattcataaatattttaatatgctgctggaattgttttgataatatagtgctgagaagttttccatctatattcattagttatatgggtgagctattttcttttctaatattattttctggtactggtatcagggtaattctggcttcatagaatgatttagaaactttgtcctccttctctatttttggaaggattttggaaagattggtgctaattctttttaaaatggttaaaagaattcatcatttaaaatgcctggtcctggccttttttattgtcgttgtttaaagagtttttattacagattcaatctctttactcataatggatctcttgatagtttccatgtgtttttgattcagctttggtaattcatgttttttggagaaatatgtgcatttcatttatttacctattttgtgggcatacaattgtccaaaacattattttacattttattttgtacaggttttgtagtaatatgtccactttcacttatgactttaatgatttgagtctcctttctcaatctatataaatgattgtcaattatatcaaactttttcaaagaacaaacatttgacttatttggttttctctattgattttttattttctgaatcatttagttctgctctaatcatgataattccttgcttctgctagttttagatttagtttgcttatcattttttagttccttatggtgtagagttagaatattgagttgagatctttcttctttttttaatataggtatatgcagctataaattttactctgagcatgggttttactaaaactctacatttttacaagttgtttattccttttactttgtctgaagacattttctaaaatcttttgtggtaagttctttgacccattgttgagagtgtattgtttaacttacatatattttgaagtttcccaattttcttatgttatcaatttctagattcatagcatcatagtcagaggagattcctttgtataattaatatctatataattttattgagacttgttatgtggtttaacatatggtttatttggggaaaggttccacatgtacttaatatttggtcttttgttatgtgggtgaagtattctgtatatgcccattagttctaacaggtttatagggttgtacaaatcttaatctacttgctgatttttatgctagtttttctacctgttattgaaagtgagactatgaaatcttattatagaacttctttcttttctccatttttaattatttatatgtttgggggccatgtttttgcgtgggtatatgtttttaattgctatctattatgggtggattggccttgactgttgcaaacaataattgacaatatctattatacctgaaattactatatgcactctaattttcttttcatcactattttttatggaatgcttttgaaaaatgacttactttcaaactatttgtatttttggatccaaagtgagtctcttgttcacagcatatagatgtatcatataattgctctattctacctatctctggacttcaactggagatttttatccgtttacatttatatcatttatttctaagaaaacatttactcgcaccattttgttatttgttttctatatgtcatatatcttttttgttcctcaattctttcactattgccttcttttgtgttcaattgattttttgtattgtactgttttgattcctctctgtatattatctattatttcatttctcagtggttatctcactgattacaattaacataataaacttaaagtagcctattattaaattaataccatcttagttaaaatgacatataaaatctctgctcctttacatctttgttacttctcctatatgttggtatttttgaaaatgaccatatgctcattagcatagatttagaattattgttttatgttatataggaaaataagaggaaatataaaacaaaaataaaataattctgtattttatatttacctatgtggtaacctttgctaatgtttcttttcatttctttgcatgattttgatttaatatttgctgcctttcatttcagcctgaaagattctcattagcatgttttatagaggatgtgtactagtagcaaatgccttcatattttgtttatttgaagatatcttatttactgttttgttaggattgttttgcttggcataaaatttttgattgacagatctttctgtttgtttcaatactttaaaaatatcatctttttgccttctggcctttatggatttttacaaaaaattggttgttagtgagaatcaactgtacttgctgacttccttattttctactactttcaagattctctttgtcattgtcctttgccattttgactataactcagtacggatctcttggagtttatgcttcttggagactattgaatgcattggatgtagagactcatgtctttcctcatatttggaaagtttttattatcatgtcttcaaagatgttttttctgctcatttctttctgtcctacccatctgaaactgccattgtgcatacattggtacattttatggtgttccagagatctcttaaatattatttatttttttaaaatttattttgcctcctcagggcagtttcaatcgtcttatcttctagttgaatgactatttcttttgtttgcttaaattttctgttgagcttttctagtaaattttgcgttttagttattgtacttttcaactccagaatttctttttggttcctttttaaattgctatcattgtattgattccctatttgttgagtcattgtgcttctagttttctttagttttttttttttttttttccagtgtcctttagtcctttaccctttaagcatatttgagacagtgggtttatagtcttttttttttcttctgttttccagagactcgctctgtagcccaggctggagtacagtggtgtgatcttggctcactgcaacctccgcctcctgggttcaagcaattctcctgtctcagcctcctgagtagctaggacaacaggtgcgtgccaccacacccagctaatgttttgtatttttagtagagacagggtttcactgtgttagccaggatggtcttgatctcccgatttcatgagctgcctgccttggcctcccaaagtggtgggattacaagtgtgagccaccacacccagcctataatgtttttatagtaccaaaacttgtgctccattattatcagtttctttgggttttctttcttctgtgaaagggctattgtttcttttttgcaggcatcataattttttgttaaattggggcatttgtataattatgatttggtatatctgaaaatgaaactctccccacacctcaggatttggtattattgattactttaagttgtaacctattttttgaagactgaattcgtttgttatgtatagtctcagaagtcttggttaatttggtgaagtggttagctagtggtttaacatattttttcatccttctggggtaagaaatttataatgaaaagaaaaaaaacacatttttaaaatctttgcctattgactctgttttggtcactccttccatgcttagttggttatttctgatgctacctgacccttcatttcctacttctgctgaacatatacatgagccagaagtgaaaggttatggagtctcagatcatttttgagcctgcattccattctacttgtttcttggttttccacattccccagtatatgcaggagatttttaaagctcgtattttaggaagtgttttactccacaacctttccttcaaagcttttggcatgtctattttttgcccaactgttatctcttgctccaggtaacagaggcttgttcatctgctttttgattgtttgaaggcgcttccttcccaaatttgtttcttcaccctaacagagatctgagttaggcaaaataaagtcaagcctcttgtgtcagtcatttaggcagactcacgcaggtcaaaatatacaaacatgattcctttggaataaggtctgttctgctgcctacagaaccaggaacccacaccaggaatgcaggttgctgatttcaggactgccatcacactagggaattgtgtgtgacaagggtaaattaaaactcctcaaagcttttccactaggtttaagtagtctttctcatgattgaacattttatttattgctatgaacatttgaccatcttccagagttctggtaaagtaaattcacttttaccagtttatagtttttaggggggcacatatttcttgggggacagtataccctgaaattccctacccgaccatttttctgatatcttgctcagttctcttttttgtcactactaccgccactttaaatgaggctactatcagctcttcctgaaagatagtcatatacttttcacaagttatttcataggtacatttggctccagctaatacattctccatgaggagaccataaaaactacaaactataaacttgattattattttttctgcttagaatactttagagttttatatagacctttaggctataaaccaaaatcattttaatggattacaagacttcatggctgggtccttcctctctctacttatatgttttcttttaggtctttgtatttcaggtgcatgtacttccttctactttttaaaatcagtctcacacatctccactttctgactctttcagtgactttcttcattttcttcctagttttgctttcccttgccttttttttacttcagagttctcacatatgttaatccttcttttacacatttgcctaggtagtcaacattttggtcaacaacagattgcatataagatagtgttcccataaaaataaacaaggttacttcaaaaagtgtgtagataaatggaattaaaatataagcatataaatataaactttatttcttaatgtaagcttcaccaagataaagacacttatgtaagggatgatacagaccatttagtccaattctaaagaagtgaagatctttggaatttaaacatatcaatgaagtctttcttcattattaactgaagaaaaacaggtgggctttaaagatttttttaacattaggaaaagaaaataatacagaaggagccaaatcaggaccttaagttggatttctggtgttttctcatagaaactcacacaaaattgctttatttcataagttgaataagcaggaacattgttattgttgagaaggactctggttaagcgttcctggacatttgttttttactaaagctttagctaactttttcataataagtacatattatcattctttgaccctccagaaattcaacagtaaaatgtctagcacatcagcaaaactgttgccatgatctttgcttttgacccatctgatatgctttgattggaccatttccatctcttggtagccattgctttgattgtgctttgttttcaggatcacactaataaagccatgtttcatctcctgttataatctttaaaaaagtttttcagtcttgattccacttgtttaaaaggcatggagtggcaatttggataaagaagcaaaatccaactgtatgcggtcttcaagagacccatctcacatgctatgacacccatagaatccaagtatagagatggagaaagatgtatcaagaaaaataaaaaaaaaagagcaggagttgctattggtatttcataaaaaatagactttaaaccatcaaatatcaaaaagaatgaagaagggcatgacatattgataaaggattcaatttaacaagaatccttaactgtcctaaatgtgtgtgtgtgtgtgtgtgtgtgtgtgtgtgtatgcaaccaatgctggagctcacagattcataaaacaacttcttagagacttattaagagacttaaataacaatacaataatagtgggagtcttcaacatctcactgacattgttgtaggaaaaacaggttgttgtcacaggaccaggaaaatttagacgtgtggacacattgtagggtgattaggggagggtttaatgggagaaaagaaaaaaggaaagaggaactttcagcaatgtgagagagagtcctgctagcaggtctcccacctcactgattgaatcccaggtcaccacccaggaactgaagaggccaggctcctccccactgcaaatgacatgaacttcctgagactccaccctgtccttccaatgtgcaagtgggcattattcagagagaatcagttgggaaagggagggcttcatctgggaccagcagtccggtttttcagccctcaggctgaaaattaatacccaagaatatttctaaaatccatgcaattacatagaaattaaacaacctgttcctgaatgactaactaataaaatcaagtaactaataaagttaaggcagaaatcaagagattatttgaaacgaatgaaaacaaatatacaacataccagaatctctgggggcacagctaaaaccatgttaagagaaaagtttagagtgttaaacacccacattaaaaagttagaaagatctcagcaacttaacaacatgcttaaaggaactagaaaaacaagatgaaaccaatctcaaagctatgagaagaaaaataataatcaaaatcagagcttactgaatgtaatttaggcacaaaaaaaatacaaaagattaatgtaaccaaaattcggttctttgaaataatacataagattactagactacaaactagactaaaagaaaaaaaaagagaggacattcaaataaacacaatcagaaatgacaaaggtgaaattaccactgacaccacagaaataaaaacaattcttaaagactattataaatatctctctgcatagaaacccaaaaacctagaaaaaatggaaaaactcctggacacatacaacctcccaagcttaaactaagaagaaattaaaactctgaatagatcaataacaggttccaaaatagaatgtcataaaaagcctaccaaccagaaaaaactctgcaccagacatatccacagctgaattctaccagttgtacaaaaaagagctggtatcaattctactgaaactattacaaaaagtcaaggaagaaggactcctccctaactcattctattaggccaacatcattctgataccaaaacctggcagagaaacaatgaagaaagaaaatgttagggcaatactcctggtgaacatagatgcaaaaatcctcaggaaaatactagcaaaccaaatccagtagcacatccaaaagctaatccaccaggatcaagtaggctttatttctgagttgcaagttaggttcaacgtatgcaagcaaatcaacgtgatttatcacattttaaatacaactaaaaacaaacaccacatgatcatcacaatggatgaagataacacttttgataaaattcaacttcccttcatgttaaaaaccctcaacaaactaggcattgaagaaacatacctcaaaatattaagagccgtttctgacaaacccacaaccagcatcatatggaatggggaaaagctggaagcagtcctcttgagaactgagacaagacaaggatgcccactgtcaccatttctattcaacatagtactggaagttctagccagagcaataaggtaagagaaagaagtcaaaggcatccaaataggaagagagggagccaagaagtttcccttcacagaagatataaatctatacctagaaaataccatagtctctgctcaaaggctcctagatctagtaaacaacttcaggaaagtttcaggatacataatcaatgtataaaatcagtaaaatttctaaacaccaattacatccaagctgagagccaaatcaagaacaaaccgcccaccccaacacacacacacacataattacctgggaacacagctaattagggaggtgaaagacctctacagcaagaaatataaaacgctgctaaaagaaatcagagatgatgcaaaaaaattaaaaaaattccatgtaatggataggaagaatcaatattgttaaaatggccatattgtccaaatcaatttagagattcaatgctattcctgtcaaactaccaacaacatttttcagagaattagaaaaaactactctaaaattcatgtggaaccaaaaaatagctaaaataacgaaagcaatcctaagcaaaatgtacaaagccaaatacattagactacccaacttcaaactatattacaaggctacagtaaccaaaaccacatgatactggcacaaaaatagacacgtagaccaatggaacaggttaaagaacccaacaatgaaggttcacacctacccccacctgactattgacaaagtcaagaaaaacaagaaataggggaaagactccctatttaaaaaatgttacaatgactgcttagtcatatgcagaagataaaaattgaacccattcatttcaccatatacaaaaattaactcaagatggattaaagacttaaatatataacctaaaactacaaaatcccttgaagaaaacctaggaaaatatcattccagatataggccctgggaaagatttcatgatgaagactctgaaagcagttgcaacaaaacaaaaattcacaaattgaacttcaataaactaaagagcttctgcacagcaaaggaaacgatcaacagagtaaaaagacaacctacaaaatggggtaaaatacacactatgcctccaagagaaatctaatatccagaatataaaaggaatttaaacaaattaacaagcaaaaaacaatcctgttaaaaaatgggcaaaggatatgaagagaaacttctcaagacatatacatggacaagaagcatttaaaaaaaattctcaacgtcacgaatcattcaagaaatgcaaatcaaaatcactatgatactatccacagcagtcagaaaggctattattgaaaagtcaaaaaataacagatgttagcaaggttgcagaaaaaatgacatgtgtatatactacctacgggaatgtaaattagttcagccactatggaaagcagttttgtaatttctaaaacaacttaaaacagagctgccatttaattcagcattcctattactggatatatatccaaaggaatataaataattctactgtaaagacacatgtatgcacgtttatctcagcactactcacaatagcaaagacatggaatcaacctagatgctcatcaatggtggactggataaagaaaatgtggtgcatatacataatagaacaccacacagccataaaaaataatatattatgtaatatttaatatgtataacttgctttttataattataataaataatacgtagataaaatgaaatgaaataaacagaaactatgttagacctctctaaatttttttttattttaaataaccaaggcaaaaatgtggagcaggaagtccatgcttttaattattttattagttgttagtcattggcaaaattctttaatcactctaggtttcatcactaaagtagaattgataaaccctactcaagtcagatgattgttttacaaataaaatcagctaatatgtattaaaatgcttcatattgttttacaaaaacacaaattataatgtattcatttatcaatttttgaaataaatattaaactcccattatgtcccatgtgcagcaccattatcatcatcaccattatctgggatctttgcatgctatggggccaattgatgtaccaatacatttgggtaataagtgtttgatatgtgtgattactatacttgtggtaccaatctgacatgatttcaaggaaaatttacaaaagaaaacactttaaaaattgagtaaattaggtaatgtgaggcaggacatatctgatttttaaaatacttttctaactttagattttggagatgcttgtgaagagtccatggattattttagaaatagatttagactctgggtaacttttataaattaaataactgatatgttaaatttgttgaaggaaagcatttctgaatccttctctttcccttctatctctttctaaattacatcttaaacattcattgcatttttgtccccaggtatggtacagaacatatcagaaaaccaagaagtcacgtgttaaccatctcatggtttttgaaaagtgaattagcatatctgggtcctaatttgtgtccatgctagaaaaatccttataggaatagtttagttgggatacaaacatattcatataacaaactgagaatctcctttgacttcttaaaatgcaagcgaaaccaacaacaacaaaaataagtaaaattgagggaaggggggcatttggaaagtccaagtaattctgagaataccacaatgtctctcactgcagcatcattgaactcacaactgattattagagcaaaaagatgttaataaaagggcaaataaaaactcggtgaatgctgctctgcaattctcctgggacactgagagccacatacattgggaatattactggagttattggaaaaagcattggcaaacatggtggcaggattagcaatgatggatgcagcagttgtagtgatagttagcaatggcaagggtaccaaatgtgacgcctcattgccttcaatgttaggtattatgaccaaagacagcactcttgattattgctacggtggtatttgtggtgcttttggtaggtagtaactctggccatacaactcttccttttggaaatagcaataattagagacatccctgaagcaatagagaaggaaaatagatactatctggtgttcaaggcaattagttaatccttgaatgtctcataaagcatctatttgctattactagaacaatttaggagaaacaagtagaaaaccagatttgtggtagagaggatgggaaagtgtcagtgaaatgctattttacggctattgctttattttccaactggttagactggagaaccaatggtcacatttgttttgttatgatttaggtagtcaaaacttaacaaaagcaatgtttcattttaccataaaaacgtgcatttaaaactcactaaaataatctttgctctttctcataacaagactgtgtgttatcattattgagcacatggtatattctagccaattaacttacatctaatctttgtaaccaaaggactttcgttctttgttaatttcaactgtctggcatcaacaatcttccgtttttgcttgtatcactccaaaatagcataatgtactacctctcctaaagtacattaacaaaagcttcctcctctcttcccactttatacccatccagtcttttctccttaatctgatgaagttgctcaagacaagtgttcatgtcaagatcattgatgacttcataccgtcagatccacaagagacattctcattttagctgaacggcattcatcaacacctggtataattgattactcacttctcaaaatatccctcctatcaccacatcctacttgttttttctcttatttttctggacaattatgttaaatcttcattataatttctccatctttatatgacctctatatggcataatggggtagttatctggattttaggattaggtccacagtctatttttctgcttttttttcctgagagatactgtctcctgtactgtgtcaaaaccttcatatggatgtgggtgtgtgcctacattgtgtatgtgtgtgttgtgtgtatatgcgtgtgtgtatggcaaagatagctcctattaacttcatttgtatattcaataaactgcataatatcttcacttaagtatctcacaaacatgtaaaactgaactttaggtttttttccccatccccttcttttctggcatatgtatttagcattgtgaattgaatatatttatatattgctttaacgtatttcatttattcaatcaaaacatgtgggataagtatctaaaataaatgagactatacaaagttgtatggggatgactaaccaaataaaagctgttgcctttaaaaaggcgatagggttacagacacaagagttcaactctagaagactgtgttataggttttgtaagtgcaaaaagtgtacaatagaaaggcaataaatagttttatgaagagaagtgacatgactagaattaaatcttatgttttctactgtggctgctttgcagaaaatgcatttaagtttgtagggatttaaataggcatggaaaatgaggactgcaaaaggttaatagtaagacaaattatcagcctattataggagacactagtactttagtctagagtaatgctagcagaaatggaaagaaatgaatagatttgatataattttggtgataaattttatgttacttgccgaggaaaatactatatttcaaaaagaggtactgtgtattatctgctaaaataatttaataacttctgcctttgggatttagatacatttatatagagcctgaaaatagtaggcatgtaataaatgttgaatgtttaaatgaatagatgactagaggaacaaacagctggatggatgaatacatgtgtacatgcatagtgaattcaactcattaaactgatgatcacctatagtttttatattgaatactatattgctttttagcatatatagcagtagatacatgtgtatatttgtttgctggttattttgtcagatacttctttttaaacttttatagaagattttaaatagatttttgcttatcacataaaggaccctgggaaaacttgaaaattaagaaagaagcaatcacctgcaaaaaagtttttgtttattccctaaacaaatgcagctgaatattctttagagaaataagcaagctattcagctaagttgatttttacatttatatgcattatacttacagtcacctttttcctaaaaaaaaaaatcacagaatatcaagtactactctatataaagtttttttgtacctaaaataattactatagaaggatattattagtgttactatagaatattactatagaaggatattattaatatttctcccccttttcccccaaaacaatgtgctgttttcaatcttactttcgctttaatacttgtgaaaattaagatgatgatatattttaaatagatagctttgatttgcataaaatataagtttgcacaagcttttgaaagcacttcagagagtacttaaagctgagtatattttttggctgattatacatgcagtagtaaactgcatctggcgatatatattttattaacagtttcctcatccttctgcctaaatctactgatttattgatggtttccttttacctctgctatgattctaatgctcccaaaactttttttttttccttcttatgcttgtttatatgaaccaccattgtgtggataagggtgagagcacagaagaaatggattttagagtcaacattcagtacctattcaaaggtgactaggatgagagctagtgtgcttttgaagagagagagagaatagattaaggagatagctagctctctctccatatttaaagatggataacatctaccacttattaagagttgttattggcctagatatttaggtgatgctttgatagtcaattactaatgcctaggttatacattgtggggaaacactcttactttctgtgattacatctgaaccaaagtcttgttttcctgtcatgctgcttttaataatattttccttccttccttccttccttccttccttccttccttccttccttccttccttccttccctccctcccttttctccttctctctcctcttccctcctttctgctcttcctgcctccatctctctgtccttatttatgtatctatattaactcacatttttgttgccttagtgtaggcagtgtgtctttagttttacatttgagaaaaccagaaataaatactctgagtttttattacacattatatgattctactttattatacccaaatttcatctcatgtttaattataaaagtaataattaaaatattagaatatcagaaaatacacacaaacatacataagaacagaggtcagtgtggctgtcagaaattgtgttgtggaaagtatccacaaatgcagtatccattttcattattgcttactgggactattttgaaaatataatgttttaactgggcttccaatccccagtctttcttctattatatcatttctggattcacatgacactgattaaatacacacacatacacacacacaagattatagtgctctgtggttaggaaactgtgacagttccatgatacttccatgttaaattttcctgcaaattttactaaaattcgggttcccaagacctacctacaaatatttaaattcttagttatcagatggtgcctaggaatcagcattttaagaaacaaagtctttctgatgttcgacagtctaatcacattaactttcttaccatctctgtaaagagcacctacctttactctccatggccattgtatgtcctgtatctagaatatttggaatcactctcacacaaaagctcaagtcaaaaatttcttctactccactgtctggaatgaataactctaactcctcaatcttccctggcatctcgtttgtaccccaaatagtcttctcttttatattagggtaagttaatagatcttgtttcacatggagattttgaactttttttggtcagtataaacatttataagtgtttatattctttgtacctagcagatatttgtgaaacacaaaacttattttaaaggaataagcatagagtttgctcttgtttcagaatattggatatataaatacacatgcagacaccagaaatttttagatatatgattttattctttcatgtttaattataaaagtaacacttacagtattaaaatatcaggaaatacatataaacatatctgtcatctatctatctacctatctatcatctacctatataatgtcatccaaaagttgcaactcagaaaaattatatttactgacatttttaatagatcttttatatacaaaactatatttttctcaataaaaaagtttgctttaaaattttcttttctattattttaattaatagacattattgcttagagcagtattaggtttacataaaattttagcagaaaattcctttatacttcctttccatgccccaccgcaccctcagttctcctattattaacaccttgcattggtgtagtacatttgttacaattgatgagccaatattgacacattattattacataaagtctatagtttgtattagggtttattctcagtgttttacagttctgaggttttgacaaatgcataatagcatgtatgcacaattacattatcaacagggtagtttcactgccctagaaatcccctgtgttcctgcccctggcaaccactgattcctttactgcttctatagatttgctttctcagaatgtcatatatttggaatcacacactatgtagccttttcagagttacttctttctcttatcaatatgcattaaagattctcttatgtcattttctggtgtggggggggcttgataactcatttctctttattgctgaataatattccattgtttgtaccatagatttttattcattcgcctattggtggacattttggttgcttccaagttttggcagttatgtataaagctgctataaccatccatattcaggtttctatgtggacttaagtcttcagctcatttgggtaaatgtctgggagcatgattgctggatcaaaaggtgtgactatgtttagctttgtaagaagctatcagtgtcttccaaagtggctgtacaattttgtaatactatcaacaatgagtgagaacccttcttgtcccatgttctctctagaatttggtgtaagtgttctggattttaatcattatagcagtaatgcagtggtatctcgtttccatttgtaattccttaataacatattatatcaagcaaatttcatatgcttatttgtcatttgtatatattctttagtgaagtgtcacttcagaacttttgtcctgcttttttgttttttacttattttgaagttccaaaatcatcagttttttgacttcatagtaagaatgtggatttttaacaaatatttccgttttcctacataagcaaagtaatgtaacttagaaaatttttttgttgatgtgggccattatttttcctaaaaatattgtcatgttaatattttacatttaagccaaaaatatcttgtaagttaggcagcgtgctagttcaaatttggaatatacatgactatatatagtgtaattcaataacaaacacagataaccattacaggacttgttttctattgtgtagcctagagaatgaccctcaagttggttttgtgatataatatatgcagacaatatgacaggtaattgatttgatttaaaatataccttactggtgacaaattatagttttattactgagcgtagcaaaataatatttaaatgaacatctaatggagcaaacattttttaagaagagttgttaattttgccacagtacatttaaaatttggaccaagaaacagtgtaattatgagtataatgcatgttgtgatataatttctaatgtgttggtgagaaaaaaatcctacttagaagaattactggggatatattttgatacgcatgtaaggattcatatctaaaaaggttaatatttactccattctataacatgaactctgatttcttgtttgaaaattgtatggataatactccattttcatattcaagattacagtgtcctcaccataagccatgaagagaaacaaaagtgctgaagttgtttaaataacattataattttgataattctgtagtctcatgtaaatgtgcttaaataatgtattttctatagggttctgagaaattcaaaagaaaatttctgtggcaggcttacagagttatatatagaataataaaggccggaaaagaaacttcacaaaatagaaacatacaaaagatgtgtgttttagtactgttatatagatatgctctgacttactaaaacaaagctggcttattccaaggaaatcatgttcagtcatagaagcttcctgctgtatattttttggtgtgtatttcatactttaaactgctttgttttcattttttacattgcattttaaaggcacttaaatatctttataacttttttaaagctaaagagtcatttgttaaaatgctatagaaatacagtgaaatattagtctgagaggctttggatattacaatatagtctattccctgctagataccacagcaaattaaaaataaacatgccctggttattgtccattaacatcatgtaatctagaggttaaatccatcattagaaaatcaatcagccttataaattgtcagatattaaaatatccacttgaaattcttttgttttcaacttttattttaggctcaggggtacaggtgcagatttgttacatggaagtatggtgtgatcctcaggtttgaggtatgaatgattccgtcaccctagtagtgaccataatagccaacagggagttttcaaccctggtccgcctttcactctccccagtctagcagtccccagtgtctattgttttcttctttatgcccatgtgtgctcaatgtttagctcccacttataagtgagaatatgtggcatttggttttctgttcttatattaattcttttgggacaatggcctccagctgcatccatattgctgcaaaagacatgattttattctttttatggctgtgtagtattccacagcatacatatgccaccttttctttatccagtccactgttaattgccacctaggttgattccatgtcttgctattgtgaatagtgctaccattagaatggccattattaaaaagaccaaaaataacagatgctggcaatgttgcagagaaatgggaacatttatacagtgttggtggctatgtaaattagtccagtcactgtggaaaataatttggagatgtctcaaataacttaaaatagaagtaccattcaaccaaaaaatctcattactgagtatataccaaaatgaaattctaattgtcatcccaaagttaacatttccaaattgaaactcatatttccgttgcattccaaccccaacatgctccatccacagtcctctccatctcagttaaaagcaaccccattcttccagttctcaggccacaatacctggagtcatacttgattcttctctttctctcatactcctcaatcaaatcttcaggacattatggcattatggttactttctaaatatatttataaactgaattattactacttgtactactactggaagattggagttatcataaactttcttttaaattattgcagtagcctcataaatggttttcttctttgtaaatttggtcttctatttacattgaaattctaatgtctattattcaaataacgtccagaaggaatattttaaaacctaactccaaatattttactgaaatccgatcaaaacattgatggctctccatttctttcagagtatacagccggaatcactatacagtctaaaagaactgcatggccttcccccattacctctagactgcctctcttcttccccacacatgttcccctagctcctggagcttcctgcaatactccaagcacatcttgccctagtgaccttgctctactcttctgcttgcagctactttccccaagatacatgctttgctaagtcatcttcaactttggtcaagtctcatcttctcagatagcttttccttgactactcaagtaatactgtaacctgtgccatccccctttttcacatcctatctgtcactccttatcccttttactatgatctactattttctttacatttattcagatttcttctcaagatcaagcagtttatttaatgtatctctcctgtgttatattttatcatacgtagccaaaaaaaaaaaagttggaaatctttaactgggatttaactgggaagcagcaagcttcattaattaccccttttattttctgtattactgtaagttacagttggagcaaaacctattattacacagctttctgcctgactcaggaaagagcaattcaagcaaagcacaattggtatcactaagcaaaaagacagaaaatggctaagatggctagaatttttggaagagagtactggaaagaagggcactacacagaggaatgctccagaaactactaaagatagttacaaagttacaaagttacaaaggagatatagctcaatagtcaatacacttttgctcttctgtcagaggtatgtgaaccagagagactccatcttaagtaggagctgggcaaaatgaggccaaaacctactgggctgcattcccagatggttaaggcattctaagtaacaggatgagataagaggtcagcacaaaatacatgtcacataaagatcttgctgataaaacaggttgcagtaaaggagctggccgaaacctaccaaaaccaaaatggtcatgagagtgacctctggtcgtcctcactgcttcactcccaccagcttcatgacagttgacaaatgccatggcaatgtcaggaagttacactatatggtccaaaaaggggaggcatgaataatccaccccttgtttggtatatcatcaagaaataatcataaaaatgagcaaccagcagctctcggggctgctctgtctatggagtagccattcttttattcttttactttcttaataaacttgctttcagtttgcactgtggacttgccctgaattatttcttgcagaagatccaagaactctctcgtggggtctcgattgggacccctttcctgtaacatatttctggcaatcacgaagggaccatagtgcagaaaccgtgacctgacagctacctttgggtaagtgttgggtttctgtaacatctttctggcaaacccagaagggacaatacagaagaaaccccctaacccaaaggaaatagactgcagcactgattgaatgactttgggtaagtggtgtggtacccgggtaaataatgggattgggttagaggcccaacttaggggagtaagagtctctcctaagacagagtaggtaagaggcccttcttaataaaaggcaaggatgcttgactgaccttgggttagaggcctgacttaggagggttagagtcccttttaagatttagggggttagaagactgtctcagtaaagtcccactcggctaagaatacatttgacactatgggatgttaactgctattctcattggattaatctgccttgtactgtttgctgatggctgtgggtgacagggttaggcatgttcaggatcgtgggacatggggagctttttcctccctaataggggaaacttgagagctaataggcttactggaaaagatccctttgtaccaagaagcagctgactgaaattttcagtgccactgcaatgggtgggtctttctctggcctctctgatcatttcgccttccccaccctaccacaggcaatgcttttttctctccccttttgctttcttaatacaaaagattttgtattactcagggtgaccatcttgcccagagaccacgcattgaaactcctagaaggaggttggattaaagatgatggggcacatctgggggcaaatttaagccttgctggtttgatactgggtgctaagcagagtggttaacgtctgtgttttatcacatgtattttgctctggccagaatgaaaaaataaataaatttttcctttatgatgtgttttggctcccagggtgatgatgctgcaagcgaaatcactagggccgctcagggaaagggaacccagaagcctggcatgctggcaaaaacataagaatttcttacatcagatttctggattctctctctctgtgcaaatggttgaatgaatggaaaaaaagaatcagtgtttatctcctctttaaagttttgattaatgcaaaaaaaattctaatgctagtcttaacctggtgtactttgtgctatgagttcatttttctgtgttgagggatactttaggataaaacaagggcttagaacacctgtaagcctgctcttcaaaaagacaacaagctggtcagtaacaaacttggctgcaggtccctgaaacaaacaaacaaaaaaaccaaaaaactggatgaagtctctatcttgttttatgtccttgggagtttgactttttttttttttttgagacggagtctcaccctgtttccaggctggagtgcagtggcatgatctcaactcactgctacctctgcctcctgggttcaagccattcttctacctcagcctcccgagcaaccagaattacaggcatgcaccaccacgcccagctaattttttgtatttttagtagagacagggtctcagcacgttggccaacctggtctcaaacgcctgacttcaggtgatccacccacctcagcctcccaaagtgctgggattacagaggcctgagccactgtgcccagcgggagcttgacctttaaccatgtggctgtaccttctcttggtctctgccttccagggaacaggaattttagggtttatgtgctagtcagctctaaaaatcatattaggctgggcgcagtggctcacacctataatccgagcagtttgagaggccgaggcaggcagatcacttgaggtcaggatttcaagaccagcctggccaactttagtctctactaaaaatacaaaaattagccgggcatggtctgggcatggtggcgcacacctgtaatcccagctacttaagaggctgaggcaggagaattgcttgaacgcagaaggtagaggttgcagtaggtggagatcacgccactgtgctccagcctgggcaacagtgcaagactccatctcaaaaaataaataaaaataaataaaaacaaaaatcatattaaataattaaaagcctttgcaagctccaaattaactactctagaattcttctgggaaagacaatggggacagccccatgctgcagctcagtagctaaagttttgcactttcacagtggcggtctggttttgattctccacctaggaagtaagttctttctggtttaatatgtgcgtgaccttgtctattctcttctccatggactgtcttaaattttcctttctctaagcacctcggtggttgtctttggtgaagttcagaagctagaaatattgactgcttggcatggataaagtagggtaataagagatctgaaaggattttttttaaagagcactgtgtttaaaagtcagtttaattaaaagtggataaacaagctttagatatatttaaaatgcctttacgtttttctcttcttggaacttgtttttctggaaaaaggtttttttcttctcattcgactggattatttttctccatattttttgtcttgccactcttaacggacacatgggaggccctaagataacttctgttagcctgtgactaattgggaaaaacagaggaggcgccacagaccctgttttggaaaaaccctctgttttcctcatgaaaccccaggaattaaaagcagattgatccctctcaaaatcaaaggctctgttcctgttttacttgtgttatctgatggttttgagttttgggggtatcagaaattacttcccattataagagagctttggtgtgtaataactaggtaagaaatataatttaaaggatgactaataatagttacggagggatacttgaccctttgcacacttggatcagagacgcatgctctcggccatctggaagataaggaaacatcctcatcccccactgggagatgagactcccatgaggggtggtgggctgatgacaaaatgggctgattggctttgggttgccttgcaatgaaatgcagagtagaagcactgcactgtcttctcctatagtatttccctccttttggggatcaaggaacaagtataaaatggcaaccttaattttggagacctgtctttgccttcagttgcttatttgctgcccttatttgaccctagaaaaacaggctttcctggccgtgttcctccaatggctgcaccctgaaggcagtaatccaactaagaaactggcaaatgaaaaatcttacaagtgctgaaccttctgtctatttatatgtgttatatgtttatatataagagagctctaattaattggcttagaaaaataagtgcttaaatcaaatattttgtagaaaaatagaaactttaatacctttttgtcacaaagctttagtaatattttggaaataaagatagttttaaagactattggtaaaataaaatggcttgaaaatgtagacgtttggtctaaattaaggtcaggtatcacatttgctaaatgctttaaggtcaaactgcttctttaacttttaaaaattgttccatttatataccttaaagccattagagcctagataaggcctgggaacacgtggaattagccatgccctctagctatataaagaagattataaagaaagagattttatataagaaaggatcttgtatggtaaattattgtcctaaagtaaaatgaccagttgtttaaaaggagggattttagggcaagtcagaaagtacaaggatgtctcatacggtccatgtgagtcatgaaaagatttgtgaaagggaatttatggaagaaatgttgtacaattcaaaggttgttagacctcctaaatgcttcataaaatgccactataactcttgtcgtacaacttgcctgcttaagtaaggtaagacctggggacatgtggagttagccaagcccctagctatcctggagagtcagctcttgtctgcatttcttcctggtgtgtgctaggctaggctccacacttagtacctaattaaaatctcttacttaccaaggttttcaccaaaaataaaagttgctgagagttaatattataacatgaaattaaaactactaaagaaacgattttacatgcaaaggtgtgtaaagaaagtaaaatgtgtttttggtgaaagattataagaagccatggaaatgtggatttttttttttcctttctgcctaaagtgttaaatgattgctttacgtaagaaaaaaatctaaaatttaagcaagttgtggaaggtttataaaaattaattgtaagatattctgtgtgtgaacatattggctaaagttaaaggggtattattcaggtttttccataaattaaacattggaataaaaacacaacaggttttccttagagtactgatttgctctttcacaaaagaatgtaaagggttattaaaaaaaagggttgtaagaatcttaccttagggtgaaacattaaaattgagtaaatatgtctataaggttttattaaaaattagttttaacattaatagtacattaatgtaaaggtgaaatttggtttatttggtataaaaatcacacaggaggcactatcaagtgtgaaatcatgttttgctttctttgaactatatttgcataaatgtgttattggtatatgttccaaagttaagggaaactcctataagtctaatatgacttagcgtatgctattgataattatcattgttgtgtaaaattttgtgtgccacagaagtaaccaaatttccttatcaattgtggctttaatagtggctgtcctaaaactttttatcatccatagacaattgttgccatgttttaaccctctttagaaggtggtttataatcaacaatagaactctagcaggtgttcttaaatgcaggtttctaataactttgaagattatgacatcagaataaaggaaaaaactttcagaactctcatagagagctgaaatgttcataactatcaaacagaagttaactacacagactaaactgaagaagtcaaatctttttaactttgcataaaatgtttctgatcctttgttttgtttttcagagtcaaggaaacttttcttttgagttacttacagcttgcagcaattaaataaagtatactgctgtgaacaaaatttggaacacatttgtttctctctacccgatttcttcagaatttggaaactagttgtgagtattcttaacttatggcaacatagttatttgcataagtgcaacaagaatctgttttcttttgtaacaggacacaattggaaaagttggttattttaccgaggacttaactggaatggtgtgctttcctttaaggaatcaaacttgacttttaaagccagtaaaagccctttggagaactggcctcatacctcacctacacagtccctgtacagggtttctgacctatggtaagtaaagaatgtcactttctcacaggtccaggagccccaggttatcttgagacctcaaaagcagagaaatttacccaactcaggtatttgatgggacaaacccgtggctgggctcagctttaaaaaagtcttatctaaaattccttctatggaacagagttccatcaacaccaatttaaaaataacttatgttaaaaatgaatactcttgctgcactttatacaaataatcaggtgaagtataataaagcaaatcagttttatcatgatttgtctttagtaaaaatgggaaactggagagagaaatattatatttcaaaaactatggtacaattgctattaaattctagtctcgttagttgtttttaagtttgtttctgcaatttagactaaccctgcttattcatgtaaaccaaccagtgatctctgactgctgttcagaagaaacaagagggatgggtgatgtgaaaatctggatcggtattctaattctgggcacattacaatcagctgacaaccccctatcagcttagttccaacagtttcccagttcatgaaaagacttctaatttagtttactcagaataactttacttattttgctttattcttgtggaatatattgctgttgtgctctttgtgtgggaatacagaacaagcttactgaatgttttcttaactaaacagttattaatcttccagatatcacctcttgtcgaaactcaagagtcatgaatggcccttgccgtactgacgctttctgaccgagcacttctctaccctgaatgcaagagaccctcatagttaggcaggaatatcatcacccctatacagcctgaagaagttgcagaagatggatctttgtcactctgccacccttaggtttcagcattctcttataaaagaaagggtagatatgtgagaggcatgtgaaccagagagactccatcttaagtaggagctgggtaaaatgaggctgaaacctactgggctgcattcccagacggttaaggcattctaagccacaggatgagataggaggtcagcacaaaatacaggtcacgaagaccttgctgataaaacagattgcagtaaaggagctggccaaaacttaccaaaaccaaaatggccatgagagtgacctctggtcgtcctcactgctacactcccaccagcaccattacagtttagaaatgccatagcaatgtcaggaagttactctatattgtccaaaaacgggaggcatgaataatccccccctgtttagcatatcatcaagaaataaccataaaagtgggcaaccagcagccctcaggctgctctgtctatggagtagtcattcttttattcctttactttcttaataaacttggttttacttttcaccacagacccacactgaattctttattgtgcaagatccaagaaccctctcttagggtctagatcgggagtcctttcctgtaacacttccttggctaacaaaattcctacttttttctaactctaatacaagagtctatcgtatttctaagtgatcacagctaatttgtatgacagctggttatgctcagcttttaccctcttgatattctgtaaattattttagggcaagtgatcacgcttattttcgttatgcttaggagtaacccataagcatttgttgaagaacaaaactaataaaataaaatgtcaagatgttggatgtagaagctgttcattttcaatttatgtttaaaagtaaatggaatgcttcaactttgatatgatgaacacatagtcactcttttaagttaatggtgctacaacttttagtaactcaaccagttaatttccaaatttttctttttaaaattaagaaattatatatttaaaatctaatcaattgccattagctgcactctttaacagtgaaaagctgacagtagacaaaatctttacacggaattttaacataaagctgtttatgaggtttaatatggttattaaagaaaaaaggctcctggctaacacggtgaaaccccgtctctactaaaaatacaaaaaattagccgggcgtggtggcgggcgcctgtagtcccagctattctggcggctgaggcaggagaatgacatgaacccaggaggcggagcttgcagtgagctgagatggcgccactgcactccagcctgggcgacagagcgagactctgtctcaaaaaaaaaaaaaaaaaaaaaaaaaggctagtttctaggggtaaaactcataagggtctaagcttattggttttatctagtactcagtatatgatatggaggaaaaattttactaacaaagaaatttttgagttttaaatgagaactatccaaagtagctaatttccagcagcattttttttttatcatttaactatgaaacatgatgattactcaagtagactataaccaccatccattaccttcctttagtattcactggaaagggaaaatgacaattctgacaagcttgtaaaatgtgatgtatcttaaaactcactaaggtttcttcataaaaacccacattatattccaaaactctataacatttctgactattttactttatagaaatctaaaagattaagaaagaggaaggaagtatgtttcctgaggtgaaaattatagtctactggttacttgaaaatgtttttcaaatggattgggcctaatgccaatatttagctaagaggttccatttcagattcaaagttccattattatctcagtctaatctacactgaatatttttaaatattatggtcttcaattaaaaaatgcattgctaaattgtgagtaaaagtctggattgacgaagctattttaaaattgtttgataaaattgtcaaaacaaaaatatgtctaccacctttctctgataaacttctaattctaactttgcaattaatacagcttattttcagatttaagactatttgtgatacttttctttaaccaaagtcctacagttattattgaacaaaagggaaaaaaaagcttttaagcttttttttttacctcataacaaaaatataaacaagacattactcttttcaagtattttaaatagttccatttagtcttgtttgctaaaatattcattgtacttgaatttatttttctctatgtctaaatacttcttctttgctaaactttcaaaatatggttgaggcagactgaataatggctcttcaaatgagatccacatcctaatccttgagatttgtgactattaccctatatggtaaaaaatgagataagtatcttgagatgggacagtatcttggcatatccaggtagggcttgaattacagttacaagtctctttttaagagaaaggcagaaagagatgtgagtcagataagaaatggcaacgtggccaccgaagcagattttgcagttatgtggccacaagccaaggaatgctgagtcaagggacaaattctccccttgagtcaccagagggagtaccgttc

SEQ ID NO: 618 - DNA, 20001 bp, Homo sapiens
tgggagcctagacaaggaacggctaggaattttgtttttgcaccacatatatcatggacggattaaaggcttcaagaagaaattaatcagtaagtgaatagacagctgcactagaggcaaggcactgtcctggcagctgcagggaccttgcagtggagctgtggtccattgccttcaagtgctcatgagctagatgagcagctgagccctaaatgggaaaagctaaataacaacatgccagataaacagtaataagattctaaagagtgatgctgtagtgaggagcaataagccctccaccagctggatttaacttcagatttatgaataactggtttatttgtaggagtaaactttcacaatgtgtggctgatgaatgacggggctggttggtgtgtttatagtgccagttttgtcagtgtggaagtccctgatttattagcattttgtataaaatctggaacacatttccccagtgaaaggatgtaataaatagttgttaagcatcagaaacctgcttatccaacatatatccaacatatatctgaaatacagtaaattttctactttattgccaggaattgaggatggtgaatcgcaaatcacttagcggcagtcttagttcatggaatagaatacctcctccgtcatattccctgtcttggaaccaccttctgtctttcccaccgaaagagagatgttcttttctcttctctcccatatgtaggcagaaacaaggtgtctttcttcttgatttttccccactagccaaagtttaagcaggagtttctggtcttctcccctgcctgacgtgcaaaagggtccattggacagatggggaaaggccagggcttggaatggggattttttgagggagctcatgggaaggttgggagtggaggaatggggctcacttcaacatggtagtgtcaaaaaaattgaaggttaagaagaagaaaacgggtgtatgatgagtgaggaagcagcctcacagggcccaacttgagatgaaaataacccaaagagatgtgggctggagtgatctacattcattcaactacatttctgcagggatgcacacaagcacagacactgcactactgcaagagggctaactccagggcggcgactccaagtcattctcatttacagcaaaaatgacatcatgggagagcagaatccaagctcagttttctctctgtttctttggatttacagccacaattttccctgggatcaaatagtcttctcaatgcctctctagaatctgactgtccagcagtgtccatctttgtgtgtagctttgtgctcccaagcacagacaaaaccataaatgtagcccacagagggagttgtcccgctccccacccacccctgccccgacatatgtcttagcttttggtggtggtatttaaaagttagctattttctctgacttgatataggccatattttatatcaaactggacaaacttatttgccagtgggtatatcaccttctctcctcccagttttcatgtgggttgctttgtatttcactactctttgttaacttttcttacaacccagctcctttcctaacatttactaaccacttatatttattttttcctgtgtcactgagtctgataggatctagggcaaggacactcaatgttgtcaatgatctctcctgagctccaggaaaaggtgagctgagagatttttttgtttttttttgagacggagtctcactctgtcgcccaggctggagtgcagtggtgcgatcttggctcactgcaagctccgcctcctaggttcatgccattctcctgcctcagcctcctgagtagctgggactacaggcgcctgccactacgcccggctaattttttgtattttttagtagagacggggtttcaccttgtccaggatggtctcgatctcctgacctcatgatccacccgcctcggcctcccaaagtgtgggattacaggtgtgagccactgtgcccagcctagagatggtatccttagggagagcttagctcgagctggtgctgtgcatgtggtgaaagatagccctgctcccaagaggtgcagactgagagggactgtggggcagaggccaggacagagtgtggttctctgcaccaggggactttccaattagcctaacaaccaccttcttccaaagcatcaagcaatcgagattttgcctgccctccctccctccctccattcaaacaaacatgtattgagtaacagaagcaaaacatagaattgaaaaaatatatacagcattttattggaaaataaaataccaattttctccttgaagtgtcaggtaatcaagaactgtctatagattaaacattaatatagccagttctcaagaaaggaaaaacctgggaatacgttgaaagtatttctcatggaggagtttgtcaatttcccaagcagattggccaaagattacagaaaatatacagagatggcagtgaaagtaatatgtgagaaaaatctccactggtaaactgtaattagacatggaatcatgaacgactttatatttctgaggcatatatgggacacttcatcttggcaaaagccgtcctgcccctcagtatttctaataacagtagataaaatgaagtctttccaagacacattggcacttctgcacggctggcatgattgagctgcagaatccatttgtcacctatgtgctaaccatttagcttctctttttatgggaattcaactcagtatctgcccatgttcccagcccttattgatcgctctggttcaaagaacgggtcttaaatggaagattctataggaaaaaaatagatggtgaaactccaccttgacagaccatcaataaatcttcctttagattaagctgaaagccagctgaaataagccttttcaaaatcttgcattttaagaataagatcttggattttattttcgatgatcgttgtaaaggtaagagaaatgaaaagtgaatgaataaaagaaggaaaaggaagcaagttaaagagcaattttgaacagtgaagattttttcccccaattattttgtataggaaactgtgaagcacatataaaaatccacaggaagttggaaagattttttattactagccttgaggcaattcacatgctttttgcaaagctgttataaactgacaaatatacaagatggatgatattgtaacacacacctagagtgaaaatggagtgcagaacaaaatgatccacatcagaagggaaagaagttagtcagagaggctgaacatctgcaagacttttgaacagcatcagctctggtaagaaatcaagccctgacttttacattaacattcctgaggctgatagaatcttttctctattacctatccgttatgattctacccttcatgtcagcactgctgagtgatatttaaggcaagcagcatagatcctattgcttcactgatgacaatttaaatgaatcttccttaaatttaacaaaatgctaaattatattacttgttctttcatttaacatgaggtcaatgatcaagaaatagaaacaaactaaatgtccatctacagactaatggacaaagaaaatgtagtatatatgtacgttacatttaatgatattaaactcatggattcatatttccttagaattcaaaataatctccaggaattccttctgaccagtacagttccattttgttcatgtcagaactcaagttgttattatgattattactattatttatgcatccagaattcacactagaaacactcaaataattgtaaggtgacatttttttctaaaagcctctctgcacctttttggtttagcatacatggcgggagttagctttgggcctgtccttgggagtatcctccctcaatcccctctgcccgtgaattcctgcccactgatcctgtggatttgtcgagggtcttgaaggcagagtgcatgtgataagctgggcagaggccctagagagagcagtgagccgcagaggtggacagagccagctctgctccatgctgcatgaggggctttggcaagttgcatcatttgtctgagtttagttccttcatgtttaaaatggcaataaggaaactaagtttgcatagtagttgtaagagataaattacatattagcatctcattactttatagctacaataaggatggtttagttatgagcataagagtcagctgtgctcaacgtgggcacttcatccaattgaagtggaaacttaatcaagttcccagggggactgagtcacatctggaataatgtctctctacagagggaaggggtgagcagtgaccatagctggatcttaagtttcagacctcactttagccagtaattataaaatcatgtcatgtatttaactgtctttagtctcagtttctgcctatttcaaatggtgctgatcatggctgccttctctattttaagacactgttatgagggaacaatgatcagaagtaggtattttaataagttaaaagccttactattcatacaatgttattactatcagtgctcataaatcattttgcaaatacttagtattagagaaacagatttctctgtgtaccctttcccttacattccatctaattggaatgaactcttctgtgctcctatcctacctatggctgtttccattcaaaatgtctggtcttgtgttttcattactcgagtatgatatgcccaatagagtgtaagctttgtggggtcaggcagcataccttgtttattcaacatcattccattacttcagtgctcagaacaataactcattcacagtaagtctggattgaatgagtgacagtggtttttctaataatggttaccatttctgaacaactcatatacatgtcaattacatttatcaaaatgatgtgatgaatagaatcatagggtgtttgggatagtggagaccttgcatatcattgcatttctcaccaccattgcataggtgaagtgcatagagccagtgagaagaaatggatctccgagtgtcacatggctgggaaatgacaaagtaggagttgaattcagattacatcactgtatttccagtgttattttctcaccaagagctcacaaaaatgcttataattttgctaatataatgttagatattaatcaagtacttctaaaagtgagagcaaaatatgaaaactatagcaaaaattcttacatctaacaaaggaaaggttgtaattttaaaaagtatgtcatcgatataataaaatgactgttgtggccatgggtatttactcaattgtctggattgactcaagtttaatgatatcatgaatctctgaaaatgtttaaagattgagctaatcttcattttgaaactgatggcagctacagatctgtggctatttttattaacagtgttggctgggtgccatggctcacgtatgtaatcccagcactttgggaggccaaggctggcagatagcctgaggtcaagagttcgagaccagtctagccaacatggtgaaaccccaatctctactaaacatacaaaaattagccgggcgtggtggcaggcgcctgtggtcccagctacctgggaggctgaggcaggagaattgcttgaacccaggaggcagccaagatcgcgccactgcactccaacctgagtgacagagcgagactctgtcttaaaaacaaaaaacaagaaacagtgtctttcacagagcagacatttttaattttaattaagtccaacttacccattttttaattcatggactatgcttttggtgttatatctaagaactcaaagctaacccaaaggacactcagatgttctccaattttttttctagcttcatagttttgtgttttactttaaggtacataatccattttgagttaatttttgtgaaattttccttcctgtttatttatttgattctgataaaatatcaaaatcagcagggtaattctgacctcatagaatgagttagaaagtattccctctgcttctatttttgggaagagattgtagagaattggtgtacattcttccttaaatgtattgtagaattcaccagtggcaaaatctagtcttagttctttctcttttagtaagccattattagttattaattcaatttcttaacatatatggacctattcagagtatctgtttctagtgtgtgagtcttggtagtttgtatttttaaggaactcagccattttacctaagttaacacatttgtgagtatagagtttttgataacatatatatttaatatttgatcagaagtcagtctttcgtttctggtgttagtaatttgtgtcttctcttttctttgctatcttagtgagaggtttatcaattttctttttcttttcaaagaactaacttttggtttcactgatctttattattattttattattactatttttgagacagagtctcactctgttgcccaagctggagtgcagtggcacaatctaggctcactgcaacctccgcctaccaggttcaagtgattctcctgcctcagcctcccaagtagctgggattacaggcacacgccaccatggccggctaatttttgtatttttagtagagacagggtttcactatgttggccaggctggtcttgaactcctgacctcgtgatccacccacctcggcctcccaaagtgctgggattacaggcatgagccaccacacccgggctgatctttattatttttctgtttttaattttattgatttctgctctaatttttattattttcattgtcctggttgcttcaggcttaaattactcttccttctctagtccctatagtagatgcttagatttaaaacaattttttggatctttcttcttttctgaactatgcattcaatgtataattttttctctaaaaactgcttttactggatctcacaaattgtgataagttgtatattttcatttattcaaaatattttttgatttctcttgagatttcttctttgatctttgtgttatttagaagtgtgctgtttaatctctaaatatttgaggattccagctctttttctgttattgatttctagttacatgtcatcatggcctgagaaaatactttgtatgatttctggcctcttaaacttgttgaggtctgttttatagacaatggtcttggtgaatgtcccatgtaagcttgaaaagattgtgtattttgctgttattgaagagattattttataaatgtcaattgggtcaaatttattgataatattattcaggtcaactatattcttattgattttctgtctgctgaatctatcaattacggaatgaggggtgttgaaacctttaactctaatagtggacttgcctgtttcttcttgcagttctatcatgttttgactcctgtattttgtactttgttgtgaagtgcatacatattaagcattgttatgccttcttagagaactgaatcatttatcattttgcaatgttcatctttaaacctgataattttcctttctctaaagactgctttgtctgaaattaatacagctactccagttgtcttttgattagtgttatcatggtatatctttctccacctctttatttttactttaccttaatatttcacttccactcttctcttactcccatatttctggccagaagttcactgtaattattatccttgtacttctatgagtcaggtgtttttcctctggcatctttcaatattttctctttgttttggttttctgaagtttgaacatgatatacctaggcataggtttttttttttttttaaatcctgcttggtattctctaagcttcccagatctgtgatttggtgtctgtcattaattttggaaaatgatctatcttttttctccattattttaattatgctaggttataccatttggaatcttctcacggttgctgaatattattttctgtttgtgtttttcattcttttcttctcttcattttagtttggggagtttttattgacatgtcttcaagatttctgattctatccttggccacatctagtctattgatgagcccatcaaaggcagtttcacttcgattagtggttattttatttctataatttcctttttgattgtttcttagattttccatctctgtgattacattacccatcttttcttgcatgttgtctacttttatcatcagagcctattattttaaattccctgtctaataattccaaaacctgtgtcatatctgagtctgcttccgatgcttgctttgtctcttcagactgttttttcttaacttctagtagccctataattttttgttgaaagccacatttgatatattggacaaaaggaaccgaaggaaagaggcctgtagtgtgaggttttctattaatctggctgaaagccggctgagtttagtgcctgctgtagctgtagctaaggcttcagatttctctggtgtccttgtttttctctcctattgtctttagtttttcgtaagaattgtgctttgtggccttttcagctgttttccactattattgtgatggagccctgttgattaatgataaggtataggggagagaaagtgagggtaagtgtttataatctgaggatcaaatcttagttttatgtaactcctgaccctggatgtgatcttcacaagttttgtgtgtcccccactccaacccctcactcttgatgagacaggaaatctaaagggggctcaagtgggggaaatgcccttcctcctaggtgagataaggctctggtgacatcttttctcctggagactaggcttttgttatggaaaatgctctgggcatatttcaaagccactactttttccctcccactgacagaggcaggaagtgatgtttctttgctttttactgtgagaacctggtggggtttctggaggtaacacccacagaagcagtgaggtcgtctcaatgttgtagccttcagggttttcttccccacactctggtccacaatcagccaacagcaattcatcacaattaccgttttagtattcctgctagtttatggctccagtagcctctgctctcgggaagctgatctcagctgtgattttgtctgtctctccagattctggggttatggtcactctctgtgacctcaattctctgataagtccaagaaaagtaattaatttctatttttctcagcttttttcttattgtaagggcagtagtgacaacttttaaattccttacatgttgcagctaaaaccagaagtctcagaagtctcacttttttaaaaaggctctattgctggcaattaattgtaacaccttcaaaaaaaaacaagtgtgccattttatttggccatggacccactgccactaaaaaccaacatattagataagtagctagttctgactgatataatttaatccccttttagagcttgcagattctctgcagacacagacccatcggagagattcaattcaatttgcacatctattaggctgtttgaaacaacgagaattctgaagctgccaaaaccccactttcaatctccccgctggacctgcctggcatcttttcgtggtgagccgtacactgatgtgctgtttggcagacactgtgcaaagagctgcccggctgtctccagagaggggctgggtggggctggggccttcattccaatgtgcttcagccacagagctgtcggccctcttgcctaacgaaatagtaactagcccttgccctgtctcagaatctaacattacctgcttctaatatagaaagatgtgatcttttaaaattgttgttgctgtttttggtctattttatttttgaaaatactgtttcgatatatgaagcccttgtcaagttcactttagctaattgtcattttgacgtacaaaatttgaagactttctgtcatttgagacagagcagggatccctcttggggtctgccgggtcccccaagcatggaaatgaaggaaattcttgagttccttcaagggaaagttgaggcacccagctagtcctgaggagtagatgagcaacttggtaagcaagaaagtaatagtggcttcaaacaatacccaaggaagttacagccacaaaatgtttggtgccttacagaaactaaagaaaacatcttaacctgtgtccctgagtagtttttcagaaacctggaccccaccaaatgaaaaaggccatccatggctcttggacctcagataagagggaactggggactgaactctgactcttctttgttataaattttttcctgaggggcctggtggccagagctaacattcttttctactgaccccagagttttagacaaagcgtcacctgttaaccatccacagaggagaacatctttgcatccacttatgacctgtggccctcccaccacctgcttgaagatgacttggcttttggggtccaaaccaatgtagagacttcatgtattgatttacgacttcgtctgtaacttctgcctccctatctttaaaagcccttattttaagccattggggagttcaggtcttaaacatgacctgcccaattctccttgcttggcccctgcaataaatgcctcactttcactttttaaaaaaaatttatttatttatttatttttattatttatttatttatttatttttttttttgagatggagtctggctctgtcgcccaggctggagtgcagtggcgtgatcgcggctcactgcaagctccgcctcccgggttcatgccattctccttcttcagcctcccgagtagctgggactacaggcgcccaccaccatgtccagctaatttttttgtatttttagtagagatggggtttcactgtgttagccaggatggtctcgatctcctgacctcatgatccagctgtcttggcctcccgaagtgctgggattacaggcatgagccactgtgcctggcccttttttttttttttttttttccgagatggagtcttgctctatagccaggctggagtgcagtggtgtgatctcggctcactgcaacctccgcctcccaggttcaagtgattctcttgcctcagcctcctgagtagctgggattgcaggcacccggctaatttttgtatttttagtggaggtgggggtttcaccatgttggccaggctggtctcgaactcctgaccttgtgatccacccacctcggcctcccaaagtgctgggattataggcgtgagccgctgtgcccggcctagcatactttataaactagtccccagacatttctaaattacacgtagttacttgaacaacatgtccagattctgcagatacagatgtctgaatctgaggttcctcatttgtaaaaggtagacccagagtaggtgatttttcagacatttgccaacatgaaaattttctagttaaaattttttttcatcaccatgcgtgtggagaggtaggaggtgtactgagatgggacgaaaacaagtcagctaagcatcgttgaaaaccatactgggttcccagtgaaatatggtttgtttctgtgtccccacccaaatctcatgccgaattgtaatccccatgtgtcagaggaggggcctggtgggaggtgattggatcatggaggcagatttcccccttgctgttcttgtgacagtgagttagttctcatgagatctgatggtttaaaagtgtggcacttccccaccttgctctctctctctctcctgccaccatgtgaagaaggtccttgcttcctgttcatcttccaccatgatggtaaattttcagaggcctccctgccactcttcttgttaagcccatggaactgtgagtcaattaaacctcttttcttcatcaattatccagtctcaggcagttctttatagcagtgtgtaaatggactaatacacagtgggttggaggtcttgtatgctgccagaccccacttggtgtccacctaggagtaatctaggagtgtgggggaggccatgccccctgggggaaggtttagcttgtgggagagacaaactgctggatgtgttctctttctttccatctcctcactgacttccgagactgggcttattggcgtctcaggaaaaggccccacacagtcaagaatctgttggttgcactttggcacgggcagctcagtatcgcctcctccttatgtgaataacccgtctttccacctcgctgctcttgcccctagcttctgcagcctcgattgtacattgtgtgaatctcccgtctttccacctcactgcccttgcccctagcttttgcagcctggattgcacattgttacaaaagagtaccaataagcctgttctttaagctctgctttctgagaaaccctggttaacacactccgtgaaacactttttcttattggattcatagtatataaaaagagaaatgttcttagaatcatttttggaaatgctgcttcctataatgctttgagtagttgatcttcaacactccttgggcaccactggagttattagcttagaatgtttggaatatatcttcatcctttcctaatacaaaactcctgtgggcggctagaatgaatagttccaaatgcattctaatctgtttctcccttctcatttcacactacattaattcaggtcaggatcctctcctggaggagaagatataaactctgacagactctaaataaaagggggagaaaccttagctacagaggctatctgctagtagggcaagaatgataaacacaggagtagccggagggttttcagctatttttggtttcgcagctaaattttcacaaagtggttcaggttgtaatttttcaactttgcctcgcagctgtaagacagtcaaagtgcagagtggaggtggggtgatgacagttatagaaattgacagacagccggccaggcgcggggctcacgcatgtaatcccagcagtttgggaggctgaggcaagcggatcacgaggccaaaagatcgagaccatcctggctaacatggtgaaaccccatctctactacagataaaaaaaaattagccaggtttggtggcaggcgcctgtagtcccagctacttgggaggctgaggtaggagaatggcatgaacccgggaggcagagcttgcagtgagccaacatcgcgccactgcactccagcctgggtgacagaacgtgactccgtctcaaaaaaaaaggaaaaaaaaaaaaagaaaaaaaaaaaggaaattgacagacagcctgacctttttctcactgtgaggaaaatgagataagattttgtattacgcagattagaaaagcagtggtgagtacttctacctcctttggtcagtcactactattttcatgccattcaggtaaaacagagtattactgaaacatttaaaaataaaaattaatccagcattttaaaagcacaattaatccttgagctgtccctaggcccatggaaataaaaaaccggtggacgattggttgggcatcatcagagtgcacctaattcactgggaattagggtgcagatcctggacgaggaagtaataagatggtagtttttgtttgagttggaaaagatcttggtacattcaaagaaggaatacacttgttattgaaacatacgtaagatgaaatcatgagacccaatagatactgttttagtttctctgatatttccaatgaaacatacaattttataactcaggtgtcacatactgcaaaactctgtctaaaacctcagactcaagagcattgaagaaattgctgcttatttagaaagatgaaaggaaaattgtcatgttaaagatattaaattagagtttattattcaatgaacggctatttaggcactcacattatgtctgatactggtctagagggagggtttctctgccacaggagtatttacactttgggctgctcggtactgtgttgtgggggctgtcctgttcctaggagttctgcagcatccttggcctcaactaactaggggccagtagcaccctccacctccaggtgggcaacaaaaaaaatctccagacattgccaaatgctctccgggggaaaatgcccctggttgaaaaccactgggctaggtgcagtgcagggtgcaggataataataacacttggaggccgggcgcggtggctcatacctgtaatcccagcactttgggaggctgaggcgggaggatcacgaggtcagatcgagaccatgctggctaccatggtgaaacccctgtctctactaaaactacaaaaatagctgggcgtggtggtgcgcgcctgtagtcccagctgctcgggaggctgaggcaggagaatggcgtgaaccggggaggcggagcttgcagtgagccccgatcgcggcactgcactccagcctgggtgacagagcgagactcgtctcaaacaaacaaacaaaacacttggaggctgccctccaggccagtctcattgagcagagaagattaagggaaagaaaaacaaagacaagggcaaatcatctagcatagtatgtaaactgcaaaacgtgtacaggtcaacttttaaacatcttgtgggtatgatgctgtggcttagagttccttttctgctcttattcactcagcaaacttttatccagtgcctcccatgtgacaggtgctgttttaggttttggtgataccttagagaaccagacaaagtcgctgccctcatggagctcatagtctctttggggagctaaacaagacaagttaggacaatcaatagatgtagatatgtagtataatgccagaccgtggtaagtgctgtgagggaagctgaagctggtagtgagatggagagtagctgttgaggacggttgtcagagaagatttctcagaaggactagtattttttggtgaagaagttatcctcctcttctctctgagaaaaacccatgcactcccacgtgaacctcttcaagcgggctctcgtgttgctctggcgcagccctcttgtgctttcagtgctcccttgatttctgacataacaaggtaactgttcaccgactacttctattgcccagacccggaattaaccatttcctcaaggactggcattattattattaatgcggtataacttacacagagtataagaaagtacactaatcttacatgtacaattcaatgaacttttacatacttatacagcatacaaccacttctcatataaagatatacaacatttctagcacctagaaagttccccaggggcccattgcatgtattacctcctcccccatgctgtatgcagtggtaattacaatactctccagatctgtgttatttttctcaacgttatgcctttgagagtcattcatattcttttgaatggcagtgatccattatttttcattgctatatagtattccattcaagttttgatttgggttgtttgcagttttggtctcctgtgaataaaactactataacaatttttaaactgagtttactgtcataatgatgacaccaagccaattggggtttccctactggaattatctaataactcataattatttccttaactttgtagcttaatgtttaatttccttagctttgtagctaaatgtctaattttctcaatgtttctcactttctcttaggctggacaaactgcatgcattttgcctacacagaaaaagattacttctcttccaaataaccttgctcaacctacaaaagcttgccgttttattcatcagtgagaggcagttagtcaagattctagctgccatttgtgactcatccacacctgtgaagtgagtagataagtaacattacaatataaataaattcagacatcaaggaaggcaaatcgtgattattcctctaatagaaagtgactcaagggtgcgtaggaacatctgggacattgatgttcatttcatgtgactgttagaagagtgcttctattctgagaatgtgaccctggtgtggtgaagttttctgtggagccttttgaaatttatagtcagtgacgtggaatgtccatccaggaggagtctgacaaatgctgtgccagtcgaggttcagcaccgtaggtgtagcgcaggcgaaatacggtgctggagctttgagtacaagctgaaacaccgcacaccacctcctctctctaccattcagaacactctttacaaaactaaaaaactgccccccaaaaaaaagaaaaatataaatgcaaacataataaaataaaaggaatatttcccagcttctggaaagaaagccaagccaatgatctctcttataggtgacatgggatagaggatcccattccagattcccccaggtgctccatgaaacagcacagactctggttttccatcatctcagttccggggccttaaggcctcccccttacctctcctctgagttcctgtggaatccacactccagaggtggccgccccacagcctggggcctccccagggagctctcatttgggactgccccagctctgatgtgtcaggagaggcatttgcctttagccacctgttcatttgggggaattctcctataggctccctgtgttcccagttctacattcaaatcattctgggtcttttggtccttgtgataaaacatgaaacagcagaaataaacgtttaactattaaaacaaagagaccaattaattattgttgtggaagtatgtgatgctatattaaaaactattttggaaatacaacttattttaccttcattgctacactgttcactggtccgctgtcttccacgggccaccacaaatgtcccctccaggaatattccatggaccagaggcccatttggggtaaaggatggcgaaactcttccaacatcactcccagggcccttttattctggagggcagaggcaggcctggcaggacaaagcaagatggtgaagattccagaacttttgtgtagataatttaagttttttcaaataatataactttaaagctcagacatccaagagaattagctaatgaaaacctctatccagcaataagtttggtaaagtgactagaaacaagtttgcacaaaaaataagaacttgcatacctgtatcgataaaatctttattttttttttttattttttgcaacagagtctcgctgtgtaccccaggctgcagtgcagtggtgcaatcaaggctcactgcaacctctgcctcccgggttgaagtgattctccctgcctcagcctcccgagtagctgggattacaggtgctcgccagcacgccctgctaatttttgtatttttagtagagacagggtttcaccatgttggccaggctggtctcaaactcctgacctcatgatctgcctgcctcagcctcccaaagtgctgggattacaggcgtgagccaccacgccgggcctaaaatcttaattaaaagatataatggaaacatagacaacataaataatattgccaaaaaatacaaacataggattggtaatcatgaagactatattagactaacacgagagaatgaaaagtaaatgaagctttgaataatagagtaggcattctgtatctttgatggaaaaactaaacatggcaaagattgaattttttttttttttgagacatagtcttgctctgtcacccaggctggagtgcagtggtgtgatctctgctcactgtaacctctgcctcatgggctcaagcagttatcctgcctcaacctcccaagtagctgggatcacaggcatgcgccaacaagcctggttaattttttgtatttttagtagagtcggggtttcaccatgtttggcaggctggtcttaaacttctgacctcaggtgatctgcccacctcagcctcccaaagtgatgggattacaggtatgcaccaccgtgccaggccagattgaatttctttaaaaaataatgtgtaatttaattttgattccaataataatttcaactggactttgtttttgtttttttactacttaaaaaattgacttgaaaatatcctaccaggtaaacagcaagcataaattgcacagataagtttggaggaaaaggttcctgtgattaaaatgttattgttaaaatagtatgataaggaacaaggatagatagataatttattaaaacaagatagagagttttaaaacagactaggtaggatatttgataaaagaagcttcatgtatcaatgaggggagaaacgtattattcagtgcagcatttcagatattggccttttagaaaaaaataaaaataatttctcactgagtcaggcatatcaatagtattcaatattctcatcttcaaaatgaaagggttaagagatctccaaggatttcttattctgttagtctctgaactaaaaattgtaagaagtaagagttatgaatagagtaggaggagaaaaatcagtcagaagagagaaaaaagctgaagttccagcaaatgcgcacatacacacacacacacagaaaccctgcaggtgaaagtggatttatccatgcagaaagggatggaaaaagccaaatgaaatgggcattcaatgtgcttgccaaatgccaaattagggtaacatgtggtttataaacagtaaactcgagcattcagcttccttttcttttcttcttggtccaatctctttagttctttaaagtctcaccttatgttgctacctcggtatagaaaatgaggggtggaggagaaagattggacataattcagatactttcagtatgtttttggtgggtataaatttaaaatgcttattttgttgcacatcaagctgctatttaaggcttaaggacaaaaaaagtcaaaatactgaaagttgaagaaatggtgttcaatttccctggaatcgggggctcaaacatttcatctttgagaatctagttattcactctgaatgaaaaaattttggtgcagttgaaatcactttatgcagtgaaatgcaaattatgggtgaacaaattatagcctgctgcttttgcctggttttggactatacctagcatcatgcataatttgtagaaaagtgtctgcatagagaaaccagggaaaaccatttagccatgtgcaaatcagtttacccagaggaaggcaatgaaaaggagaacactgttatctcctcaccagcttaatgctgttcctgatgaaaatcgcctgaggtcacacaagaaacgtggtgtagtaattatgtgcactcaaatagcttcccattggaaagaaataatccacactggtaactgaatcaagcaaaacaggcataaaattaagcagattcattttatttcaactgtaaatttcagcaacaggggaagaaagtggatactagaataagttagaagcagcagttggtggttctgaagcatcaggtaattcgactcagggtgactattgtctccatttttaatttttaatttttatgggtaaatagtccatatgtttacggggtacatgtgatgatttgatacaggcacactattaaggtaattggggtagtaattatctcaaccattaatcatttctttgtggcaggaatattccaattctactcttttagttatttaaaaatatacactaaattattgttgactatagtcaccctattgcgctatcacataccagatatttttaattctatctcattatgttttcctacccattaaccagccctacttttccctctactccctgttacccttctcagcctctggtaaccatcattctactgtatatctccatgagttcaattgctttaatttttagcacccacatatgggtgagacattgcaaaatttgtctttctgtgcctagcttatttcacttaacttaatgccctccagttccatccatgctgttgcaaatgacaggatttcatgtttttatggatgaataatattcccttctgtatatgcaccacatcttaaaaaattcatttgtctgtagttagacaagtaggttgattccaaatcttgactattgtgaac

SEQ ID NO: 619 - DNA, 58964 bp, Homo sapiens
gctcttgacttgagctaaaagggaaaacaccttccacacctacagggggcttcgatacaccctccaaataatccttttcacagagtctcccagcctcccccacatgaggcctagatgctccaacaggtcctcagagagcaaaaccaatttttaatgaattccgttgtaaatgttgcataagctccggcacctcgtttgaaatgcagccagtcctgtgccctgttttccaagcagcgccttcatgttaacatcttttcatctctgggaagaaaattgctttccatcaaaagatttagaaagcatgggatttataattctctttaataagcaaaacatgcgtgcagaaacgctaagaaatgagcgtgtggggtttccccactcagacccaggtcaaggtcagagcctccagggtccctatgtgccttagtcatttatgtaaacagtcctttactttagggcactttctgttgatctattggccatatacttttttttttttttttttttgagctggagtttcactcttgttgcccaggatggagtgcaatggcatgatcttggctcagtgcaacctccaactcctgggttcaagcaattctcttgcctcagcttcccgagtagctgggattacaggtgcccgccacaacacctggctaatttttgtatttttagtagagacagggtttcaccacattggtcaggctggtctccaattcctgacttcaggtgatccacccatcttggcctttcaaagtgctgggattacaggcatgagccagcgcggctggccatacacttttaaaggaggggtctgctttaagatttggatgaaaaataaataaaattaactgcatgaaaaagcaatttgcaaatgggtggtccaagcccctcttaaagtttgatacatctttcaagctgagaggaagtctacgtacctccaccatctccagagtttgttccctgcaaaagtgattttaatctagagcaatgaattctgcaaactcacatctcaggcatgttcctaataatagactgcctccctgcccccacactggcagccgaatgttgccagtcccaaggaatgctccatcatgatgccatttgcctgtcaggactctatcccagcagcagctgcagctgattatggctcggctgtgggctgtgtttttttatgatccacctcctccctttcaaaatcaatcagggcacactcatggaagtaaaattagaggccctggccagggcttcagcttgagaaatgcactttcccctccttttcagggcagtggtgtccaaggaggccaacagaggggtggacaccccgcaagaagccctgtgacagcctccacccagcgtgtctccatctataggcagttgctaagagacttaaaatgcttttattcctgaagtttcttcttctttcccctcctaaccaccctggtgtggccctcagctctcagtagatatttcatgttctgcactccccttccaaccatgtttatttctgctttgggatgcttgttggaaatagcatgccattcaaagtcacagactgtcaccttgtccttagctgctgccttcatttcagtccttttttctacctatcgagactcattggcaaccaccatgtggtccctccccagttatcccactgctctctgggggcatcatctgagctcggttgtccctcagcagcctgggccagagctgtcctctttggttgattcttgaacaatccatcaccttcacatcccaacgtgacatttccataagatcaaactgcattctttatccatccctgaagatacatattcattttcaaaagctttggctctcaattaaaacagagagagtcatttggtcgagggctctgtggaaaagacattattagctggagtattcttctcttccctgtggtgaatgagagagcattttccaattaaggcactcattcactttcaagaggcatgtgcagggtgctcagatgcggtataaaggagagccaggcagatcagtagcaaacgagaggaaaaactggtggaaaattaagaagaaatgagagtattcagatgccagaagagaaaatgaaagactgatacagtgacgtactcctgccccagaagcggagtgtctgctcaaaagcgtgaatttgtgcaaaaggttgtgcaccaaagcagaagggattctgtttgcacaaatgcatgtttctatggatgtgcacgagatctgttgttctaacaagaattgctgagcatttccagcaggtcacttaggggagaaaggactctgcagccttcctggcccatcttcttcctaggtatcccgggggaagggcatttctgatctgcctgctccaaagctgggactagtactgggccatctgctatcgcctcccaggtgatgtgccataaagtcagaactcatgaaacatctcctgggcagcctccttcactttccacacctgtaacgagtggagaaatttaggcctgggtctctctttctctcactctctctgccccatcttcgtcataccagatattccgagcatgctggtcccaaaatacaagtagtgtaggggaggcctggagagagtgaggcaggagctcaagttgtcccagagccttgcgtgggagctggttgttgctttcctggccactgacaaagcgcttcaccgacctccagtctattctcatttcctgcctttgactcctcggtagagcgccgtgcatcatgactgatgactgactctcttgccggctccctgtggtcagtccctgggttgggttgaggcagacactccatcttcatggagtgtggtctactgtggaatttcctgctgtgttggtctctgcatcggtcactgtgatggtccctgctctggaacagtgtagacaacaactgagtctgaaaggagaaggatggacaggatccagatccagggcttttcaagttgggattcccctggggccaggtaatctatgtgctccaacagctcactttttgagtgggcaatgtcacaggccaactcctttgcttcaggtatatcaggtgtactagggtgtgccagagtaccaggtgtgccggagggatcagacgtgccaagggtgccagttgtgccaggagaccaggtgtgccaggaacaaggtgtgccagggaccaggtatgccagagaaccaagtgtgccatgcgtaccaggtgcatccagggaccaggtgtgccacaggaccaagtgtgctatgggtaccaggtgtgcccagggactattcacatcaggggtaccagatgtacaaggcaccaggtgtgccaggggaccaggtgtagcagggataccaggtgtaccagaagtaccaaaggtagctcagctcttctccagctgatgatgcagtgttgactctatttttctttgaaataagaattttgttctctccttctcacacacgaaaattataaggaaatttatttatatttatttatttattataatgaaatttaaggaaaaattgtatttatagtaaatacaaatagataaaaagttaaaactatctaaactaccccattcaggaataaccactttaaatgctttaatgtcagtcattccaataattttttgattttacatgtaatgttttcaatacactctacttaaaaacagaatcgtgatttcaaagcctgttagttcaagaaacctgacattttcaacatctttctgtatcattaacacactcctacaacatcattgttaatggccttctgggattccattactttgaatgtaacaaaactttttcaaccaatctcttcattttggactttcaaattattcctcccttatttatctaacctactactgatagatgtttgcttgggtagtaccaacataaaatagccttgccaggtgccaagtgtggtggctcaagcctgtaatcccagcacttcgggaggcctaggtgggcaaatcatttgaggtcaggggttcgagaccagcctggccaacatggtgaaacccagtctctactaaacattcaagaaaattagccaggcctggtggtgggtgcgtgtaatcccagctactgggaggctgaggcaggagaatcacttgaacctgggaggcagaggtcacactgagccgagatggcgccgctgcactctagcctgggcgactgagtgagactcaaaaaaaaaaaaaaagcctttcaggttgcacggtggaagatatcagctcctcggttttaatttgcatttttgcatgtgaatcatcctttggtattctttgcccaattcctttagtgtctcagtattaggctttaagatttaaggtataaaatcttcatcatacagagtgaaaaatatggttcttttttgtcatccatctctctagtttgttaggggtgtttaatctaacactgtattttcttatttgttatgttttgggtggaaggagagaggtcagatcccttattttttatccttgtggtctctgccttgaggccctatgtagagggcccttttcacatcgagatgtatctacaggctcacctatattttctttcattacttttatgttttttaaaaataattgtcttacatccatttatttgtatggcataaggtctttaatatttttctcaaatgattagcgcagttaccattttttataaaaacaaaagtttacatgctccctttctcctacattaaatttttatatatgcttagatctgttcctgaaatgtatgatctgtcttactcatctgtctatccatttctgagccatggtcacagttttaaattattgtagttttcaaatataattttatttctatttttcaaatataattttctttcttgtatactagatggccccgtctttaattacttaaataaaatttattatctcctctgaaacatttttttctcccaggtaaaatttaaagtggaaaaaaagcattgcggttgctgttttccagcaaactcctgctgtgttcttgccgcacacccccgctagccctgggagagccatagggaatgtctcacatgtgctgtaatcctgcaacactgtcactgtgccaatcttgagtgcaaatgacaggtcctgccttctcttttgagtgtgtgctttcccccatctacctacagaactgcagcaacacaaagaatggaagggcagaagttgcctaacgttgcctagtgcaagcctggcctgcgagtctgctcagagcacaattgcagtttgtagaaggcagccccaggggactcctgggcagagagagctaataccagctaggtgatcacaactccccaggaatgctgaccacggagggaggctgtccaagggtctacgagatggcatccctctgtagacggcctccctctgtggatggcattctatgggtgaattgatacaattcattcgtcttattcagatttccctattatcacattacgagtcctccatggggactcatcaggattcctttgtggtctgaaatgcaggaaattgagctctttgggtcagaagccaagttaaacaagacagactccagatgctctgcaagatggatgcagatgccagcggcaccaaggttaaggtgggaggcatccactccacttcctcccatgggagtctggtccttccagggccggtgggcaccgttcttccccatgctgcaatggtgttgaacaattcctggggtaaaataaagttagtaaagacaacaactttcttatgtgataaaaattagcaccaagaacagagaacaaataagagcagcttcatgggcaagcaacccaggcaggtacacaggtctccactgtcagaagggccctgtgcttggcttaatgctctcctgtcaccatcttcaaattctaaataattgtgaacgaaggctctttccttttgcatcatgaagcgggtcctaattagcagtataggagaaagtagaatctttaattgcagtcaactggcttggagtcttctcaaactcagcctccacttgtgcattatgcagcagtgagggctgggtctgcattttggcacctaaaatgtgtacatttccattcagtgaatgagtctcccattcctaacatggatgaggttccaagattcctgaggagttgacctattccactgtgcaatttatcaagcctgaaacaaggaacatctgatttgggatttaacaatattgttttgttttaattcaacaaaacaggttgtaggaggacaacatgcaagattcttgtggaagtctagtccttccagggcagaaaggtagccacttctacctttctccctatgcccatccctaactccagcaatcactaattagtacccccatcttatagttctgttatttcaaaaatgtcatacaagagaaaccataaagtatgtagccttttacaattgactttcaatcagtataattcccatgagattcatcagagttgtggtgtgtttcaatgcttaatttcttttttactgctgaggaatgtttcatggtaaaggtatgccaaggtatgcaggccacctgggggctttcgtttccatgtggaggagtcagtggataggttatgaccaggccacagctgccaggtgacaagggcattgtgttctgtggcttgtggcttggggcagcctctatcagatgtccccacacagctaatcctacccacagccaagattagaaatgtcaaaacccttatccttctgcaaagtccctccagcactctgtactaagaaagcatagcatgggacataggagaaaagcttaatggaactctgggatttatcatacagcacatacggaagtgttctttggagctgagaggcaataaattgataactgacatgatatacacaaacaagcttatttctaactctgtcttctgctcagtttatctgtgtatctatctcttcattgatatgacactgtcttcattactttagcttaatagagaaagtcttgatattgggtagagtgatggcttatacttcgttcttcttcaaattgttttaggtattctagcacatgtatttttccatataatttattttttatttttttattactatactttaagttctaggatacatgtacagaacgtgcaggtttgttacatagatatacacatgccgtggtggtttgctgcacgcatcaacccgtcatctacattaggtatttctcctcatgctatccctcccctatccccccaacccccgacaggccccggtgtgtgatggtcccctccctgtggccatgtgttctcactgttcaactcccacttatgagtgagaacatgcagtgtttggttttctgttcttgtgttagtttgctgagaatgatggtttccagctttatccatgtcctgcaaaggacatgaactcatccttctttatggctgcatagtattccatggtgtatatgtgtcacattttctttatccattctatccatctaattttataataagcttgccaatggctacaaaaaaaaaaaaaaccttgctgggacacttagagaaattgtattaaacctatataggaaaaaattatctttattatgtttaatctcccaattcatgaacatagtatgtcttttcatttatatagtacttttttgatttgtttaatcagcattttgtaattttttagtatacagattctatatatgttttggtaagtttatattgaaatgtgtctatttttcttgtttttcagatttgataaattctattgatctgtcttcatatttattcattctatatttctcatatccactctactataggcccatttagcaagttttaaaaaaaattactgttattgcggttatcagttctataatttccatttcattctttttaaaatttctgtttctttctgagattgtctatttttaaattttatcaagggaatttgtagttgcttgttgaatcatttttatggcagctgcttttaaattcttgtcagacagttccaacatctgcttcatcttagtgctggcatcagttgattatctctcattcaagttgtgattttcttggttcttggtataatgggtgacttcttattgtattaggttggtgcaaaagtaattgcggtttttgccattacttttaacagcaaaaataatattgagaacattttgcctattgcatttttagactctgggtcctatgagactcttcattttaggaggctgttgccaggcttagggttagcaggtggcctggcctgcttttgtatgctgtggtttcaatcccatgctggtgctcatggttgtggggtcatccctatggaactgtgtggcctctctgtgactctggttgggagaagacctcgttggacttcaggaacaaaatgtgctgcttggatggggctactgttgttgcagacagcccctgtgagttctctcagctgcccagtgtctctaagggccaaagagcattatccagcccatgcttcctgctgggcaaagattgccctgtccatgccacccaatgtcccagtgtctcttggtggaggaagggattctccagcactaaggggttagagtacctctctagctgaggcatgagctgggagggacctcctagtgctgcccagctgccaaagcctctagctgggagaggtgagctcagggccagtggtgaaggagcatgttccttcagagagagccagacccccacgcctgctgccaggctctctggtgttgtcagcaggactcttctttgatctggggcagggaggagcctgcccaggttggccttcattgctaggctgggggctcaaggaatgcagggtctgggtcaccttctgttgttggggtcaggggtgtaggactctctggcgctattttgttcctctagtcctggggttgctgatcagtttgccctcctctttctccctttcagagtcctgtggtggcttcttctgccatttcaagggcttagagttgttcttagggggagaaacaaggagagaaactggctgagggagcggagaagaaaatttcacacagggagtgacaggaaccatgtgtgttgggcatgtggtgtgtgagtgtctgtgtgtgtatgcagtgtgtgcataagtgtgcataagtgggtttgaaatatacgagtttagcctgccatatattacacaatgagtcaagtgtcaattatcagtctctctggctttcctctattaccatagatcaacaaaattgaattttgatagtcttccaaggaactgagattgccacttagctctccttatattaatcatagcataaagcgagctacaaatattttggaattaaatggctgtgctgcgaactgatattcattcatttctttgacatatgaccatggtagtaatagcagatgtggcaatggcttcaactgagcccctggtgtgagccccttctcctctaagtcccctttcctgtgtgagaagactctgtttcagagcagtggccaccccgtgtccctccttaagcccaggtgactgtggacagagacccctgtgttccaggagccaatagtctagagaatatgaatcatgtagggtttttgatatgcatttttcattctcactcctgagttcatgaacttcccctggtcatactaggcacctacttgcttgggattgtgtgtatgggtgtgcagattatagcttcccataggaattgacaccaagtctactgacgccaattcttaggtttatcaaaagaaataatgttttctaaattcctttactgtatcaaggacaaagcctattgaaaccagatcattgagttacttttaagagtttgagaagttgccctcaccctttggcagcctggcctttgtgtctgctgggagaagtgagaggaggtagaagggataggtgggcagagggaagagagaaggagagacagggggaggaggagatgctcacgtagagctcactctggttcagatgagcttgagtaaggacaatgctggggtcagagggctttggggatgcctatcactgctggtcagctgcccacatgccagctgggttcagccacatcacagcccccatagtgcttcagcttggaccaagaaccaagggactctgaagccatgctgtgtccccttgacatagtgggaccaaagtgggccaagggtccctctggaggggccactgtggggtggtagtagagtggccctgagagtgggagtggcaaggtggtcccctgaactgatgccatcacaagggtggtctccaggggcagcaaaggttgcctgaagctggatccccagatctgggcagggaaagagggaggaacaaagactccagtctttgtgggctgcctggatcctatagacaccaggcggggagatcagaaccgcacaggctggtgaggggccatttgaaaaatgaggctagggaggggtagaatctgagattcaaggcccgtgacccctaggtgctgtgagactggctctagagcctttttcttgttatactgtgagtggatattctcaaggaaggttgctgtggactgaaggtttgtgtccccccaaattcacccaaattcatctgttgaaatcctaaacccaaggtgacagtataaggaggtggggcctttgggaggtgattaggtcatgaaggtggcaccctcatgaatgagattaatggctctataaaagagaccccagagagaccctgcacctcttccatcatttgaggccacggtaagaaggtgccatctatgaggaagggatcctcaccagacatggactctatcagccccttgatcttggactttcctgcctccagaactgtgagaaatacatttctgttgttcataaacaagccagcctatggcattttgttatagcagcttggatgaactaagacagaaaattagtaccaaggagtggggactcctgtaccaaatacctgcaagtgtggaagtggccctgtaactcagtaatgcatagagactggaagaattttaaagttctagctaagaaaagccaatggatggagcagtaagggtgattcttgtgagggatcagagggagaagagaagagctgtggggaatcttctgtcttccaggaaaacacttaagtgtttgataacagaatgctggtagaaatatgaacagtaaaggccattctgatgaggtcagatggaaatgagagacacatgattggaccgtggaggaaaggccatccttgttataaagtggcgaagaactttgctgaattgtgttgttgttctaggtttttgtaaaaggtagaacttgtgagtgatgaaattggatatttggtttcaaaatttgaatattacgaaatttctacagaagatgttgaaggcatggcttggcttctcttgagtacttatagtaaagtgtgagaagagagaaatggcttaaagacaatgttgatcaaaaaggaaacagaactaaaaattgcggaaaattctcagcctatccatattgtagagaatgaaaaagcatgttcaggagagaacagtaaaggtgtggccaagctactgtttgataaagagatttgtatgagttggcatctcaagggaagccaggtactatttatccagacaatggaagatgacctaaaggtggagatcattggggctgcccttcccatcacagtcttagagtgcaaaggcctgggtggagaaagaaggccactgttgcccagtgctacctcatattgcgggctcttcttacttcatttcatttcagcgcagctgttgagcctcaaaatagtgtgcctggtgcctggcaaagctgagggaacatcactgtttccacttagattttaaaggatgcccccaaaagccacagggccaaggcagagacctgctgcagaggtcaggccaccccagagaccccagcagagccatggaggtgggctgttcctgagaccctgtactagaagagccacagaagcatgattccaggcgaggagagctgggggcgttacccaggcacagagctactatagaggtggggccatggcagagaatagactcaggggcaagcccactgccctagtgggcttacatggcagaacttccagccaaagatgattctgaggcgttacggttttagatttacttgggaccagttatccctttcttctttcctagttctcccttttggaatgagaatgtccgtcctatgcctgtttcaccgttgtaatttggaagcacataacatgtttgatttcagaggctcacagttagaggggaaattacctcaggatgcattgtacctggagtctcacccatacctgttttagatgagacgctgggctttattttgtttttgtttttttgagacaggattttgctctgtttcccaggctggagtgcagtggtgcaatcacagctcactgctgccttcacctcccgggctcaaggaaacctcccagcccagcctactgagtagctggaactacaggtgtatgccaccgtgcctgactaattttcatatttttttgtagtgatgcggtcttgctatgttgcccaggctgggatcaaactcttgggctcaagtaatccacctcccaaagtgctggaagtacaggtgtgaacaactgtgcctggcctaagactctggactttatacttttgagctgatgctagaaagagtgaagactttaggggctatttggatggaatgaatatattttgcatgtgagaagggcataatttgagaggccgggaacagaatgctgtagaccaaatgtttgtgttcccaccaaatttgtatgttgaaatcctaacctccaaggggatggtattaggaagtgggatctttgggaggtgattaggcaataagggtggatccctcatgaatgggattagtgcctttgtaaaggaaacctcagacagctagctggtaccttccaccatgtgaggagacaccaaggtgccatctatgaaccagaaactgagcccttaccagtcacataatctgctggtgccttgatcatggacttccggcctctagctatgagaaatgaattgctgtttataagccacccacccaagccaccatgctctttggaaataaagagtgtaggatgaaaaaccatgagacatgtatgtaattaagagcctacaagtaccaaaaaccaacaaaacaaaacaaaccagtccttttcaggaataaagatgatcagctgggcaggaaactgcgagctctggtctcaggctcctcatgctcatcccagcccctgagaatcagatgcagtctaattcccagcagagaagcagatcagggcttggacacacctcttattctctttctacatttcctactagtcaaacaataagagcaaagaactgtgaaatattggttaggttatatgctgtggttactttggttttcagaaaaatatttgtggacaaaataaggatttgggaactgcaatctaagagggaaataactctttcccccactgtcaaagataaaaaccacacatattgcatgagtatgcttatgaaaacatactccctccttcattcactcagcaaatgtgtcctgcacccagccctcctgtggtccaggctcctgtgtgctggagcacagggaagtactgcttgaggctgtggtttgagctcccagtcaggggaagatggacaggtgaatttaggggattccagaacagctcttgctgtgacagtgatggccagggagctaacaaaggggacccgaaggtccttagaacaagggagagggccaggaggcctgggttcttttccagagtcagagagaccatctcagtgggcagatagaggggcttggggccgcacacacatgggcagcacagatttcaggcaggtgacagagacagcatttgtgcaaagcatgtacgtagggacagaggcccagaggtgaggggacagcggcagcgtacatggacggaggctcctcagaactgtatctcctcttttcagcaagtgggtgcatgaaggtccccgtaaaggaatggtacccaggccaggagactgtctagaggccatactgaggcccgagtccaaagccatgagactgttggtttggaagagaagcgaggaggctcagtgcactgattccaaccccgcaggcagtaggcaagggtgcctgaagggagggaccctggtggggcactgagagggcgctgccctcacttgccctgggtgcatctctgcgtgctcctgaatagctgtggccccctccttgagcacctggaagagcacccagtctctcatcctgcagaagaggtggcgtggaagagcagggccagaatatccatgaggacagtggtgagcagtgcaggcttccaagggcaacagtagagacaggatcattgtcacaaatggagttgagatatgcatgcggatgcatgtgctgaggatgggggctggggggccctggaggtggatgtggatgggtttacagaaacaggaggaaagaggtaggaaagggcaggattcaaaatcctacaggaggatagacctagttcaggagcgagggactgacctcccaggagggaaggtggtgaaggagcatcactctcaaattcctgatgccgtgggaggcctgccagtggccggcacagtctgaggttgccaggcgcacagggatgcctcgtcatgaaaggcaccattcttgctgcaggcgacgtgggtttacatcatttcaggacatagtggaactgcatcctgatctgcccttgggcaccttatggagcctgaaatccagggcatctgctgagtgggaaggggactgagaggggggatcttcaggggctctgtacaacttggaactaaagcaaaaaaagacggagaaaggaaaaggctgccacaagcagtaaacgtctcctctttctgtttttcccaagcgatttcagaaactgcttgtgactgttatcattctggaatattatccaagagaccattgttccccagggaaagaaagtaacagacaagaaactttggatctggacctatgccgtcacaaatgtgctgtttttataaaacctgacagtccgggacagcctaattaaaaaaaaaataaaaataagggatttaattcccttggtattgcaaaatactcagcaaaataatctctttctgtaccccatgtcagattttttttaaagtgctgatgaaatgcagaccttggcaatttttgtttaatccaaacccagaaggactggctatcagctcatggccatcagttaatgcagggcttgtaaggccatttatcaatcgagttcatgagcttgaatctgtgccagccattttctctcataaaatgatatagcccagcccttgttcttgctgaaactgggggtgacagcgtctgtttgtgcacattctgggctgatgcaggccatggaaacagctggtgcaggtgttgctggctttgactgaaatccacggcccaccacggcatcgtagatgcatgtgcattagtttgagcctagactccttaggagttgtgtggcattcagtaactgacttaacttccctgtttctcacaaattaatgagaggtcttaatacatttctcatggagctaatgcctattgaaagaaaataaagctttttcacctgtagcacagccaggcacacaagctataagtatgagtgatcattattacttattcttcattagcatttcccaatgtgttatataattgttattcaaaggaaaaatatcttacaaaactccagttactgctggggcatgacagccctagccatagttccaggcaccctgagatccatgtacctgtgatgaggtttagtggcatcggctctatatttctcatgaagctgtaggacaatgaactgagacagtaaataagaaagcaccttatgcatcatcaaaccacacacaggcacggggtgaggtatgcactccatggcaacagcaaccggggttaatagattacattcacccagctccagtgaatgtgtcaggggatgagatgcccccagcagttactacgagagctgtgagaacagaagaagtcagcactgcagcctagagccctcaaggggcacttggaaggtcgtccaagccgaattccctcccctcaaggctggggcagagactctctatcttctatgtctaatgactaaccacagtgggtgttcaaaatcaactccagacatggctcctccctaccgtcagagtggagatgacccaggaggaaggctcatgggctctgggccatctctatgccaaggtctgtttccttggggcagcacagggcacatcaaggatttattctccctgtggaaaagaaaggtgtcaaagtgggaatgcttatgttgaaatatgtgctgggcacttcctgtgtctgcactgaccacttctagagggcatctggggagcttggacctgtctggccagggctggcaggcattgtttccctaggttctttctcatcctcaagccctgaccaagcctcagccctgacttctgttccctccagccagtcctcctcctggcccaggctctttgtcatacaaatgcctctgggctctttcttcactttgctgttccacatggcacacatctcctgtctctccacctaggaggcccctaagtctctgtggcctgcgtctttccctaaaatctctctgtgaagccactgacattgtcactgtgctcacacagtgtttgtgcagccaggtggggctggagaaaggactctgaacttggggggtgggttttgtattccacccccatcacttggcagttctgtgaccttgatcatggtctttggaacacttgggttttttttttttttttttttttgagacagggtctctctctgtcacccaggctggagtacagtgacacaatcatggctcactgcagccttgacctccagggctcaagcgatcctcccacctcagcttcccaagtagatgagtagctgggactacaggtatgtgccactacacctggataatttttgtatttttttgtagagacagggtctcactatgttccccaggctgctcttgaaatcctgggctcaagcgatcctctagccttggcctcccaaagtgctgggattacaggcatgagccaccacacttagcctgaaactcttgtttattgatattttcccatgctggtctccttataattctgactcagtgttcttatctctatttcacagatgagaaaaccttgtctcagaaagtgggttttcaggcttacagaccctgtgagcaccatgggtagagtgccacatccgacatctaggcacccaagccagcacttcgggatgtgccgatgatgcttctcatcttggctcttccagtatggaatggggtgatgacccctgcttctcagagttgttacgaggatcaaatgaatctccagtcttactggactgtggggttcacaggagatgcatgctttatccacagcagttgtcctagcatccagaactgggcctggtgcatagaataagtgcaaaataagtatttatttaagtggaccacataagcaagccctctgctcagcacctggcaaaaggcaggcattccataaactatagttgtaggaggaggatttttacatatatactcagccaagttactcatcatctattttcatctaccttttgtggtcaagcgcccttagtgcccagtatggagcctggcacacactggccacttaacaaccatgtgtttgtgctgctgaggagggtggtggccacatgcaatatagaaggggcatgcccgcccttcaaatatagcagtcctgaacaagtggatccacatagagaaaatgaacacatttatttatgctcgctcttgttaggcaatgtaaacgtattttgctgtgattcatttaattccctcacacacacaaaaacaaagggctctgctctttttacagatgaggagactgaagcctcaaggagttgagttgttcacagggcatgaaaattaagtgaattatagaaaaaataagtttacaatgcctaacatacagtaagcactaaataagtgttttgattttctttatttggaaagggttgtttgctctaatccactgctccatgtagccactgggacatctccactgattgtgggtagaggggaaggccacgtcctgagaagaccttctccaggggaagaaatgccctgaaaaccacccaaaggagctgctcttgatgcgttgaaacagaaaaagagaacaaagaacatctgggggttcttcctccttttccaagcacaatgcaggctgccattttccatttaaaagcttaaaaaaaattgtagttaataagagaaaaaaaatccctcacaattcttaggggaaatccaaagacagttattctcatcatattttgaggaagtcttgaatccttcactggctgatatcagattctcagaaagcaactgacctgcaaaagccattaaacagcctcatctggatgggggttttgagaatgaaatacggcagaaaaataaacccagacaatggagccttcgaagggggcctccaagagcacacacagacaggcaggcacacatgttgaggaaggtctgcagcttccctgatctcccctccaggctcccaggttctggaatgttgtgcatttccactccagcaggacaaggtgaatctcagaggaatgttacatttccccgacgggccacttcctttctagcaggagaggagcccacgctggaatgtgttcccagggctgcttttagggcttttcactaaagtaagactctttccataataatgaaaagaatatgaactcacatttgcagattatcctggatgatttactttgttcaatggcctcagctctatagttgtgggaaatgagaactagagagagaagtaacttgccaagtttgcctaactgatagatggagccagaaccagaacccccctcacagaccacaccctccatcactgtcaacgttgtactgcctccagtcacctatctacaaaacattacctgggtagtttgaaaattcacagaagatcttgtctcttccttgcttagacccttctgcattagcctgttctcgcattgctataaagaaatacctgagactgggaaatttataaataaaagaggtttaattggctcacggttctgaggctgtacaggaaccatgatgctggcatctgcccagcttctggggaggcctcaggaagcttacagttatggaggaaggcaaagtgggagcaggcacttcgcatggctggaacaggagcaaaaggagtagtgggggaggtgctgccgatgtttaaataagaactcgtgagaactcactcattatcaaaagaacagaaccaaggcgatggtcctaatccattcatgagaaactgcccccatgatccagtcgcctcccactgggtcccacctccaacactggggatcaaaattgaacataagttttgggtggggacacagattaaaaccatatcaccttccattcccactagcttggatgaagctcaagcattcttttgtggctcatggcttcctgggccaggtccacacaaaccattcagggcaagtgataatggatagtccatatatcatatctctgcatattttaaagctctggtctcagcccagcccccagcccaaaggagaaccctttgtgctcaggtactcaagttttcatgtccttgcaagtgaatattctggcctgaacatccaacctctgagcacacgtgtgtggacacctgcctggattcccacttgctttgttcacccactgaactcccaacttccaaaatctgcgtatggctcttaccacacttaccacactgttgtccacatgtctgtgctcagctaccccttgagcccagggtacatactggacagttggtcagtcctcaggaagagacctacaggaagtgggtttgggatgtttgggcagtgaattctgggttttggggtgtcacaagcatgatctagaaggaggggtacaggcccaaggtgggcacaccccctctgcagaaacggactcagcagagcaggaccagtgtggactctctaaaggccagcccatcctcctcctttcaggctgagggcctccctggccaggcccagacccaatgtctggcctcatttcctgctgtatgatgccagcctttgtaagtcacttgcagtccccaagagcaacctctgtctcatatccccatggacccattttttattatatgcctgcctgggatcccccacttgctttgttcatccactgaacccccaaccaacaccaaaactccagtctggctcttactctgttgcacaatgatgattttatagtctgccttccagaccagatggatgttctcagtccaagcacaatgcccaacatagggttgatatttaatcaacgtattgcctgaatgaatgattttacttgccctgcattctagaaaaaatgagagactagcttttgttcagagagtcacagaaaaaaaaataaggaaggctggaataatatgtgcttatgtcatctccctccaggcaggtcttggctgaagggcagcaactgtggtctgatcacctcttaaagatcttaccacttaatattgttgtgttggggattaagtttccaatgcataccttttgagggatacattcaagccataacaggcttcaacatatttcagaatttgaggacaggcacaaatattcagtttatagctacaggtgaaggaattctcctagaagagagaaaaaagacagcaaataaagaagacaaaagacctagaagataaatctggtggtcaaaccattaaaaaacagaaattctagatgaagtgaaaaggaaaagattaaggggaagaaattaccaaaaaaatttctctaaatggaagtacatgcatctcaagattgaacatatccttgaaaagtctaccacaattaaatttaaaaaaacaaaaacagtccaaggtacataattatggaatttcaggacacaactgcaaaataaaaactaaggccaggtgcggtggctcacgcctgtaatcccagcacttggagaggccgaggcgggcggatcatgaggagatccagaccatcctggctaacacggtgaaaccccatctctactaaaaatacaaaaaaattagccaggcgtggtggcgggcacctgtagtcccagctacttgggaggctgaggcaggagaatggcatgaacctgggaagcggagattgcagtgagccgagatcgtgccactgcactccagcctgggccacacagcaagactccgtctcaaaaaaaaaaaaaaatttgaaaactccaagagaaaaacagatcacctttaacagaacataactaagaatgtcattagcctgcatgaggaaggcaataaagcaatgccttcaaaattctgtggaagaataatttggagtgtagaattctaatatccacagcagatattaaataagtatgattacagagtgaagacatttcaggcatgcaagaactcaaaatgtttacttcttattcagtctttcctcagaagttacttaaggttgcacttatctaaaatgaaatactagatcaaatccaccaaatagagcaatgtgtgagcttttagaagctgttgagcagtcctggagaacagccagccaagaccaggaaggattccaggaaggacctgaaacaatgaagtttggaggtaaaataaagactattaaagaggaagacattgcttgataagaagtcaaattaacaaaaaaaaaacctctagaaaaccagactcaaaagaagaggaaattgtggtaaaccacagtcgcataagagcagggtaatgtaagtgccctctgtctaacttaaagtagtgttatgactatacttcaagatagataaagggagatgaaatgtagtttgagagagctagcttctcaattatcagaagttaaataatatctaaatattgaatgaaccaaaaatgtaagcatactacttagagttgtaaatgtaactaccctaagaaatagctaaaaatgttgaagtgtggttattactgggaaacatgatatatttgtttaagcaggatttttatatgacaatattttttatttatataatgatactttaaccatatatcactctgataaaaatgtcttaaaagtttattttaatatacttgtagtttggcttcaatttttattttatatttcatttcagaaactaatgtgacacccatgtcaaccattcttgagctgcattaacgtacaaagagacttgagcaatttgcctacttttcatcgagcaaaattttgtttcccaaatccaattattcaatctctaaattgcttgcttcccacttccttttcgtcatagtctctttatattaataccaaacttggctttttttccttccttttatggcctctcagcccaaaccaccagtccctagataactaattatctgtgtcctctggcctcatcccaactttttagggcagtgagctaacacttctttttgtatgttaggagttctcaacttttttgaagaaacatggtgctttctaaaataaatgggagaacataagacaaagcaaagccagaagaaattaattttctttggaaaatcccaaaagtcaggaaagttttctgaagactgaatattcttcaccactcattttcacttttattcattcaacattgtttgaaccttcaccctgtaatgggctctttagtggcatcatggctactaatgtgaggaaggtatggagagccacctaacagggctctgctcttctctccgctgcatgttccacaggcgctcatggcaaaactcacccaaatctcttcatggtgaccacttgttcagccttatatcttccctcacaagcatagcccttttctgagacttgcatttgctttaaaattttgaatttccaaattcccaatatggtttacttcataattgagacataaagttcactgcagaagagaagatacccccacaagtcagaaaatgctctttaattgtttattaaaaatgaaagagtggaaattattgtgcaaatccaaatagaacaaatctaaaaaatccataccaagacacattgtagtcaaatttctggaacctaaacaaagaaaaattcttgaaagcagtgtgagagaatgacaccttaacctatagaggaaaagtcacttaaatgaaagataatatctcatcagaaaccatggagaccagaagtaagtggcttaaattttctttaaagtactgggaaaagaaaccctaccaataagcattcagtatccaatgaaaatattttatggggatgaaaggaaaatcaatcattctcagatgaatttcagaaatcatcattctcagatgaagtaaaaactaagcaaaatttttaccaatactcctaccctaaaagtatgggtaacggacattctttcaatataaaggatatgataaaaataagaaatcttgaaacattaaaaaaaaggtgaatggggagagtaaaaatatggtgaatacaatagaatttcctcctcctcttgagttttccaaattatgtgtgatattggagcaaaaattctgacactctgatattgttctcaatgtatgttgagaaaataattgatataatcataaactggaaaggataaaaaatatgctaaataaaggaaagtttctatacctaatttgaactgaaaaaatgttgaagcctttagactatagaattatatatataacaaatatataataaacatattttatatataaaaaatatatttctatacataatgcaattctatatataatataatcatatatatatatatatatatatgattccattattgatttctgcattgcagaaatttgatcctccttctctgagagggagccggttttcatttcctttagtctaaaggcttcaacattttatcagtacaaattaggtgtagaaatcttcccttcttcatcatggcacccaggaagagaattctaactcagaatatcttggctaaaaccacaacattgagcatggaattcattcctgtgcagtttctccatgctagtctgtgtcactaatgatggtatctaagaagctatggaagaaggacgaaagtcctattttttcttttgtattagagatgattaagatgtcatgtctttcccaccagcttttccctttctcttgatatgaagagtgttgagattttgaaaagcaaggaaatagagaatagaaatctcagattcttttcctcttatttattcattgcataaaatagttactgaacacatcacaggtgcccggatgaacgttcaaagctgggaatactatggtgagcaatgcacagtcttggtctcatgttgcttcctgtctaggatgcttcccagtcacttacttatgcttcttgatctgacaaaaaaaaatgtaagtacaagagtgagtaaatggcaactaccccagaaatgtaagcactggtccctgtgaattatgtgaaagaaaggagatagtgaaagctcaagtgttatgagcatgcaaccttcaacctgttgtttgcctaaggccttaaaatcctttttataagccaactctttactagcaggttagaagataaatttatgtttcttcttttgttggaaagtcatagtaaagtaaattctagcttcttcttgggagaagtccttttgtttcagtggacttagaagtaacttacaatctaaactcctgagaaagcacactgtaggactgcacaaaaagctcaaggtagtaggaatacatggatttttgtcttaaggttagagcaaagttttcaaaaaggaattctgaagttacaattaaaattatctacttggagggagcctcttggtggaaattcatgagagatgaagcagcatcttcaaacagaatcatcttcctaaagacggtgtgcactttcacaaccacgaaaactaggggtctaccgagtgggatagaaaccaacttcatttagactaacaattcgttttctctctccttcctttctccctccctccttccctccctccctccctgcctgcctgcctgcctgcctgcctgcctgccttcctgccttccttccttccttccttccttccttccttccttccttctttccttccttccttccatcatccgagttgtcagaaccagaaaccatgatctcccaagggcagcaagtatggtttagttgaccttgctctttcaatacttgccacgtagcaagtgttttaaaaattaaaggatgcaagaaattctttaatctttgaagggaaaaaattaaaatgattgcatatataactttctcccttccctaccatctatagggtaatatttgttttctccccactttacaggtctctgtttcacaaagaaatgaaataaatggataccctcaattgaagatgggaaaaacatattctaaatgaaaaattgcatggaggtctttggggagaataacagatgctgtggattaaaacagggagtcacacagctggtgggctgcgggagaagactctgggccatttgggtgagggaaagggtaaagaaatgggctttaggacagaagtctaaagagagaatttctgggtgctttgctctgttctgtgcatctgctgccctctcaggaaaagcccatcttagagggccctggattgggtgcttgggtgctcagtgggactgtcctgaaaacaggagcaggacagcacaggtctatgtgggttacagatctttgcatcttgcaatgcttcccatctgccaccgcagatacatggccctgtcaaagccaaagctcacatagacactgtcagcaaacaattcagtgttcatgaaaaaatctagaacttagtaatagtacatatatttgtttctgtgagtccagagagtgatcatgtaagtgtgtgaggatgtaatccctcacatgtggaataaaagggtcatgtttcattcagcattgaatcacccttaacaaataatcgacgaggaagcccgctgttgcctgcctcagtggacggggctaccaggaagcatacaaaggctcatcacagcagaaattcattctgtggaaaatgtgatcaagatccatttcaaatgccagagccctgctttatttgacaaattcaacaatcctgagatgattggtcatggattcaaggcctaagcaaaactggcttccagcaaattccataggcccttgttttgacctcttctgaaaatggtaggtatcacatttcaccaatcatttttctttacagtaataaccaaaatgaaagcttattttaatttctctaaatagtcaaaggtttctcttgttttcctacatatttcgggtgtctggggctctctacctgactcagatctcttagattatcttagtaatcaactcagccttgaggagttctcttcccagaaaaagctaaggctttgctgctgaaagccagcatgttactggagtacaaatttgattctccttctctgagagggtgctggttttcatttccaagcactgggaccacacagctgctgctggatacccacaagtgtttcacaaaagcagtcctgtgtctggggtaccctcagcaagcacttataaaatgctgcatctttcttttcccaggaaaaaaagatagtgttctgtgcctgactaggaagttctggtggttttcttagttagcacatgagaggttgacagttgccagtctccagtgaagctgtcaacaggttatacgcaaataagaaattactttaacacatacaaaacttttctttagaagaatgcagacaacttatattcaatttcatttcaaaatgctaccgattttcatatttagagaaaataagtacgtaatacctcctgaaattaacatatgttccacaattgtgtgtgtgtgtgtttgcacaatcatgccaatagtgtatctctgtaagatatacatttttttcttttttgagacagagtctcactctgtcacccaggctggagtgcagtggcgcgatctcagctcactgcaacctctgcctcctgggttcaagcaattgttctgccacagcctcctgagtagctgggattacaagtgcctgccaccacacccggctaatttttgtatttttagtagagacggcatttcaccatgttggccaggctggtctcgaattcctgacctcgtgatccatctgcctgggcctcccaaagtgctggtattacaggcatgagccaccatgcccggccaccaatttatattcattgaaaatgttacccgcattctcgccaacactgggcaatattaaacttttaatctgataggcgagaaatagaatctcatcattgtttacatttgcagtaacattagtgatgaagttgagcctctgttcatgtgtataccatcattgatatttctttttctatgaactacttgttcaagtcctttgtagtttatgttcaatagaattgtttatctttttcttattgatttgtatgagcattttatatattaagaaattctgtctttgttgtatgaaatacaactaatttctacttcctaataaatagtatggcatttgtctacttcctttgttactttgtgcaattattattattattattattttgagatggagtcttgctctgtcacccaggctgaagtgtagtggcatgatctcagctcactgcaacctccgcctcccgggttcagatgattctcatgtctcagcctcccgtgtagctgggattacagttgcgcaccactgcgtctggctaatttttgtatttttagtagagacggggtttcaccatgttggccaggctggtctcgaactcctgacctcaagtgatccacccacctcggcctcccaacgtgctggaattacaggcatgagccaccgtgcctggctggaaaatttttataaagtcaaatttattaatcaattttttcctttgtgatgtctggaatttatagcatatttagaaagaatttccataatttggaaaaatctatacaaatctacctgtttggtttatagtgcacttgtggcttttttttttgtagttaatatttttatttatctgaaatgtcttttgaaataaggtaggaataagcatttttgtgatttttcaaatgacaagctatctttttctacacaggtatactttcatttgaaacaccaatttttgatctatggagttttcacatgcatttggcatgcagactgtgcttgcagactgtggtgggcttgcagactgtggtgctgggcaaaaacagaactagttccactttctatcagtctattcctgtacaacactatattgtcctatgttattagcatcataatatattgtatttaacagatataactagactcacatcatttttttctttaaaaattttcaggctaatcctatactggttaattttagaataattttgccaggggaattttagaattgcattcattactaatttcagaattattgttttaagccttcttttccaagcataatgaactcatgttttccatttattcaagttttctatcatacccctattgccatcatcctcattattatttttgcccaaccactttggactgcctagctgccatcataattttctaggcgcagagtcacatcagccagttatactcattaccttttttcttccactttagtcttatctcttcttccacttcattgctttgactaagtatttatgacaatacaaggggcataagtaagtgtctccatctttcatctgactttacaggaaatacttttagtttttattactgagtagtagttgagaaacagggtttggaaattaccttacttggattcaaataccaactctattccaaatggatatgtgacttggaaaaagttctcaacatctgttaaatggggatattaatactaccaatctctgttttattttttccattttgtttgtcaagtattgtaatcactgttatgttcattcatagtagaaatttggatgcttcccatcttccttataagttccaaaccgtataaatatcatcagaatcatgttttctttgaaagtgggaaaaaatatgggcttggcaatttgggcaatatcactttaggaatcttcacaatttattttgcttttattggtctctttaggttttttaaaaaaatctcttataaaatcaaattttgtgatttatattttcctagaaaatcacctatttaatcaagttttcaaatttattagcacaaatcaataactgtttaaatcaataactgtgtcctgtcatacttcttctttctttgtacctgtggctatgtcccggcacacagtgctaagtttgtgtgcttataccttcccttaccttgtttattaatgagcctgggcagttggtgcaactctatcctgggatctataatgaacaagcactgagatttgtcagttctattattaattgtttcctggttcttaaaatcttgcttcttctgtattgactttttcctttttttcattttttgttatttcttatttttcttatttctgaagattttttattagtttattatttctcacttagcaatgtaaagatttaagtctatgaacttaactttgggaataactattcatatctcatagactttaaaaaacagctttatctaagtataataaagcattggcatacaataaataaataaattgtgtatatttaaagtgttcagtttaagtttttgacatatacacttttaacatatacacccatgaaaccatcaccatagttaagataatgaagatattcattaccccaaagggttccctgtaccctttttaattcctcgtatttggcccctctttgacttacctcaatatcccaagggaatcactaattttttttccctctcactataaattagtttgcaaattctagaatattatatatattaagttatatactatgtatttttttaatctggctttttttctctcatcataattattttgaaatgcatcaatgtcatatagtgtatcaatagttaagtttttttatagttgagtaattttccattgtatggaaatgccaactttgctgaagtattcatctgttcatagacatttgggttatttccagtttggggctattacaaataaagttgctgtgaacatagtgaatacatctttgtatggatatatgctttcatttattttgggtaagaacctagaagtgaaatgtttggatcagaagtgtatgactaactttttttattttattttattttattattattacacttttgaagaagttgccaaacctgtttccagagtggtcttgccattttacattcccaccagcagtgtatgagagttacagttgcttcaggttctggccaatacttgacaaaataaatctgtctaattcaatcattctaatagatgtgtgatgatacctcattgcagttttaatttgcattttcctaataacaacttttcatgtgcttattgattatatatatatatatatatataatattctttggtgaaacatcttaatcttctgtcaatttttttatggtttgttttcttattgttgagttttaagagtttctaaatatattctggataagatttttcatcagatatatgctttatgaatattttttccagtttggggtttgatttttttaattctcttaacaatatatttcagaaaacaaaagattctttgatgaagctacatttatagtttttttaagggttgtgctttttgtacaatatctaagaaatctttgcctaacacaaggtcaccaaaaaacctcctgttttcttgtaggagtttgtagttgtagctcttacatttatatttgtaatctatttataattgattattttatatggtgcaaagtatagactgaaattatttttatttttgtatatagatatccaatttgttgaaaagacaatcttttctttactaaattgtctttcacctttgttgaaaatcagttgttaatatgtgtgtgtgaggatctgtttcttggtctctttttctggctcattgatctatttgtttatgttgatttttgtagtgctataatccttaaagtcaagtagcataagtcttcaactttgttctttttttactttaaatgctgtttgactattctaagttctttatatttttatgtgaattttaaatcaccttgtcattatttacaaaatctttctgggattttgattgggattgcattgaacctagataaatttgagtagttatgctttataaacttgccacaaacattgaattagtgaacactgaaccattgctcttaggggaaagacaaggctagtttcctgagaacatctggttccacagaggtgaccacaataaccaaaatatttttattaacatatcaacataaaacctcgtcttatgtatgtttctgtttaaagatatcttgtttaatatatgtttgtgtatatatatctattaccaatacattaacattgaacagccaacagcactatagctcagcttgaagaaatcctatcacacatatattttttgtaaagcacatcatggccttcctgaacttaagaacactagacagcccttcagcatgaaagcttggggccattttaaatagtgaattgcccccagaagagctcaaaaatgtttaaaacatggcatgaaatactgcaaaaaggacatttgtttacagtgtgagagctggagcaagaaagcagagtgtaggcttgttaaactcaagctgcgaatgtgcaccacaggagacccatccctctcatctctctgtgcccatctgcgtgtgaccatgagaatgctgcagctattgatctgagtgttacaaatacattttagcaagcaggcaaattggaaaatatggaatctctgaattatgaatatcaattgtatttctgcattgattttctaaaaattttgttttacatttttgtgtctataatcacaggggatattgttctataatgttcttataatatctttgttagagtttagtattgagaattggccttatagaatgatttaagaagtatatcttcttcaatattcttgaagaacttgtatacaattcccattattcttttcttaaatatttggtaaggctgggtgctgtggctcatgcttgtaatcccagaactttgggaggctgaggcaggcagatcacctgaggtcaggagtctgagactaacctggccaacatggtgaaaccccatccctactaaaaatgcaaaaattagccaggtgtggtggtggctggcacctgtaatcccagctactcaggaggctgaggcaggaaaatcgcttgaaccagggaggcagaggttaaagtgagctaaggtaatgccattgcactccagcctgggtgacagagtgaaactctgtctaaaaaaaaaaaaaaaaagaatatgacatggctgcttctaacagcttaaactcagatatgggagtaaaggaatgatttaaagttgaaacatatttaaaagggaagcaaagcataaaagtttggaaaattcacagcctagccctgtggtagacaaagaatccaagcaggctgcagagcaaccacttactagagagattagcatgactaaaagggagccaagtgttaatacccaaggcaatgggaaaaaggcctcgaaggcatttcagttatcttcaaggcagctcctcctatcacaggcccagaggcctaggagtaaagaatggattcaggggccaggcccagggccctgctgccctgtgcagtctcaggacactgcttctcacatcctggctgtcccagcttcagccttagttcaaagggctccagatagtactcaagctgctgctttggagactgcaagctgccataagccttagtggctcccacatggtgttaagtctatggtagcatggaaagcaagagtgaagggggcctggcagcttccccttagatttcagaggatgtatgagaaaacctgggtgaccaggcagaagcctgccacaggggtggagccctcacaaaaaacctctactagggcagcacagagggaaaatgcagggtgagagcccccacagagactctaccagagtactgcttagtggagcttggggaaagggactgccaccctccaaacccaagaatggtagatctaacagaagcttgcatcctgagcctcgaaaagctacatgtactcaactccaacccatgacagcagccatggtcatgtacactgcaaagtcacaaggggcagagctgcccaaggccttgaaggcccacctcatgtgccagagtgccctggatgtgggaaatggagtcaaaggagattattttggggctttaagtaaagaaaaggaatcactttcttttttcatccatgcaaaagaaagtgatagagtgatccatccatcactttttttttttttgactgtcctttgaagatttgaagccaggcattgacttttctctagctatgaaagtcccagatggcatgttcttccaatttaaggtagtttcatctacactggaaatctgtggccacctttatcaataatcttagctagattttctggataacttgctgcagcttctacatcagtacttgctgcttcaccttacatttgtatcttacaaagacagcttttttccccccctaaataccgtgaaccagtatctgccagcttcaaattttcctgcagctttcttgcctctctcagccttcacagaattgaagagagtgagggtctttctctggattaaattttagcttaagggaatgttgtggtcattttgatcttttttccagatcattacaactttcatcagcaataaggctattttactttcttatcattcatgtgttcactggagtagcacttttaatttcttccaagaacttttcctttgcattcacaacttgactagtgatttggttcaataagcttacctttctgcctatcttggcttttgacataccttcctcattcagcttaatcatttccagcttttgatttaaagtgagagacctgtgaccctttttttttaacttgaacacttagaagccattagggttattaatcggcctaatttcaatattgtcatgtctcagggaataaagagacccaaggagagggaaagagaggggaaaatgttcaatggagggagcactcagaacacacacatttaccagttaagttcactgtcttgtatgtgtatggtttgtgatgcccaacaaaaattacagtagttccatcaaagatcaccgatcatagatcactatcacagatatagtaataataagaaagtttgaaatgttgcgagaattaccaaaatgtgacacagagacacaaattgagcagtatatgctttgggaaatatggcgtcaataggctgttcagagtagagttaccacaaaccttgtaaaaagaagtttgtaaaaaaaataacgtaatatctgagaggtgcaataaaggaaagcaccatcaaatgaactctgactgcatttcattgatttttaatatgtaggttttttgttattattgttttcttgataatctgattttttaaaattataccattcttttttagccaagaaagttatctttaaatatttggcttattaggttttcctgaaatgtttggcattattggtttttatatttatgtatttattgagacagaatctacttctgtggcccaggctggagtgcagtggcacaatctcggtttactgcagcctctgcctcccaggttcctcctgcctcagcttcccaagtagctgggactacaggcatgcactaccatgccctgctaatttttgtatttttagtacagacagggtttcaccatgttgaccaggctgctctcaaactcctgacctcaagtgatccacctgcctcagcctcccaaagtgctggaattacaggcatgagccactgtgcccagcattttttatttatttttttattgaggtaaaatttacagacaaaattaagcattttaaggtagacaattttgtggcatttagtacattcacaatgttttgcaaacactaactctatctagttccaaaatattttcattacgccaaataaaatcctatatccatgaggcacctactccccattactcactctctccagcccttgacaatcaccattctgctttctgtacctctgaatttacctattctgaacatttcatgtaattgagtcatatgaccaacgtgtgaacttttgtgtctggcttctttcacctggcataatcttgtataatatctgggcaatgaaataatctgtacaacaaaacttcatggcacaagtctatgtaacaaacctgcatttgtacccctgaacttaaaatataagttaaaacaaagaaaaaaaagagacttacagaaagaagaagaaaaaagactgaattatggatgggtggatggatggatggatggatggataggtcaatgaaaagatggaaggctcattaaaattctgtttatcactaaacatacctgttcagaaaaagtgtagcgatgtttacattatgtgatatgccacaagatgaattctgttcatatccattattaatccattcatccactgatggatgtttgggttgtttctatcttttgactattgtgaatagtgctgctctgaatgttcatatagagagtaatctgcatacctgttttcaattctcttaggtatgtccctaagtggaattcctgggtcatctggtaagcctatgtttgacttaccatgaaatatttattcacagtgactgaatcattttacatttcccccagtaatacttgagagttccaacttgtagatatccttgccaacacttatttttcattttattgattgtagacatcctagtgggtttgaagtggtatttaattttggttttgatttggattttcctaatgacaaatgttgttggtcaccttttcatgtgcttaatgtccatttttagatattctttggagaaatactaagtcctttgcccattttaaaatggtcttttcagttgaatttcaattctttatatactctagatattaatcccttatcagagatgtgatttgaaaatatttctcctattctgtagattgtcttttcattttcttgataatattcttggatgttaaaaatttttgtctttatatgtccagtttgtctactttttcttttgttccatgtgctttcagtatcatatctaagaacccactgtcaaatccaaagtcatgaaggtttgtccctatattttcttctgagagttttgtagatttagctcttacctttagattgatggttcattctgagttcagttttgtttagtgattcaacttcattcttttgcatgtgaatatctggttgttccagcaccatttgttgaagggatgattctttccctaaatgaattatcttggtaccctcttttaaaaattattaatttcttgtttattttattttattttattttattttattttattttattttattttattttattttattttatttttgatgaaggctcgctctgtcgcccaggctggagtgcagtgacccaatctcggctcactgctgggactacagatgcctgccaccacaccaggcttattttttgtacgtttttagtagagacggggtttcactgtgttagccaggatggtctcgatctcctgaccttgtgatctgcccgcctcggcctcccaaagtgctaggattacaggcatgagccaccgtgcccggccaatttcttgtttattttcatgttagatattgaatatggtctgcacaagtttcttttctgtgattaaaaaatttttgttgtctctttgtggtcaatttttataaatgttgaagatgcttaaaagtaggtgtgtatgtctgtttgtaagatacagaaatttgagtacatatagtacacaaccttatatcacatataataaaaatattagtagtactgcttaaattctctatatttcttattttgctaagtagtcttaattagtgatggattgaaaaagatgagttaatatttactattatactttttggtgtgtatttatttttgtattttcagtagctttttctgtgtatttttgttgatatattatctgagcataaaggttcctgacatttttacatttattgtgaaatactttctgcatcattaaacaatgagttcatttaggatttttcatgtcttttgcctaaaattaaaatttgcctgcttattaatacaacaatccccacttaagtttgttggcatttgtttgctttatctttgtctaacctttaatttataactttgtaattttttaacatatcttttacttttggcatgtaattagcttttggatcaaacaaagaaattattttttaacagattttatatttctatttatatttgtatttctaacagatatgcttgatacatgtgcttccttttctctctctctgtgtgtgtgtatatgtgtatgtgtgtgtgtttagtgaagtggtgtgtatgtgtatgtgtgtggtttagtgaagtggtatgtatagaaagtggtgcacttacttttctcctggtaatttgaaagtattattgtctgtttgttacagactgaatgtttgtgcccctctaaaattcatatgctgtagccctaacacccaagatgatgatatttgggaggcgagccttcgtgtggtaattatttttagatgagttcatgaaagtgggaccctcacgatggaattagcatccttataaaaagaggaaaagagaccagagatctctctccacaccaccaccataagagaacacagcaagaaggtggctgtctgcaagccaggaagagagccctcaccagggaaccaaatcagtagcaccttaatcttggacttccagcctccagagctgtcagaaataaattgcttttgtttaagctatccaatgcttgacattttttttatggcaaccaaatttactaagacactcttctagtgttatctttgtaaatttggagatatatgtcatctttattaattcataacttttagtatcaactattcttacatcatgaaagattagatatttagtcttgatagatcaaatattcaacaatatgaattctagttttggaattctccattaaaggtgcaattgattggatttgtcatcatgtttttttaaggatgaataggtactatatgcactaagaatacatactttaagaatagctttctttcgtcttttatgtgaagaataaattgactacatgcataagtttggagtctgacttttccttctcagaattatctatatatttcttcactgtgttcttccattgaaaataactatttggggaaatctgaggtcagtctatttttcttcttctaagtaacttggcttttttctcacattttaatctttaacgttttgaacaccatcaggacttcaaatatttttttcttccatgctgaattttcttaacttgcttttctatatattttattctctccaaaactttttttttacttcttcattttgcttatgtgatctttttaaagctgttcttcttacattgaatctatttccagcaatctctatttttattcctgctgcttctattgtggttttcatttctgtaacagttctattgttatcttgaattttcttaatcttccaactcacttttaacctttttaacttgtcttaaaaaaattttttttggctgcatgtgtggtggcttatgcctataattccagtgctttgagaggctgaggtgggaggatcacttgaatccaggagtttgagatcagcctgggcaacatagtgagaccccacagtgagacaaacattttttaaaaatagccaagtgtagtggtgcgtgcctgtagttccagctacttccaaggctgagatggcttaagtctgggagattgaggctgcagtgagccatgattatcaccatactccagctggggtggcagagtgagaccgtgtttcaaaaacaaacaaacaaaaaacaaaataagtaatctcctctgtgattttttccccagtgtccatgtttttctttaatttctttaacactgtagattacaataatttgaaattttttttgatgcttggaacaatttttatcttgaaatgtattttagtattatgatatttatttactttctcccatttttttctctctctccctctctgagtagcagtgacagaggtgagggtagtatttatgtgcagcactgaacattttgggcttataagtcatctttgaaagagggaaattccattcaggtctataatgattttcatgaacagagtgtccagatgctagagagcacagagggttagatggaaacttcagcgcaagtctgtttccttagaacagtttgtcagcacattgctgagtcatctgcccttgggggcattccttaatatcctccagtctttactcagccacatccctgggtgggagcctttatgtcccacaggccccttgtttggtgatgtgtatttgcctgtgttttttcagatgactgtgttccacagctgcataactgtgtaccacttgtcccaggatgtgtgttccccatttctcagggtaagtcaacatgattatatatatccagactcttccaatttctctcttgtctaattttgtttttattcccttttttctgtacatcatttccatccatcatttttccttctttgcctgttcatttgagtgcataatgtagagataatcattcctgtgacatatgggctcaaatgccaaaatttaatcacctgtactcctaactttcccatccacttttttttatagaccatgtgttttctattttatgcagtttgcctggattttacaccatctcccaaattcccagatggatcttaatatttgccttaaaatatacaagcgtttttgtgtctcatcttcattttcacatcatgcctaagacatgaaattttatttgctctgcttaagtttatagtttcgaagaatcctaagattattagtttataggaactataagcttatagttcgtaagagccctaagaatccccaagttgtcaaaaattgagtataatacaattgtttccacagaatcagtggtagagaaagggagttaagagatgtactatttgatacttgatgtttatagacattttctcataaagaatttgtattaatattttaaatgaatgtattttatgtttttctaggtaaaagtcttatcaaataataatttgtaaaatgataaaaacataattctccttcaagtatataaagtgtagagtcagtgcatacctaacattaaaaattatttttatttttattattattattattcttgatggacaaatcatacctaacattaatgagggaatcggcaagatgacaaatgtgattcaaaggagaatgtaagggtcttatgtagatatggtcagtgaaagaaaggctgctggaatatgatgtctaagttagatgaaaagaagaggttaatactttacctgacaatacagccctaacctctggagtttttaattttttaattttttaaaataaaaaacagctttaaagaggtataattgatataaaataagtgtgcatatttaaaatttacatttaatactctactgacatttgtatgcacttatggaaccatcatcataaccaagataatgatcatacacatcatccccaaaagttttctcatttccctttggaatcactccctctcaccatgtcccatgcacccacatccatagacagccactggtctgttttctgccactataagttaaatagcattttgtagaaatttataaaaataaaagatgagtatacacattggttttgatctgaattctttctatcagcaaaattattttgaaatgtatccacattgtagcccctatcaatagtttacacctttttttttactgctgagttgtatttcatttcatgcatgtaacacaatttgcttaatgtatttaccttttgatgatatccattcagctgagtattaattaatcaatccattcagctgaggaaattacccaagaccagtgagtgaactatctagaaatgtaaaggtaccagtgtttggtgttcacaaagggctggggatggtgcctttcctaatcatccagactgaaaatacacattcaaaaaatgttaggcacgttacacagaactgtcttgcttcaatggtagggaataattatccctcaactaaatattatattattcaaatagaaaggcaatatattatgaccaagtgggatgtattttaggaatgcaaggttggcttaacattcagaaacctgtaaaatactcccacttccatttccatgaaggtaaagtggatgtgctttttcttgtctatcaacttatacacacgccaatgctcatttcaagaaataaaaagactctcaagggaggagtaaaaaaaaagaccagctattaataggtacctcagtctaagtagcaatatggtggtgaactcctgagtttacttttacctcatatatcagaatggatgttggcaaagttggcagtacaatgatgccaacaagttcagacaaaaatagtccaaacaaaaacctactcttgctagccaaaacaccagaaaaggagcagcctcacaagatattaaacttttagactgtaattgctcaattccaatcaaaaaacacagaaaacacttgatcccatccccacctacaccagcaaaggccaaggaccccaaactcctaacctcatgaagtaacaaggtgttccaaacacccctatccccaatttcttcatcctggttggtatcagagcagctggagttaagagtcaagactttcatccccgcccaacagtaagacacctcctgcttccatgctgtcagtggccaccatgccaggaaattgaatttctatcctcatagtctgtaataagagtgtaagaatagaaatgctgcaggaacaaatatgtattcaaataagtaatggctgaaaatataccaaatttggcaaaagacttaaactacagattcaagaagtgaaataaactccaaacgagatcaacaccaggacacatcatactaaagcttctgaaaactagaaacaaagaaacaaagaaaaaatattgaaagcagcaaaagagaaaggatgtcttacctacagaggaaagacagtctaaatgacaatgagttttccattagaaaccaaggaggcaagaaggaagggtcacaacattttgtaagcgcagaaagaacagaattgttagtacagaatattatatcttttaaggatgaaggggaaatcaggacactctcaaatgaagaaaacctaagggaatctgctgccaacagaccaaccccaaaagaataactaaaggaagttatttaacccatttcctctttgccctgagaatactcttctctctaatcctaacgtgacatcatagacatttctgttacattagtattagagacaagttctgtttagaagtaactgcaaaaacagtttttatatttcattttcacattgaaaatcagtcagatttgactcagcctcaaagagcatgtaaaattaaatgagtgctggcagtgagctgcatttttttttctaaagggaaatgggttaaacataaaggaaattataaaataagaaatcttgggagcttggaagcagagactgggctattatcagactctaaaccagctggcaccttgatcttggacatctagtctccagaactgtctgggagagaaaatggcagagaggaggcaagactaactttcaactcccactcagatggacagagcagtgtgtggagacacacattgtgaaattttgctccaagacctgccacaggaacataccaggaatgctgagagaatccaaagaccctttgaaggaggtgggttgctgctgcaggctccatgggacagctgtggaattctgatgtgctcttgaaagtgccacgccctggctggaggccaacgaacacaaaaccagtgcactaaacaaaaatacaaccacataccctcacagagtccacttcactccccagctacctccaccaggtgctggtatccatagctgagagagctaaagatggatcacatcacaggactctttgcagacactccctcctcagtaccaatccagagcctggtagttctattgggtggctagatccagtggagaaataacaatggctgcagttaggctgtcaggaaaccccattcctagaagaaggggaagagcaccatatcaagggagcaccctgtgggacaaaagaatctgaacagcaacacttgagtcacagatcttccctctgacatagtctgccaaaatgagaaagagctggaaaaacaattctggtaatatgacaaaacaaggttttaacacccccaaaacatcaagacaaaaatctcagaattgccagaaaaagaattagaaggttgactattaagccaattaaggaggcaccagagaaaggtgaagtccaactgaaagaaatcaaaaagaaaatacaggatataaatgggaaaatctttagtgaaatagatagcataaattaaaaaaaatcacaacttttggaaatgaagaacacacttggagaattgcaaaatgcactggaaactctcagcaatagaatcaaaaagtagaagaaagaacttcagagctcaaaggcaaggcttttgaattaatccaatccaacaaagacaaggaaaaaaaaaacaacaataaaaaatgaacaaagcctccaagaagattgggactatgttaaatggccgaacctaagaataattgttttcccgaggaagaagagaaatctaaaattttggaaaacatatttgagggaataatagatgaaaacttccccagcattgctagagatttagacatccaaatacaggaagctcaaagaacacctgggaaactcactgcaaaaagatgatcgcctaggcacacagtcatcaggttatctaaaataaagatgaaggaaagaatcttaagagctgtgaggcaaaaacatcaggtaacttataaaggaagctctatcagactaacagcagatttctcagcagaaactctacaagctagaagagattgggatcctgcctttagcctccttaaacagaacaattatcagccaggaattttgtattcagtgaaactaagcttcataatgaaggaaaaatacagtcattttcaagcaaacaaatgtgaagataattcaccactaccaagccagcactacaagaactgctaaaaggacctctaaatcttgaaacaaatcctaaaatacaccaaaatagaacatctttacagcataaatctcacaggacttataaaagaaaaacacaatgaaaaacccaaggtattcaggcaacaaatagcacaattaatagcatagtacctcacatctcaatactaatgttaaatgtaaatggcctaaatactccacttaaaagatacagaatggcagaatggataagaattcaacaaccaattatctgctattttcaagagactcacctaacacataaggactcacataaacttaaggtaaagggttggaaaaagctattccatgcaaatggacaccaaaagcaagcagaagtaactattcttatatcaaacaaaacagactttaaagcaacagcagttaaaaaagacaaagagggatcttgtgtaatgataaaaggactagtccagcaggaaaatatcacaatcctaaatatatgtgcacctgacactggagctcccagatttacaaaacaattactactagacccaagaaatgagatagaccgcaacacaataatagtgggggacttcaatactccactgacaacactagacaggtatcaagatagaaagtcaacaaagaaatgatgaacttaaactatatcctggaacaaatgaacttaacagatatttatagaacattctatcaaatagctgcagaatataccttctatttatgaaatattctccaaggtagataatatgataggccacaaaacaagtctcaataaatttgagaaaattgaaattataccaagtactttctcagactacagtggaataaaattagaaatcaactccaaaagaaactctcaaaaccatgcaactacacagaaaccaataacctgctcctgaatgatcactgagttaacaataaaatcaagatggaagttaaaaaattctttgaactgagcaataatagtgacacaactatcaaaacctctgggatacagcaaaggcagtgctaagaggtaagtttgtagcattaaatgcctacatcaaaaagtctgaaagaatacagacaatctaaggtcacacatcaaggaactagaaaaacaagaacaaaccaacctcaaacccagcagaagaaaagaaataaccaagatcagagcagaactatatgaaatgaaattgaaacaaaaaaatacaaagattaatgaaacaaaaaactggctcttttaaaagataaataaaattgatagactgttaatgagattgaccaagaaaagaaaagagatgatcctaataagctcaattagaaaaggaacaggaggtattacagccaatactacagagatacaaaagatcaatcaagggtactatgaacacctttatgtgtgtaaaccagaaagcctagaggagactaataaattcctggaaatatacaaccctcctagattaaaccaggaatagaaactctgaacaaaccagtaacaagcagcaagattgaaatggtaatttaaaaaattaccaacaaaaaaagtccagggctagaggaattcacagttgaattctatcaaaaattcaaaggagaattggtaccagtcctattgagactattccaaaagatagagaaagaggaaatcctccctaagtcattctatgaagccagtatcacccaaataccaaaactaggaaaggacataaccaaaaagaaagctacagaccaatatccctgatgaacatagatgcaaaaattcttaagaaaatactagctaacatcatccaacaacatataaaaaagataatccaccatgatcaagtgggttttaaaccagggatgcaggaatggtttaacatatgcaagtcaataaatgtggtacaccatataaacagaacttaaaacaaaaatcacatgatcatctcaatagatgcagaaaaagcatttgacaaaatccagcatctcctcatcattaaaaccctcagcaaaatagaaggagataataaaagccatttatgacaaacccgcaaccaacattatactgaatggggaaaagttgaaagttgaaagtttttcctctgagaactggaacaagacaaggttgaccactttcactacttctattcaacatagcactggaagtcctagacagagcaatcaaacgagagaaagaaataaagaacatcgaaatcggtaaagaggaagtcaaactgtcgctatttgctgatgacatactcgtatacatagaaaaccctatagactcatccaaaaagctcctagaactggcaaatgaattcagtaaagcttcaggatacaaaattaatgtacactaataagtagctctgctatacaccaacagcaaccaagctcagaatcaaatcaagaactcaaccccttttgcaatagcttcaataaaaaaatattcttagaaatatacttaacaaaggaggtgaaagacctctacaaggaaaactatgaagcactgatgaaagaaatcataaacaacacaaacaaatggaaacacattctatgctcttggatgggtagaatcagtattgtgaaaatgaccgtactgccaaaagcaatctacaaattcaatgcaattcccatcaaaataccaccatcattcttcacagaactagaaaaaaaaacctctaaaattcatatggaacaaaaagaggcccacatagccaaagcaggactaagcaaaaggaaaaaatctggaggcattacattacctaactgacttcaaactattctataaggccatagtcatcaaaacagcatggtactggtataaaaataggcacatagaccaatggaacagaatagagaacgcagaaataaacccaaatacttacagccaactgatctttgacaaagcaaacaaaaacataaagtgtggaaaggacaccctattcaacaaatggtgctgggataactggcaagccaagtgtagaagaatgaaactggatcctcatctctcatcttatacaaaactcaactcaaaatggatcaaagacaaatctaagacctgaaatcataaaaattttaaaaaattatattggaaaaatccttctagacattggcttatgcaaaaacttcatgaccaagaacccgaaagcaaatgcaacaaaaacaaagataaatagatgggacttaataaaactgaaaagcttctgcacagcaaaagaaacagtggagtaaacagataacccacagagtgggagaaatctttgcaatctatacatctgacaaaggactaatatccagaatttacaaggaattcaaacaaatcagcaaggaataaacaaagaatcccatcaaaaagtgggctaaggacatgaattatcaaatgaattctcaaatgaagatatacaaatggccaataaacatattaaaaaatgctcaatattactaattatcaggaaaatgtaaatcaaaaccacaatgtgatatcactttactcctgcaagaatggccataaaaaaaaaagatgttggcatggatgtggtgaaaagggaacacttttacactgctggtgggaatgcaaattagtacaatcactatggaaaagagtgtggagattcctcaaagaactaaaagtagatctactatttgatccagcaatcccactcctgggtatctacccagaggaaaagaagtcatttacaaaaaagagacttgtacatgtacgtttgtagcagcacaattggcaattgcaaaaatatggaaccagcccaaatgcccatcaatcaatgagtggataaagaaaatgtgattttatatatatatacacacacacacacacacacacacgatatatatatatatatacacacaccatggaatactaatcaaccataaaaaggaataaaataattggaaataatggcatttgcagctacctggatggaattggagaccattattctaagtgaagaaatggaaaaacaaacatcatatgttctcattcataagtgggagctaaggtatgaggacacaaagttataagaatgatacaattgactttggggactcgggaaagggtgggaggaaaataaggaataaaagactacacattgggtacagtgttcactgctcgggtgggtgcaccaaaatcttagaattcaccactaaagaacttattcgtgtaaccaaacaccacctgttccctcaaaaccaattgaaataaaacaaagaagaagaaaaaaaagaaatcttgagctgtcaggatggaaaaaagaacaaagtgaaattacaagtaaatacaatagactttccttctccttcaattctctaaattaagtttgatggctgaaagaaaattctaatgctatctgatgtggttctaaatgtttctggaaaaaatttaaaacaattgtattataagtgggagagggtaaaggacataaaggtagatatactttctatattttgtctacttaccagtagactgataagttttctgtatatattgtaatatgtaaagcaaccactaaaaaagctatacaaagaaatacactctaaaacactgtagataaataaaaataaaattataaaaacattcaaataacccacaatgatatataaaaaagaaaacagttaaagggaaagcagaataagcagaaaatgataaagtagaatggctgagttaagccctaacatatcagcagattacattaaatgtcaattgtttatatatgtcaattaaaaaataaaagttggcaaagtagattaaaaacatgacacattatctacaagaaactcactacaaatagaatgatacaggcaggttgaaagtaaaagggtgaagatatatatatcatataaacattaattgaaacacaacaggagtagcaaacattaattaaaaaaccccagtagtggctatattaatatcatataaagtaggcttcagagtacataaatatgccagagacagagaaggatattatgtaatgacaaaatagtcaatcaccaagcagtcatagcaaccctaaatgtttatgcagtaaatatgacagcaacaaaatatgccgagaaaaaaaaactaatttaaagtataagaaaactaaaaaagaactgaaaagagaaacacataagtccataagtataattggagactttaccaccactctcctaacaactaatccaattagacaaaaatcagcaaagacagaaaactcaaaagtgccatgaacaaatatctaattggcattattaaatactccatccaacaacacagttctattcaagcacccatgaaacatacttagatcatataaaacaaaccttgataaatttaaagttattgaaatcacaccaagtgttttttgtccacagtggaatcaaactacaactccacaacagaaagataacaagaaaatcttcaaacgtggaatttaacagtatactttttttttttcttcagagacagcgtcttgctcagtcacccaggctggagtgcagtggcatggttatggctcactgcaacctcaaactcctgggctcaagcaatcctcctacctcagcctcctgtgtagctaggactacaagtgcatgccacaaggcctggctttttttttttttttttttactttttgtagagatggagtctcgctgtactgctcagattggttttgaactcctggcctcaagcgatcctcccaactcagcttcccaaagcactaggattacaggcatgagccattgtgcccaacccctaacagcatactttaattcatggtcaaagaggaagtatctgaagggaaattttgagaaacacactgaattgaatgaaaacgaaaatgcaacatatcaaaaaattggtgtaacacagctaaagtatggtttagtgaaaggaaaatttatagcacttaatgtacacattagagaagtataaagtcttctgcctcaagaacacagaaaataaagagccaaaaaactcaaagcatgccaatggaaggaaataataaggataaaagcagaaatgaaaacagtaagacaatgaatcctaccaatgaaactaagagctgattctttgaaaatatcaatacatttgacaaatttctaataaggccaacagaaaaaagagaaacaaaagaaacaagtgaccaatatcggcaatgaacaacaaatatcactacagatatcaaaaggataagggaggactatgagtaaatctacacatacaaatttgacaaacatttatgaaatgggccaaatcctaataaagtaaaatccatcacaactcacacaacatagaaaatgactatttgaatagcattataactattaaatagattctataatgtaataattccaaaaatgaaatttacagttccagatggtttcagtggagaattctgccacatgtttaaagatgtaataccaattctacacaaactcctccagaaaatagaaaaggaggggacactttccaattaattttatgaagctactcttaccctgatcctaaaactagtaaaggcaatacaaaaaataaaactacacaatatccgttatgagtatagatacaatatcaagaaaattctatttgctggcaaatagaatccagcaaatataaaaggagtgtatattatcaacaagtagggtttatgccagggatgcaatgctaactcgatattcaaaattaatcagtgtaaaccacaataataacagactaaagaataaaaatcacagatgatatcaatcaagacagaaaaagcatttcaccaaattcaatacctatgcatgacaaatactgtcagaaaaatgggaataaaggacacctttctaaacttggtaaagaacatctataaaaaatacagctaacagtacacttaatggtatactgttataccaaagactgaatgcttccccctaagattggcaacaaggcaaagatgatcactctcaccatcactatacaacatagtcatggaatttctagccagtgcaatgaggaaaggaaggaaataaaaggcatatgatcagaaaggaagacagaaaactgtatttctttttaaataacatggttgtctctgtggaaaatctcaaaaaatctaaaacaacaacaaaaaactccaaaaactacaactaagtgtatttaataatgtcttataatacaaatttagcactcaaaatttagctgtatttctatgtactagtgatgaacatatagacacccaaattaaaaatacaatacgatttccaattgctcaaaaagaaaatgaagtacctagatataaatataactaacatgtacaggactcatatgctggaagctgcagaatgttgatgaaggaaatcaaagaaggtctaaatgaatggagaggcataccatgttcatggattggaagactcaatataatgaggatgtcagttgtccacaaattgatattccaatttaatgaaattcctttcaaaatcctagccaggtttttaaataaatatagacaagataatctaaaatttatacagaaaggcaatataactaaaatagctaaaatacttttgagaaaaatggaaagaatcagtctactcaattctgagacttattacatagctacaataaccaaaagtgcatgctatcagcagaggaatgtacacatagatcaatgaaacagtagaaaacttaaaaatagatgggagggaaatgtgagtggctaataaaaggcagcaggagggatccttatttgatggaaatgttttgtatcttcattctatcaatgtcaatgtcctgatttaatattatactataaatttgcaagatgttaccattgggggaaaccaggttaagggtacaccgaatctctctatattgttttttacatcttcacgtgaatctacaagtatctcaaaagacaagtatctcagagtctaattaaatataattacctcaatagacacagaaaatgcatttgacaaaatacaacatccattaaggatagaatctctcaacaagctaaaagagaagagaatttccttaacttcataaaggacatctatgaaaaacacagtttacatacataatgatgaaaaactgaatgcttctcacctaagatcgatatgtcctttccttaggaccccttactgcaggacttctgacacaccctgtcataatttttgcccatttttctagcagagcacaaagccaatcaaataagggagttctattcagatcttcttttccttccatattcagataatagttcctgacaataatctattattaccatctgctaaatgcaaattatttccttaattaattgttcatattttgaaaacaggtatagtgggagacttgtatgaaaaatatgtttttattaaaaaaatttcttagatccaaaggaatactaattttttatgcatagtaagtcaaaaggtttgtgaaagattaagtatgagaatcattttatttatggttaattctaaatcaaaagggtaatgggctattttattttgttctaagattaaccttcttcagtactttaagaattggatatattctgtatgctgtgattattaaggaaattcataaaaaaaagggagaatggaaaaatattgatagtcataattagactttatcaatacaacctaataattatttgatgttctagtgaacagtagctcgtaggcttattgtttcctattatttactgccagagttggtaaggttagatgttaacttaatacaaaattcacaagttaccaataatttttgccactgagtatgaaaatgacttctatgtggtggaaatgattaccccaaagttgcattttttcccattgaatgtgtgcatgtgcatttgtatgcatcctcatatcctcctttgaaagagctttgccatgcttcgtgtattagttttctccttaatgagttaaataaatgtgatcttttgacacattcttaatatatgagggtcaggtgttcagaggtttgaaaactaagctttgatataaaggaaaaaagaggatttagcacatgtggggctgtgagccttcacatagagctagcatggagaggattggcctcaggccagcctgtggccattctgctctaaggggcaacattagcccatatgcttgctaatgcttttatttatatttattgtgtatccgttatatatacagaatgtgctaggagttgcaactgtaattttggttactttaataagaatatcttctgttaaaatttttctctctctcttttttttttgcttctcctggacaactctgattcatgggcttaaattatcttagtatgctaattatactggaggactgggagcatatactagactgtgacatcctgaaaattcgtgagtgtccctgttgagtgaaaatggtacattgactgtgttgtgtgcagaagaaatattgaggctggcagagtgtttatttctctacttgattgaaagtagatttctgtaacggagctatttgctcaagagtttgaacctctaaacccaattctagaaacttagggatttttttaaaaaggaacacagattgggggacagagcaagaggtggaaaagaaatctccactgatcatcacccccagcaagaacatcaatttaacaactatccacacacaataaaaccactttcataagaaccaaaaatcaggtaagcactcacattacctggttttaaccacatattgctgaaaaaggcactgaagaggtaggaaaaacagtcttgaatcactaatgccactactccctcatccctttagttgtggtggcgtggtgtagagagcagctttgtgctctggggagagggagagcatagcaattatgagacattgaactcagtgttgccctgttatatgaaaaaaacaaaactagaccaaactcagctgacacctgcccaccaaagagcatttaaaccagccatagccattagggaatcactgatctcagccgtctgaacttgaattcccacaagcctcatcactatgggctaaagtgttctagggctgtaaataaatgtgaaaggcagtctaggccacaaggtctgcaactcctaggtgtgctgaactggacccagagccagcagactaagtgggggggcataaaaaatatgattatttcaacagatgctgaaaaagcgtctgataaaattcaacatcccttcatgataaacaccctcaaaaaactgggtataaaatgaacatacctcaacataataaaaaccatttatgacagacttacaggtagtatcatactgaatgagaaaaaaactgaaaaccctttctctaaggtcaagaacactacaaggatgcccactttcaccactgttatttacgtagtactagaagccctagctagagcaatcagacaagagaaattaataaagggcatccaaacttgaaaggaaaaagtcaaattatttttgtttgcagatgatacaatcttatatttggaaaattcttgtttgcagatgatacaatgttacatttggaaaaccacaaaacactgttagaaccaataaacaaattcagtaaagttgcaggatacaaaaccaacatataaaaatcagtagcatttctatatgccaacagtgaacaatcagaaaaagaaatttaaaatgtaatcccatttacaatagccacaaataaaactaaatacctaggaactaacttaatcaaagaggtaaaagatatttataatgaaaactataaaacactgatgaaagaaattgaagaggacacacacacacacacacacacacacacacagaggaaagacattccatgttcatggattggaaaaatcaatattgttaaaatgtccatactacccaaagcaatctacaaattcaatgcaatccctatcaaaataccaatgacatttttcaaagaaatagaaaaaacgattttaaaatttatatggaatgacgaaagacccagaatagtcagagctatcttaaacaaaaaacaaaacaaaacaaaactggaggaatcacattacctgaaatcaaattatactacagagttatagtaaccaaaacagcatgatactagcatgagaacagacatatagaccaatggaagagaatagagaacccagaaacaaattcatacacctatagtgaactcattgtcaacaaagatgccaagaacatacattgggaaaaagatagtctctttgataaatagtgctgggaaaactgaatatccatatgtagaagaatgaaactagaccccatctctcataataaaaaaaatcaaaatggattaaagacttaaatctaagacctcaaattataaaactactgcaagaaaacattggggaaactctccaggacattggtctgggcaaaagtatcttgagtaataccctacagacacaggcaaccaaaacaaaaatggacaaatgggatcacatcaagtaaaaaagtttctgcacagcaaagggaacaatcaacaaagtaaagagacaatccacagagtgggagaaaatatttgaaaattactcaggatatatacacaaaacaaaggaaatcatttattaaagagatatctgcactcgcatgtttgttgcagcactgttcacaacgccaaaatttgaaaacctagctgagtgtccatcaacagatgaatggataaagagaatgtggtacatatatacaatggagtactatttagccataaaaaatgagatcctgtcatttgcaacaaagtggactgaaccagaggtcattatgttaagtgaaataagccaggcaaagaaagacagacatcacatgttctcgtttatttatggggtctaaaaatcaaaacaattgaactcacagagatagagagtaggatggttaccagaggctgggaagggtagtgaggggaacaaggtaggtggggctggttaatatgtacaaaaaaatagtttaaaagaatgaataagatctagaatttgctagcacaacagggtgactatagtcaatactaatttaattatacatttttaaataactaaaagtataattggattgtaacaaagaatagacacttgaggggatggacaccccattttccatgatgtgattattatgcattgcaagcttgtatcaaaacatttcatgtacttgataaatatatatacctactgtgtacccactaaaataaaattaaaacaaaaaaacacaatatataagcttaaacatttttaaaattggtctcagtaacatatattaagctgaagtggggaatagtctctgaacattagaaacattagaaagttatggcttgtttctaatatgcaagttagacagaaaatacaagctccataatcttatattgcggaagcaacatttgttttaagtcctggaatccacggcctccatttcctcatcttgtgttaatggaattgtatctgcagccagagaaagaggtttctagttagtgaatattggcaaagattctaggaaagtttgagttttactgatgaaagagtggaatgtagacaagattccaactggagtagcccaggaaaagagcttgtcagataaagctgaaaggtaaattccttatctgcttgtctaatgggactaggtatgatatttatgcccttaataccttataaccatcagttcagtaccagaaatgcatgaaactctgttttttagtttttttaagtttgtattaacaaatagagacattaaaagacacacatcatctcttgaggcttgactagccattcatctccactgccatgagaaatcacctgccacctgcacctgcacctccttctgtgcaaaagcacctttgtttggcagaagaccctcaagaatccaggaaaaagtcttcttcctctaaacccagttgaattcctaaatcaatacaatgcaaaatccattggttaaaaagaacatgaatgagataattttttcctactcatgggtcgcaccccgagggacttgctctggcttccaaccctcgtggggaggcagcagccctggttagtgggtgggctccgtggctcctcttgtgctgttgggtcagcacagcagctggaagccagagggtcacctgtccttttgtaccagcgaaggttcattttcctcagtgtttccccaagggcaggaacatatttttactgatgaccaattcagtttttccagaggtccatgtgtttctgaattcagaattttagaatccagtaaagttcatattgtcaaataacttatttaaagagttagggaaagacttggggaaagactttccaatctctcacttcacttccagtgtgagatgttatttatatatgcaaaactgggaggtatatatgtatatacacatctaataagaataacttgagttgagcaaccctaagatgctaccatttgtttcatcctttttaaatgtgcgtagcccctctccaaacacacataagcagtttgaggcagggaccatattttgtactttttgccttcaaagagcatgatccatagcaggagctactaatgagtgttcgatcatcataatgatgaattaaatatagatattttgtcattcgtattttattcatttatttttggagatggaatcttgctctgctgcccaggctagagtgcagtggtgtgatcttggctcactgcaacctccgcctcccaggttcaagcgattctcctgttcagccgcccgagtagctggggttacaggtgcccaccactatgcctggataatttttgtatttttggtagagacagtgtttcgccatgttggccagggtggtctcaaactcctgacctcaggtgatccacccaagttggcttccgaaagtgctggcattacaggtgtaagccaccttgcctggcctattttgtcattttaaaaatgtatttctctaccttcaggtggagtcacagatctcagtggtcacccccaagtggagaagctgtgcgatgctgatggcctctagggggtgaggccactgggaaccaagccctcccctgcagcccagcgctgtgtccgctgcagcatgggatcctcggggcactggctggggacatctgaagaggttattgcttcgctggcatggacggcaagggtcacactgcccagctgtgagttgcccctcaagcagcaccctgtcgccattccagaggaatgttccagaggaaacaaggaactgagcttagctcatctctggtctctcctcccaggaaggacttttgtgaggcctgttttgtcccccactgcccggccatagccaagtccctaaatggaccttctttgaaggaagaacccagctactcaacgcccaccctgttcccagcccctggttttgatgaaaatgcagtcgtgcccatgaaactaggaatctgtggggttttttaaaactgcagtgagagacaaagagctgcttctctttgtcaaccaggcttcccccctccagacatttgcttctgcttagagatattatgagccggaaaattcacaaggccaaatcagagacaggggaaattcctctgagggttggtgaatggaatataaatcctgctctgatgtggaaaactaagttgctgctcagtcattattcctgtcagcattccagggccagtccttgtcattaaagctgcactttcatcctgtccacacactcaaggccacacaaaaataagggactgcccaacactaaacttcttttattttttgagggaagggggcactcctctttagggaaacaatatgtttaagtcaagc

SEQ ID NO: 620 - DNA, 20001 bp, Homo sapiens
aaaaaaaaaaaaaaaaaaattcaactataagaagtgataaatacttattataaacactatcatcactgtgatttgtctctatttgggttcggtgagttttaaaattgctcaatgttgaccccaaggagaaaacaacatagtggaaacaatgttgggttgatttatatgtcattctactgtagaaatccctctgtgcaagcctggaattgtggtttcggataatgtggtaggcaggagcacattaagtactcaatggctaacactcataagattgtgatttcctttcctttgaaacaacaaagcagaactctaatacgatgtgcagtatcaggcatggcagaggaagcatgcacagtgtaaagaggggaacgctgctatctctaggatgtgcttatgatgcgacagttgagagagggcagaagatggaatgaataaagactttatcctgtcaactagaaccacgttaaacttaacgatatgtatggacggtttacattttgaacctggcctgtttcaatccaatcccatacttgctgtatggttatggttaatgacaaaaacagtatggacacatacatgcgcatgcacacacacacacactctctctctctctctctctccccccaaatgtcttttggatttaaaagaaagtatctgaatattgaacattcagccattatatacagtcataaaacctcttttaaaaaaaacaagcagaatgactctaaaggctgaatctcttcttagtagacttttaaaaagtaatatacatataaaaagatgcaaagcataaagtttcagctcatcaaatttatacctagtaaacaaacctatgtaactcccatccacatgaagaaagagaatatgatagtcaccatatagatagaaggaggacttcatgttcctgtccacttattacctcacctctaaatgcaaccatgatctttccttccatcattacagattaatctgggctggttttaaatacatgtaaatagaatcatcatatgggctctcttaggttaggcttcttttattcaacattatattgaagatttattttattacatgccacattaggtactttatttttatttttggagattttctcattgaataaatataccatgatttctttatccattttactattactgaacatctagtttgttttcaggctttgtctattagaaaggtattattgtttaacctcttagtcctatcttttagtgcacatatgggcatatttttgttaggtttcttaccagaaattcattattttgaattttaggatctgtgtatgtatgtatgcatgtatttatctatctatctacctatatatgtatgtatgaatgtatctatctatcaatctgtcagcaaatagtttctaaagttgctagaacaatttcgtctcccaccagtaatgaattagagttcctaatgttcttcagcatcaccaattctcataatgcagatattgcttcatattttcagtggtttataagacaaacatttgctcctcttacaaatctgcgtatcgattggtgaggctctgcttcaggctgaaggtttggttcaggtttgctttgtatgtcttcattttccttggtccagggcatagttttcttataaaaaatgacaagagcagcaggtaagaactttgcaatatcctttaaggcttctgcccagattgtcacttttgcccacattctgttggcaaaagcaagtcatatgcacaggtcaaaaatcaattgtctaaagtttataatactctgcctactctaatgttaaggtatggcaacaatcgtatggcaaggaccatagatatatataattctaatacagaggacagaataatcaggatttttttttattttattttagtcagcatggtgggaatatattgataccccattgttgatttaagttgcattttactaagtatgaatgctgattatcattttaaatgcttatttgatatccagatatcttttgtgaagtgacaaagttttctttttttaccattttctgattatattgtctattatttattctttgatatatgaacactatatattctgaatatcagtcctttgtaaattatatgttgcaaatattttatcccagtatgtagtttatatatgtgccctattaatggtatattttgatgttcttaactttaatagggtacacattatttttttctaatttttcaactacttctcatcttcttgaagatatgtttcctactcttagtcaaaaatgtacttgttgttataactctcacatgtagatctgcaatccatttgaaattgatttttctatatcctgttacttagagaatcaaattcattattttcacgataaaatccaaattgagctagcactacttatgaaagaaaagtccattttatttcccattgaattgcattggcaagtctctcaaaagtcaaggatccatgtattagtagctatctgtccagattctctattctgcatcatcactccatttgtctatatagttaatgcaaatttcacactgccctaattttacttgcttgataataaatcttgatatgtgttagtataaatcctaaagctttcattcctttttatggttacctcgactctttatagtattttgctttttgacagaaaatcaacaaacagcttgccaatatccacaaaaacctacttacagcttttgattacaatgaaactataaatcacctaggaggaaattgatatctttacagtattatgttttccactcagtaaaactagaataacttaaagaatgtataattaaactatgaatatttaagaaattatcaatgacaatgaatacaaaattagaaatattatttttctatatcagaaaaattaaatattcatcttatagctattattatttgaagtgtttttgttttgttttttatttgtattatcaagcatcctaaagcattttaaattactcagtttgcttttatatatttctattgaacaatgtatgatttttctataagttgtgaaaaaaatcaactcagttatatagaaccagagataataaacaggaataaagtgcatgttcccccagtttaaaaaatcatattaggtatttaaaaatatgtataattttcttattttccaatgtttcctgttagtctacgactaaacacaaagtttttttggctgttttgactatattattctatggatatttgcatacatgtgcacttgtctaaaggtatattctactgaattttttgacactgaattattacatcgtattttttcatgaaaatatacacatgcacacaagcacacatagttgatattgatactgaacctgatattgatacacatcaatgagctaggtattatacacaaatgcatacacccaatgcaaaagttcaaaaccatctttcttatctaccatccacagcctcatagttcttaatactctgttgttattgtgtattgtggtgctgattatacaggtatattagtttacttgcaatgtcataataaataccacagactaggtggctcaaacaacagaaatttatattcttccaacttctggataagcccaagcagggttggtttcttctgaggcctttctccttggcttgtagataacggtcttctcctccttggttgttcactctgtaccagtccgtgacctattcttttatatggatctcaaccagatgaaattacggctctgctaataacctgattttaactaaattgcttctttaaagagcctatctctaaatacagctactgtctcagatactaggtgttagaacttcaacatatgaattgtggggaaacacaatttagcccatagcagcagatgtgtttaatttgtgatattaattgatctgtatacttacaatatgagtaaacacacacgcgtaatttaaggagttccaaataacagtttgtgatctgccctctactgcccctggtcctggttctttggctgtatctgaatcttttctttcctttaacctgggctgactctgcttaataacaattcttcaaactttgaattcatctccatgttttagaagattttaaaataacttttattttatttctgaggtcctgagggcctaggctacccccatagctctctgatctagtgggtgctgctggttgttttggattgcctatgcaaattggaacctgtgtagtcctctattattaatctcccaggctttcttcagacctccttgcagtcagtgggttttactctccctccagatgagtatttatgtctacttctgtgttatttggccgtgaggatcctcagaacttccttttctgcccacttccactatttcagtacagctggtacttgcacacagaggctgcaggttttgtggtagtggatgtttagtctcatataccaaagtgcacgctcataccttgtcacttaatttgctgcaagccgttgtctgtatttattctgttctttttgtcatcctggctgctattcatcttttaagagagatctgacaatgattatgaatcctgagtcatggtcggacatggtggctcacgcctgtaatcccagcactctgggaggtggaggcgccgggatcacttgaagtcaggaatttgagaccagcctggccaacatagcgaaaccccatctctactaaaaatacaaaaattagccaccagttgtagcggcgcacgcgagtaatcccagttactcaagaggctgaggcacgagaatctcttgagcctgggaagcggaggttgcagtgagcctagatcgtgccactgtactccagcctgggtgaaagagtgagactttgtttcaaaataaaataaataaataaatacatacataaatacatactgagtcaaggtcaaggttttatcccagcagcaagtccttactttcaggttttaatgtttcagttttttataataacattctattaatttcagaagatgaaaaatgatgaaggtaaacactgaatgctcgaaaagtaaaactaggtaacctaatcagagtacattttaattgtatgattgtgcatcatttcggtgatcctgcctatataattgttagttttctgagcatttggacttactctataaaattctgacaaataacagtgattattagagagatggtttctagtggcatgtatatacagtgttcagtggactttagacattcaatacatttaacttttagcaaatattaggccatacttaactcaaagctataatttgataaatttgtccaaaaaataaagcttatgcatgtattccaaaaaagtaaatggaatagatactataaatattatatattttattaaatgatttatgttacataatatataatacatattgcttatatcactatgagaatatgtcatatatatgcttttatttttaaaatatctgcttataataatacctattcccacaataataaagatgtaaattaaaaatacatttcggttgtcatctggtatcctttttgcgatataaccactattactatttactgtatttttttagatttttaagtgcacaagaatatccacttatatcaatttactgcataaatgagaatattctatgcacattcctctgaatctttcctctttaataatatcttaagggttttttgcatattaacacatagctcattattttatcatatacataatatttcattgagtgggtatcaccataatttatttatttcagcccttaccgaggtatgtatccattgtttacagtaatctattacatattattatgatctaaatgtgtcccccccaaaacattcatatgttgaaactaaattaccaatttgattagtacaaagttggacatctgggaggtaattaattcgtacataaggattaacacccttataaaagacgtttcagagagctgttaatgccttttgctccttcactggcctcatcttcactccaagatgatgcagcgagaagccttctccagacgccaatcttccatcacctggatttttgacttcccagtttccaaaactgtgagaaatacatttctattacttataagttaccaagtgttatatattgttatagcagtatcaacaaattgtgacaaaattggtaaagagaagtagggtattagaacaagtacttaaaaatgtggaagcagctttggaactgggcagtgggtagaagctaaaagagttgggaagtgaatgctagagaaagcctacatttccatgaatgcaccattaagggcaattcttgtgatggctcagaagcagaagagagctgtagggaaagtctgaatcttctcagagattacttaagtggttgtgatgagaatactggtagaaatatggacagtaaaggccattttgatgaggtctcagatggaagtggagaacaagatattgaaaactcaaagaaatgtcatccttgttataaagtgacagcacttggctaaattgtgtccctctcctagtgctttatggaagacagaactctgagcaatctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttgttggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatacccctttatcattttttattgtgtctgtttgattcttctctcttttcttctttattcgtcttgctagtggtctagagaatttagaccaatatccctgatgaacatcgaagcaaaaatcctcaataaaatactggcaaaccgaatccagcagcacatcaaaaagcttatctaccatgatcaagtgggcttcatccctgggatgcaaggctggttcaacatatgcaaatcaataaacataatccagcatataaacagaatcaatgacaaaagccatgtgattatctcaatagatgcagaaaaggcctttgacaaaattcaacaacacttcatgctaaaaactcttaataaattaggtattgatgggacgtatctcaaaataataagagctatctatgacaaacccacagccaatatcatactgaatgggcaaaaactggaagcattccctttgaaaactggcacaagacagggatgccctctctaatcactcgtattcaacatagtattgatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagccgataggcaacttcagcaaagtctcaggatacaaaatcaatgtgcaaaaaccacaagcattcttacacacaaataacagacaatcagagagccaaatcatgagtgaactcccattcacaattgcttcaaagagaataaaatacctaggaatctaactgacaagggatgtgaaggacctcttcaaggagaaccacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattgaaaaaactactttaaagttcatatggaaccaaaaaagagcccacattgttatgtcaatcctaagccaaaagaacaaagctggaggcatcacgctacctaacttcaaactacactacaaggctacagtaaccaaaacagcatggtactgctaccaaaacagagatatagaccagtggaatagaacagagccctcggaaataatgccacatatctacaactatctgatctttgacaaacctgacaaaaacaagaaatggggaaaggattccctatttaataaatggtgcttggaaaactggctagccagatgtagagagctgaaactggatcccttccttacaccttatacaaaaattaattcaagatggactaaagacttaaatgttagacctaaaaccataaaaaccctggaagaaaacctaggcaataccattcaggacataggcatgggcaaggacttcatgtctaaaacaccaaaaacaatggcaacaaaagccaaaattgacaaatgggatctaattaaattaaagagcttctgcacagcagaagaaactatcatcagactgaacaggcaacctacagaatgggagaaaatttttgcaacctactcatctgacaaagggctaatatccagaatctacaatgaactcaaacaaatttacaagaaaaaaacaaacaaccccataaacaagtgggcgaatgatatgaacagacacttctcaaaagaagacatttatgcagccaaaagacacatgaaaaaatgttcatcatcactggccatcagagaaatgcaattcaaaaccacaatgagataccatctcacaccagttagaatggcgatcattaaaaagtcaggaaaaaacaggtgctggagaggatgtggagaaataggaacacttttacactgttggtgggatggtaaactagttcaaccattgtggaagtcagtgtggccattcctcagggatctagaactagaaataccatttgacccagcaaccccattgctgggtatatacccgaaggattataaatcatgctgctataaagacacatgcacacgtatgtttattgcggcactatttgcaatagcaaagacttggaaccaagactaatgtccaacaatgagagactggattaagaaaatatggcacatatacaccatggaatactatgcagccataaaaaagatgagttcatgtcctttgtagggacatggatgaagctggaaaacatcattctcagcaaactatcgcaagaacaaaaaaacaaacaccacatgttctcactcataggtgggaattgtacaatgagaacacttggacacaggaaggggaacatcacacaccagggccttttgtggggtggggggacgggggagggatagcatttggagatatacgtaatgttaaatgacgagttactgggttcagcacaccaacatggcacacgtatacatatgtaactaacctgcacattgtgcacatgtaccctaaaacttaaagtataataataataaaaggaactttaagcaatcaactaggatagctggcagaagaaatatctaagtaaagttttgagagtgcagcatggctttacttgactgcttatagaaaaacgtaagaggagaggaaaaaaaggataaaaatgaaatttataatcaaaggggaagcagaatgtaatgagttgaaaattcataccctctagaaaatgagaaaatgtattcaagcgataacaccaggggtgtggccaagtgactgataaaggagaatcatatggatgggcagaaaccaggtggtattcattaagaccaaaaaaaaaaaaaaaaaaatgactccacaggcatttggagatcttagaggctgccaattccatgataggcccagagtgccacagccttgagggcagaatggtttcaaaggagggtcccaaggaacacacaggaccttggggctcactgcccagggccacctgaagattgtgtttcccacattctggcagcgttcctcagatgatccaggtgtggcttacacagaccctagtgccgctcaggccatctctccggaccacacatgaattggtggtaaactttgttggcatccaaatggtgctaactctgcaggtgtgcagagtgtatgagctgtagaggcatggctacccttacctagatttcaaaacatgcctgggacagactcaaggcccaggaagagaactgtcccaggggcaaagctgctgcagagaggcttcactagggcaaggcctagtggacccatgggagtgaggctactactaagactgcagaatggtagagccaccagtgtgcaaccatagcctgagagagctacaggaacaagaatcaaggtgtgagatctgtgattttggttgtgccctgcaaagttgtgaaagttgggctctgagagccttgggggcccaaattcctgcttcagtgtgttcataaggcaggaaatgaagtcagagaagattatcctcaaggctcaatatttaatggtttgctctgttgagttttggacttacttggggctaattatccctttcttcttctctatattttcctgttggataggaatatttaccctatctctgtctcaccattgtattttgtaagcatgtaacttgtttgagttcatatattcacagctagagaccaatttgcctcaggatcaatcaattgtaccttgagtcttattaatttctgacttagaaatgagaagtattttgggctattgagataaaatgaatgtatttttcaggtaacaaggacatggatttgtggggagtggagggcaggggtgaaatgctgtggtctgaatgtgtcttctcaaattgcaaatgttgaatcttaatctccaatgtaatagtgttggaaggttgggaccatgggaagtaatcatgagggccttgtgctcatgaatggtagtaatgtgcttttaaaagactcttcagagagcttctatctccttttggctttctacgtgctgccatgtgacaacacagcagtaaggtgtcatcttggcggcaaagagtgagccttcaccagacagaatctgctggctccttgaccttggacttcccagcctccagagccatgagaaataaacttctattatttataaattacccattttaaggtattttgttatagtggtatgaattggctaagacacaaacaatgttgcaataaaaatctcattatgcaaataacatggttttgaggattaaaaaaaatctttcctgcaatccaaatgcttagatacttttatagtctcaaaaaaattaaaaaatcatgaactttctgaaaaatatattgagagataaaaaatagacagggataaataagaaaaaacagataattttaaaaaataaagaaaaaataaaaagtattcaagaacttaaaactagaagtctacctgctaaatctgcctagaggaacttagaagaacactgcagaactgctgtatcatatagagtaatttccatattaaatgattaagatatttaagctgagtataaaaacaacattaaacaagaaatatggtctttaaagataagcattaagtaaacaactcagatggttttactctaaatagatttttaaatacatgatataaagatgctgtggcatagttataccttaagatattattcagccttaaaaaggaaatcctgccatttgtgacaacatgaatgaactatgaggacatttcctagaagacataagccatataaaaaagagaaacactgcatgatcaaacttacatggggaatcttaaaaaaaaaatgaatacataaaaacaaagagcatagaaaggtgctttaccagaatttgaaggagtggggaaaattaggagagatatatcaaaaagcacaaatacgcaattatctcagatgagcaaggctagaatgtacagcatgagaattgtaggtaataatatggtatacaggaaatttgcttgaaagtaaaaaaaatttaattttgtgagatgatcgatatgttaatttatttgactgtagtagacacttcactatgtatgtgtatataaaccatcaagctgtacaccttgaatatatacaataaaaattaaaaagatatagttaaaataaaggcaatatttataatattagtaaatagaaaataatttgagaaaattaaatatacagagaaaataaaaccattttgatagatgaaatatctaaagcatactgaagatcaattaaatataaatctttaaatatttagtaagagcatgaaatatatgaaagggggaaccaacaagaatacaatagaggcattctttaataatttgacttcataacgatgaaaaagcaaataaaatatatagaacagacgtgataaatcgtcattcattctgggactacacacataaagtaagtgtgttagacaatcttgtgtagatcatgaactactatatgtgaaatacaattataggcactggtagttctaattaatatactcctttaattaaataatctgaattagtgaccgaaaatgacaaaattataagtgttgcacttaacgtaattatctaggaaatttaagaatatgacctggaaacaaaagtcattttagggtatgagaaatgagtaaaataccctcattttactcatgaggtaaatgagaagaagtaatacagaaacatagagaaacataaatacttttgcatttgcagtatccagaaaaaactgaaatagagaaaaagcttcattcacagtgacaagaaaatataaaatatttatgtatgtgttttggtacaaataataattactaaaatataatgtggataataaaaaaattagcagagaagcctatcatgttctaagattagaataaatattgtaaaaatatcaatgaaattatacttatacatgcacaagtaatgtaatctaaaaagtttaataattttggaacttgatatcaggaagatagtcaaagtactttttagaagatattgagagatgaagttcatactgctaaagagttaaataaaatataactctctaatagctgaaaagtaaaactgtgactataatggtcccactataatggtgagatcaatcaatgaaaccaaatggaatagaaatataaggtctgtgtgtgtgcgtgtgtgtgtgagtgagttagtgtgtgtttttttaaagcatgtgtgtagatcttctagaatattatataatacagtagatacacaattacaaaaaacatgggcacataatttttaattaactgaatttaagtgatgtattaactctttggaaatcatgatatattgtgtataaccatgttaaaataaaacgaagaaaaaataacatatatggtgttcagattttaagtgatctttgctcttcaatgatggaaagacaataagggtgtaatcatgcaaagtaagattaagtacattaatacaaaataaaaattatttgtcttagatttttgtgcggggttggaggaaacatatgagtctttttttttttaagtataacaattgctctttgtcttgtaagtggctgcaagtcatgatgcattttcatttcccctacaggctactagacaagattacacaatatgctattcccagtgctgccacccattcttgttaggctttgcatttcctatattcggtctatcatttgtgtaaagaggaatgagttgctttctccgacgtttcatagagccaggtaggcatgaagtctggcaatagaacagcagtgactgacattatccgtaactcaacttgcagacaaggattggttgatcaataaaagcattcttttgacatagatgacaatttattctttattgattgtcaaatgatgagtaatatcctgcatctggcattcttgcctcttatacattatcctgtgactccatttctgttgttgactgattcttgactataattataggtttctttccttattcaaagtgggtagtatagcattttttccactttatctgcatactaactgtttaaatttgatttatatcacctgactcaatttttctttcacaggtttctcataaaatgatgcttgcaatgaaatcactgataacaaaatagatttatctaatttgctcttgcccgtagcacatacggcaatatctccaagagcactgcagttaaccttgctccttggagtcttgaagagctattttaggtgtgcttactatgtacatgtccctttctgctttgccttcgttttgttctaaatgcctcacggtgcctgtagaaggtttgttaccactctctctgctgattgcctgtgcaggcatctccaaatacaaaggaggtaacactaaatatcactacctttaagaactgtactgccttccccaaactgacccctgaggttactgcattcttcagtttgatagattaactcttctgcctgatgattgctgcctttagtaagcaaggacacacacacgcacaggtgtagaatcttttaacaatctctctcggagcttttcattaaaaaataataaataaataaaaagctccttcattctctgcctgcagacgcttgttttccctttgggatcaggagcttctgcacgatcaaatcttagtgacacacgatttagtcagaattgcctctttctacagaagactgaggctttgctattgcaccatgcttagcatggtgtcaatcttctattttggaccatgtgtcaaatcttctatttctcagttttctccaagggtaatctaataaacccatatggaaataagctcacaagaatctctactttatctaattaactattctcgggtatctctgatagaatttacactgaaattggaaccctagtcatacttatcttcttgaaacaatgttttgcttttaatagacaatacgttgttgctgtgggaaagtgaaatgcatataaaagaaataaggaaatacatgcaaccccgtgtctcagaaataactggtaactttgtgttagttaatatttgatgagtaaatataaaaacgtagttatatgcagcaagacagatattatttacatggatagtactgtatgttaataaataaatggaagtatacgttttgtattgtgttttaaccggtattttccagttaacattgtaacatgagagctattctgttaataaatatcatttcacatttttattactaagagtgctcttagtaagaataattataatattaatcatagctaacatctgatgtttgtatatgctaccagactgtatttcatatgctttatatacaccagctcatgcctttgtctcaacctccctatgagttacacacatcctattagtattaccactctagagatataaaataagaatttgggactttctggtagtacacaatagttcttagatagcaagtgttcattcacagaagaaaaaaatagaaaagctcaacaaaatatgacacttgggcctactaatcattaaaaacaaaaaataaaataagaatggcctatcttcaattcatccacagtattttcaaattaaaaatgttaattttgtttagtgattgaatgtgagattgaagttatccttgcataatgatggtgaatatgtaagttactgcagcaatttggggctacaaatcaaaatttaatttatagaaatttatacataatatatttggacaagtgtccaatgtttgatgccatagaatttgcatcccatcacttttcatcagagtgttaactttagaaacaaggtaaatgtcttgtagttgtacaagttaaatgtcttgtaattgtacaattgttatataaattatgttacattcatatacttgactattgcaaaattagtataaatatatttgattatgttgataggtagaaatgactattgttgagtggtaagactatcacattattctactttttccttgatgcatttgtatctaactctttagacaaaagaatgaaaagttagtaaggaggggaaaagatatttaatttaaaaaaaaatcataatttacccttccaaaaatttttatatgaaatgacctcatctactagtgtcattatttaaattaaaatatattttaaatgatttttaaattttatgtgaagctttgcaatgtatatttaaatttttctctaaaaattggtaaacagtttatcacaatacttttagaaatatttctcctttcatcattatctaatgatgtatcctagattgtatattacatgttttatgctctcttcctgggttgtatattgttttcctctcaattaactgtcatattgcctcagttttacagtattttaactaattccttaaattacaatttcaaatgatttcttgctggtaaaatgccaggttttctattcattattaagtttttatttctaatattgaaaatcatattccatgctttaattacaggaagtaatttgttacatttgtcgggtaacttgacaatttacaaagcatatgcctatacaccatcctacaatctgataaaaacactgtcaatgaagtgctatcattatgattctttaacagatgagcaaactgaggttcactgaggttatcaccagctgaagaaattattacattgtgaagatggattcatatctaattcctgtatttcattgaacctcagaggccattgactgtaagatataccattattttatgcatcaaaaaatgaaaacattgttaattaaatcatgaaagagtttattcagatcactttaaccctatattttaatcttattgaaaaaacaatctgtggattattttacatgttgatttttgtcatatattgtgctgctctagcttgaggtctttctacatgcaaactaatttatgtaaatgttgagtgtttataatgcttacaattttttttttaaaagtgaaaggaagatcattagagaagtaaagaaacaaaagaatggctgttccattggcatagcattcccaagggctgtgggttgacttatctttatatttttgaatatattttaaacaataaaactctctgtctcttgctatctctctctatatatgtgtgtatatatatatatatatattacatcatatatatgcataaacttatatatgtaattatatgaaactaacaaagtagataatttaaacaatggtgttgtgaacagctatgagcacatttgcacatacataaggaattaagataacattatattattgatttgcaaattctgggtttcagttggtattgattgtaaggctaattaagggtaataaaatgtgaaaaaagagcacatctttgagtcaatgggataaactgtttttaagctttcgtctctaggtcaaaggtatatactagcatcattcagtctctcatgaacaaaactgaaaaataaagataaaaagcttagtaacgttagttttttttagcacctttgactttcagtagttgtgtaggattaacaaatatttaagtatctaacatttgccaaagtctataatggattcgaagctcccagaaatgttttttttttttgtttgcttttttttttttcctgaaaagtcacaagcattatgccacattatttttcaaaaacataacataaatccttaaacctacaaaaaggtcgtttaaaaacatctgacactggccgggtgcggtggctcacgcctgtaatcccagcactttgggaggccgaggtgagcggatcacgaggtcaggagttccagaccatttcggtcaacataatgaaatcctgtctgtactaaaatacaaaaaattatcggggtgtggtgacacgtgcctgtggtcccagctactggggaggctgaggcaggagaatcgcctgaacccgggaggcggtggctgcagtgagccgagattactccactgcactccaacctgggtgacagagtgagactccgtctcaaaaaaaaaaaaaaaaactgacacttatctccactgtattatgtaatccaatgttttcatttattctcaatctaattttctatccgattggtgtgttgcaacgatttcaattcagttcccttgatcatgtctggcaatgtcccaccttttgcccattttcacaatggtttctctttacccagaatatactttaccttcatttaaaaaaaaaaatctgactttctacctattatccaagtcatatttttgttagtgttatatttagctaccccactggatatgatgtctgtgagagggttcctaacacatattgtcaattttgcaaattggtatttatagttttgtatatgaatattttaatgtgtttaaatagcaagaatagaattaaagtttcagtcttttaatggctttgtgtcttgggtctttggctttcagaagtgtttcttcccctcagccagtggttagtttcttcacaccgatgtgttttcattttcctggctacagcgtttccaatctatttccttcatgccttgtaccctatttactatattctctcccatctttgatgagacaagaaggctggaggggactgcactaatgagaaatttcttttccaagctggaataaggcaaattcctttcccctggagggttgatctttataaagaaagatctgggtatttttcagtctcctattcccctctttctgtaggagccataactgtatctttctccagtgttcaccacaataacatgatctaattcctggcaggaaagcccaccaaaaactaccctctcttgaaaacgcaaacaaacaaaactcacactagccacctataatttattaaatttactaattaagtgttacttctatatgactccaggagtttctatctgagttaaacagatctctattgatgtatcttgctggatgtgactacttctgtcaatgtggaaatttggcctctgaactaaggtctctaatgggtcctagaaaatgtttattttcagttcatttttagtttgtccagatttttattgtggggagtggactttttacatgtgagactcttttacatgtgagaagtctttactgagagctgaaaccagaagtctcaggtgacatttatttatttatttatttatttatttttgagacagagtcttgctctgtcaccctggccggactacagtggtgtgatcacagctcactgcagccttgatcttccagactcaaaagatcctcctgcctcagtctccctagtaactgggactagaggcatatgcccaggatggtcttgaactcctgagctcgaatgatcctcctgccttggcctccccaagtgctgggattacatgcatgagccaccacacttggccctcaaataacttttaatggcataataaaatcttcctgataaattttttaatgaaaataagacaagatattaaatttcccatgaagatggcttcactcccattcaaataaaagccatgcaattaaggaaagcaatctgaaagtgagcgaaacaaagtgcaatagtggtaatatcctggtttaattttccattttctttcttgtgtattcaggtttttttttacaattatcatttatcaaataaaagcataagaaaataaacattaaaatgtttatgtataatggttttaaacaaaactaagaaaactaaagagtaaaatatgtcgtaaaagagtaggacaaagccttcattatactgcatattgtcaatatattgtcatttttacaaaattttgaaggtaagaacacaggtgatacaaggtttcagcatgtgccattggaaaacctctctagttgacactgacttgtcattcacttctagcgcaacttatttgtttattgttcatttatcatacatattcaatttgtgtgatgtactgctaccagaggacttagctgtcagatatcctcaatacagtgttaaaatggtgcaataaaagttgtataaatataattatgccacctttcttgtaaactttaattcctttctaaaggataatattgagttctagaagattagctccctatttcaatctcctttttttagttttgcattatatctcaattctcctccccaagatgaaaatgcacacaatgccacatgtaggc

SEQ ID NO: 621 - DNA, 70377 bp, Homo sapiens
tgtagcaatatctacatgtcatagattgaaaggggattaaacccttcccactgtgcctagcattgtgagatttcatccttgagagcatctagcagtgggaatgatttaagatgacagcacagcttactgttctatccttcaaatctttcccacgtccatcctgaccactgtaacagtgtgtctggtatattgcattccactgtggttgaaagatgcatccggggtctgtagtgtatcccccttcctcatgtttccattactcagggaacattttcgaaagatgagatctgctcaattttggaatagtttccagagggatgtggcaaagtgccgcatcattttatttacttaaaattagaccagagcgaggaatcccagtgtcccactgtgagcagttttgtaccggtgggaggatagggaagagaatcatgcccatttgctgctggaatacaagaggggctcttcatcattacttcatatgactccccaattctgataattgccatttcaaatattggtcttcttatggagaacacaaattatatttttttctaagtttcttcctttctgctcctacttctcacctagcattatcatactgtcttcactaatctaagttccagttgaattgtagagcacttaatggaaaaacaataactttacaaactaatgtcctgttccccaagttctaagaagccaactacagattgtatttgttaaagatttaaaatgtaccctcattgcaaatggatgtatttgtcagcttgggctgtcataaaaagtactatagactgggagatttaaaccattgaaaatttactttcttacagttctggaggctggaagtctaagatcagagtgccagcatggtcatgtttaggcaagaactctcttcctggcttgcagatgaacaccttctgactatgtcttcccatagcagagggagaaagatctgtttctcttctcagaggctactttcttgttggattagggtttcaccctatggcctcatttaaccttaattacctcctaaagaccctatccccagatacagtcacactgaaagttagggcttcaacatttgatagggtgggaagggctggggagggcacacaattccatctatagcactgagatttccaatgcctaaaacatttaatttttcaatcctcagagatggatctcaaaaaagaaatcaaaactggctcagatttcccaaggatttccatatctatatactagaagataattcagacttatgcatctgagaagggtaagttcagtgatctggtttgttcttttcatgtgcccatttatggattggaaaaaattcaacctttggggagaacagattgagttctaatcctggtcatattactaatttgatttatgacctcagctttttccatctgtaaaatgaatccttctctttagattccttcccactctgatagttcagaaatctgagaactatggattggcattagtattcatttgggcatagacactctgattatcaaaattcaaagaatgctccaatccccaagggtctacatttttattggcctcatgaccaagacactggaactgagaggacctgagtagcacgttggaatcagactttcagggcagaggtggaagacagacaatacaccacagtctagaagtgacattgggggccaacaggtagaaagattcatgggccaaaaggggcagttcctggagtgctcttcctgcctgctggtttacatcttgtggggtcactgggatagaggagacaacagagtgatttatagtctagaagtttggtgaaggatagaataataatagttgatgcttaactaacaggtattttctaaatgctagatattttataagtactttatttttattatatttaatattaaattctgaccatagagcttgaagtaagtaccatttttatccgtacatttcggaaaaaggaaaatagcactttaaagaaattaaacaagttgtccaaaatcacatagccaagaggagcagagctcagattcagttgacctttgatctcccaattcctattccactctgccataccaggaaaactgagtctcagtaacggggcccatgttttctccactatgcggtgttccaagatagcggcaattaatacgactttttacctccagcatttataccttctaaaaaattcttgaatgtagaaaaacacagagtgatagcaaactccaaatgaagattctcaaattcaatcagaataggggcatcttcatggaagaaaaaaagtggagaatgagacccaaagactaagcatgagttataaaagtgtctatgggagaaccacagtgaaagaagagaaggatgaaatattccaggcaccaagaaggtgcttataccaaaagctatcggtctccccctctcagtaactccaagatcccaaacagctatacttgctaaatgtgtgtaatgtacactattgtgtacccaaaaaccactatttgggtagtggttacaataaaaatccagacttcaccactgtgtagtatatccttgtagcaaaactgcacttgtgccacttaaatttatataaataaatagataaataaatatattctgaataccataacacttatctgtatcatagccttctcatcatattctaatcacatgtttattcgtctgtgtttacagacagtgaattccttgaaaacatggtcctcgtatttcttatctttctgtcccttgtaccaagtgtaaaataaatgtccaatgcttattgaatgttcaatgcttgttgaatcactaaataaattaaggactcctgacttcacccctgactagctatttgtcttggatttactatttaatcttgtccaatcaatgtttccttgccactgcataagtagcatgtagctctgctaggcattagaggagtgataaggcaaaatgcatggtttccagagtatcagcatgtgttggggatggcagacaagtatgcaagtaagtgagttccagtgtgtccatatgtaaaaatgaagatgagaaaacaacttcttgctacctcacaggatgataggggtgtgtaataaaataatgagtgaaaaaatgtattagaagttacaaagtatcatttatatccaagttaatagctatgattttgtggaagttttgctcagtattacaacttttctggatttgggatcattgaataacatatagaaaccttgctgtaggtgcttatagaggaggcttaggctgaaatttgagtaactattaatatatttttatgctattgccttttgtacttaagaccttatgtttatgtggcttcaagaatggtttacttattctctagttttataactttaataattcagtacttggaaagattagggattgaggcttcattctcttacagtatcatagtatgcaacctttcatgtaaaaataaggtggcataaatcaatatgcatgtatatgtacatttgttcaaaaagaaatacaggaaggtaaaccagacactaacaagatggattgcctgcagagagtgggtaggaaagaataagggaatggaaattggttggaaggaataaaggatgagtggtacctccttgagtatatgtctttgtaaagctttgacttttgaaagagtgatagtatatcacataccaaataaataaataccaaccaatcaaatagacagacaaaatcaacggagaattgggaaggaggtaaactttaagcagaatacaaacattaacaaatgaactaactctacaaaaaatagatgaaatcattttactgaagggagtgggaaagttaaggactaacctaagtaatactggaaaacaggatttcgactacaaattgcaaagctaacaacaaaaataactgtacatggaattttactctagttaataagtttgttttccataacgttagtaatcctggaatgactttaaatgcattctaagatagcaaataaataaacttgctatcaaatcatggataatgaaagccagttttctcatttttgaagaaaggaatcataattaaaggttgaaggctagaatgaactgtgtaatgttggatttgaatcagaggtattacaataaattaatatatgtatgtgtgtatatatttatatatgtatatattatatgcattatatacaatatatgtatatattaatatatgtatgtgtgtatatatttatatacacacattcatatgcacacacacataaatcacatttgtgtatatatacggttaaattgatgtagatgtgtgtgtgtgcatacttatttttttttcatttttgtctgctgagagggcctagaagtaataatactgtagtacagcaattataatgagcacacctaaagtttcaaaatagtttctaaatactatttttaaaataaataaaaaggaaaaatgaattcatttaagtactggattatttcagtgctagtacagggaaatgcaagataagcctgggactacttatggtgccaagaaataagagaatactccaaaaatgatggggcatgtaaaaagaatgtagcagttaacctgaagaagctttcactggtaaattttatgacaccataagcaacaaaataagtactaataaaacagcctgtgttgttttatattgatataaataaataagtaaatgagggagagtgaaagctcttttcctcagcagaattccaacttatatatgaagaaagatagatggacttcatcacttagcaaatactacagaaataggtgttgcaggcaagatttatcaatgaaaactaaaattagtgggtaaaggtatgatgagaaacaagatttttgcatgcaaacatatttatagaaagtacctccctataaggtacttattaaatacatgggagaagatagtaactttacattggtaaaccaagcagaaaccacttcagtcaatggtgaactttaatatggccagccatgaaatacatggacattgtttaccttctaatatgatgcactaagaagaacacagcataatttttatgatattcttgccaaaaaatgcattatccaaatttaaatatgaaggaagagcagatggtagacattctaccaaataatggagctgtattcttcaaatgtcatagtcatacacaaaaagtttataaaataaaaattaaaaaagtctgaggacctgccccagtttggagaagaccgaggaaaaggggcactgaaaagtaacctgtaatccaggattaaatcctgggtctgacaaaggacgccagtgggacaatgggcaaacgtcacatcaggtttgcaggttagttactagaactgcacccatgtccatttcatagtttgataattataccaaggttataaaacatcaggaaatgcttggtgaaaggtaaacagaaacattgtgtactattttttctactttatcgtaaatttaatgttttctcaaattaaaaagtaaaaataaaataaaagctttattcctgcaattaggtctgtgatgttagaaacaaggtggtcacgatatgagatctgttgccagaatccggagtatcttgatatcctgtataattcagtggaattttctgtctgacttcttcagaatcccagtgtcaaaaaatttatattcagaatctttgggtaataaaaatggcagaacaccaacccacactgtgccaggtgctgtgttgggcgctatatttacatctctgtgtcactcattattttgcatcatgtcattttcctgtcctctactacatacaattttaattctgttttatagaaagagcaggtccaaaccagtccaatcctctttctgaatacggagagcaaacagcttaattggaaattgctgtttttcttctccctaagatggtaaaaatcattttccatttctttagtcagttgagagtcactgccctccaggaaatgaggaacgtttccctggactttatttttttgtgtgctataaaatgattacaattttgtttcattttagggttgaggtagggatgtcagaggagaaatgcattagggcaagggagtaaataatatacaaacctataagatgctttgaaagattgccaggaatgtggtgaataattgatgatgatctgatgcattcggttatttcctatgaaatggtccttataccaaaatgaattgcaagctatttccttctctttcacacatacacacacacacacacatgcacacacacatgcgcgcacacacacacgagtctatttcttgagctcctttcaaagttaacagactgatcgtatcgttgttcattcagagtgtccagaaagtcagagccattcaccatctctcttattcccaagcttttgtcataacgttggcacacactgacttgcatgcaatcttatgcacctggtccctctgctccaggacgggctgaactgctgcctcctgtagaactttcctgctctgacccgagcatgatctgcccaacaaaacaaatctgctctatcatcagtacctacctgtgaacagtagcccacatgtcttgacctgtcatagaaagctttctgagatctggcttctgacctctttttcactggatgctacaaaaacccttagtatcgttcctttttaacttttatcttaagttcaggggtacaagtgcaggtttgttacacaggtaaacttatgggggtttgctgttaaattgatatttattctctgcgattttattccctgatgtttctcgccaccctgcctttattcacatagtctctccacttggaataaatatcctttgtcctcatcttaacctgccaaaattctgtctctcatgcccatataagtgtgacttctttcttgaaaccctccccaatttttctaaatgagaattcatcattcccctttgtcttcaccttgcaaagttttttttccagttattctcttagtaacctgcctccagtgtcttttgcaggcagctttctctattccttgactgaaaacatctcgaaaatagggagggaatttgtattttagtgtctgttctgcttagaaatgcagaggtacaattctgaaagattgtaagtgaaaggtttaagaggaaatgttgcaatagagagagagagatagagatatgtgatacatagtttattgagatagaaaatcttctatggaacatagcataccaccatgattctggaaaaatttaaagtgctactctgtgtatgtttttacagcaatatcttacaattttttatgttattaattcttaaaaacctactgggtttggctttccttgtttttctgatgagaaaatttggagttggaccaggctcatggctggctgaagtctatccaggggcagaatgaggacttatgactacacagatttaggtgaaagtcagaacctggaaaagaatgccacagaaaaggtgtagtggggaatacaccatagtggtcttaggcatgtcctttgagttttccaggcttttctttcctgtttataggtctacagatagactttctaaggatacctgcacttagaaaggccttcttttgagaaggccttaaatatgatgagctacgtccatagtggaacatccgtttagtcaggataagaggcccccaaaaccctgaattgttagagattcattcttcttcatttgtctttttggtgtttagctttgttcatcaaaagggtgctctgttttgttagtggtcaacatataatctcttttagccagtgtttcttcatgcaagctgtggtcacaggagagtctagggcactggttaagaacatgaactatggagcaaacaacctgggtttatacttcagcttcatcccaaactagcagtacctcatgctcccaatctgcaaaatgacaacagcaatagtatttttaaagtaatggcaaaaactgctattacttttgcatcaccctaatacttatgtcatgggactgcttgagcattcatgacaccccacatgtaagtctctaagaacagtgcctctcgtaaatggtagctgtttttattcttatgccaacccctcaggctaactgggaagatcaaatgacaacagtttgtaaactttgaagtattatgctaatggaaaataaagacttagtagaactaattttattattattatttaaaactaggaaaaatgtgccctcttgttctaaaatctctctggggtcataagctaagcatcccaaagaaatatttatgccatttataggagataattttattctctctaagatattttcaagttaattttatagtagactttcaccaaaataccttttgttggaatcagtttgtagacttgtttttttaaggacttcattttaaacaccccccctcccaaagttagaaaaaaataagtaaatgtaaacaaataacacaagctacaaattacaaaagccattttcaatctgcaaagatttttaaataaaagtagatatatactctccacagaagacttctccctataaatttatattcagataataactttaggctgtaaactcaggactcagtaagaaaaactatctttttattttggaagcacacaggtgttaaataaaatggatggatgatacatgccgttcctatcacgtgcaaagtaacctgtaagagcagaatatgttaaacttttaaagcataacacctatatatgaattgaatacatatgtgcagaaaataacttgagaaatggtttaaggcagtttccaaactggtttattgtcatcgtttgcattaatatcctattctttgcttatattataaaaagggaattgttgagtggtgggcacaagggaacagtggtgggtacaaagaggctggccaatctagtacatataaaatattgatttcaacccaacactcatgtttttggacaagtttccacttacaattaactatatataaggagctagactgatgtgtatcactgaaatattcaaaatacatacagggccaggcatggtgactcacgcctgtaatcccagcactttgggaggctgaggcgagtggatcatttgaggtcaggaattcaagaccagtctgaccaacatggtgaaacccctctctactgaaaacacaaaaaattagctcagcagtagtggcgtgtgcctgtaattctagccactccagagactgaggcaggagaatcacttcagcctgggaggcagaggttgcagtgagctgagattgtgccactgcactccagtctgggcaacagagtgagaccctgtctcaaaaaataaaatagatacagaaataaatactgctgaatcacttgctaaaggtgaaattatttccccttgggggcactgggcaggaatgggaggaatgacgaatgaaaatgactgtggaattcttcatgaagtggaggtacctgactcaggccttagaaacaagatttttaaatgtaatgactgctggaaaagagatggtaagtagagctcagagcaaagagattacgtagaaggtggcgatttcaggagtatgttgcaatgacaaaaggatgaagacaaggactgtggctcaggtcattgggatgtcactggacatgatttgtttaaagactaacaagggtgaagcactgggaacggtcaggtgaagatccttgaatgtttttgagctggctttgctctatctgtcctcaagtctgtccataatcaccttcccaaggaagcaactccccaagaattttccacagatgactagttccatgtgatgctatgtaaaaagaaaaaaagaaaaaaacacaccaaatttccatttcaaataaacttggaaaaattggcataagtcaaattaaacatatttcattctcaaaaaaaatgttggtaaaaagattaagggagaggcagagaaaaaacaagggaagcaagaaggaaggaacttggagtgggaaagaaagatggatagaggggccagtctgggagcataactgaaatgcagacaggtgattaaccaacactgaaaaactctggaagtttctaaaggaagtggggctattctgtctaagaaaactgagggtagaaaataaagggaaatatcctaaatcaaaagattgcttcaggttggccctattatagatatagacatactataaaccatagagtgagatagcctagaaaattactgttagacgagatcttggaggctttctagtatgaacttcttttcttcatctctccatataaacttgtccactcacttttttatgttgtttttagcagacaaggtccacttaatccattgtgcagttccttcttatttgacctctaggaagctcagagcttaatttaatgtaatactcaattgcagtaactgttacctattaggtttccattatatccatatcttcccttcttgcaaatatagccagaaaagctgcagtggctcaagggctattctaggctctgtgagggctacagcaatgcttcaaagagctccaactggcaatgagaaatacatattttccacattgattcattcaataactcctggagttattgaatgtccatcatatgccagaatctttgccaagaacactaacagatgtaaagaataaaaattaaagaaatactctctgttttcattatcttaataatgtgttaatgtgcacttattgagaatacattttataaatatgcaaagtatctcaaaaattggttacagcgagtgttcaaacagatatgacattttcattgcaggtcctctgagatgtttgtggtatcgattcatatatcgattcataaaatctcagtcatgaaaagacacaaatctaagtttgtaagatctatgtgggtataaatggaaaccctttaaaatgttgggacttatccattgtaatttatctgattagtcttcctgccagatctttttaaccgaatcacattagatttgggataattacccaaggacatttatactattttgaaggttaattccaacctcactcattcagcatatgtttggagtgtccttgcctaatgccaagtcctgggctaggcaaaaggacctggagattgtttcttagtttcctcattgagggattctgattaagagccctctgccaatcactactgtaaatatattatctaagtgctcagcagagaaaattcatgtcccaattttctgattgagtaaccaccatgaccaatctctgggcagagccaccaggaaataactgctatttagcctcacatgtctttgttgagctttgtgcctccacgataggaggattatacaaggaagtaaaagataaattgacaatacgtaatataaacacattcttttcagaatggagcaaactacatgagatgggaaacatggcaagtggttcacagaaaccagtgaataagatttaggatgggcatttgacattctctaacaagttttggtcctgacttttggccaaattagtctgtcaacagcatctacttggtgtccacaatgtacagtggcttgcatttggtactgaagatggaaaaaataagaaaaggtcagagacatttttagatacaactccagagggcaccattcacaaagattgcagtataaatggcaccctctaaaatcgtgcgatccacaatctttacaatgatgtaaactgaaactaggaaatatttcacacttctgtgtttttatatattcataggaagggcttaatcaggtaaaaataaaaagccatgaacaaaaaaaatgttgatgagagaaaataggaaattgtagagctgaggtttagaagcaaggacaatgagttgagatttttcaggctccaattcaaatccagacttcagagcaacgttaggaacccatgatgaagactgatgggaaaacagagccaattagagggtgagactgagattagaaacttttatttaagatttgtcagtagaaagttgatagctggaaagatgagatgggacaattttctaatggaaatagatcatagaattagaatagacacaagagaaatataggattagaccttggcaaacctctacttaaggaaaaggattaaggtaggagaacctagagaagaagctggaagcttgtgcattcatccccagtgtcactgggtgaatcgcagtggcatatcacagaccacaaagattgtcaaatccacaaagactctgcggatttcagaattgttgtttggcaaagtctggtttgccatataaggacacagattgtcatttttcacaaattccaaccttctgtttctcaagatatgcctcaagtgcattcgtcaattccatcaaggacatttcctggtggtgaggaaactttaaatcccacaaattcttaagaattctttttttaaataatagtagtatttagatagtaaaagaggttaaattaccccattgttttatattcagggggagctgtatttcatattcagggggagactcaacaaacatcctctgaaattcaatagataggcagaaattaacagacattccttccattctgtgggtgtttaatccatccctgacaatgtgacagtgctagagactgcaataaattggtgaacaaagctgacacaaacctttcttggaaaattgatattctaacaggagaaacacacacatacacaaaagtaacaataaagacagcaaagaagtgcacacataaaagtgttctgtgaacaggagataaaagagggaattataggggaccacgatttagatagggtagtaatggaaagccattctgagatgatattttagtagggacctcaaaggtaagaaagtgcaacctcatgaagaggctgaagaaggaatattttaagtaaacagaatggcattggcaaaggctttgagggtggcataaactagacaagtttaaggaggtggctagaagaggaaaagagtggaaagaattaccatgggaggagttgggagctgggttattgcctcatgtgaagaacgattaaggtaagcaacagtggagtagaaatcacctttgaattactgtcatcaccatccaggagctgctgggctaagttcgtggcaatcagtgagagagagagagatggatgaatccaatgataggcatgaagacaatttacagggcttgtttatggatcagtgcatagagccaaagacggaagaattttagggatgattcccagatttttatttgagaaacaggacggatgatggagccatttactaagaggaagataatgaggtagtgccaagtttcgggaggaaaatctagttttattttaaatgtgctaaacttgaaatatctgtgaatgatgtagtcaaagacaagaatagcaaaatttgaaagcaaaaagtaattctttttcctgtagtaaaaaaaaaaatggataggactctcaacaaagtgaacaaaaatgtgttcagatcatttatttgcttaagcttttcaatggccctgtttttcctcctgtctaaggatcctgacacttggctgggtattcaaggctctctgtggtttgtccacaaccacttcccctacttatcccacactgcaacacaacagacagtccctcattttataaagtattcatttccaaaattagggaatacctttttccctccttctcaggtacatgtgatctaaatggagtggtattataagaaagaagggagtgaaaaacaaagtattgttttttctaatccatgaatcattggtttatggaccaaggctattgtattaaggctgattttgaaaagtaaaacataaatacttgctaatcccctattttttattcatttgtttccttctctgcctcagctaaccagctcactgcattaactcacttggaaaggggaagaattggctaccaaataagcccactgctggataggtatgagttaaactctcagaacccttagccctcagaccttctctaagaggcagaaatggggtttttgatgttaatagaaatatactcactgtgtttcactgggacaatgacctcgaaaactcattggctgaattgcctataatatgttgggcaggtacttggcactctaaggggaagtaataacaagggaggtgcattcttctttctcagagaacttgtagtatctgggaatacaaggttggaagctgtcagtcccaggaataaagggcatttaaattgttatcagaaataagatgatggagagagaacctttagatgagaataatatgaagagctttatggaagaggatctgtttgaactgggccttaaattatggatatgatttcaacaacatggaaagaaagatatttcaggaggaaagtagactggaacagaggctggaagatcaagtatgtgcttgtcaaactagaagtagttcactaagcatggaaagtaaaatctgaagtagaaggtaaggatgaaaaaaaattggttgagtccagaagttagaaaaacttgttggttgcttcttccgtatctaatccaccaacctccacaattctgagcctgaaagatttgatgggattagctccactatcagttctatagaagggggtcctgattagattgaatttatccttgtatcccattctcatattcaaaaggattaatccagagatattagctggtggggggtaaaagaagatactcttctatgggttttgagcaagccaacctctttatcttcaatgcatactataggatattactctctttctcttgctggatgtagacatggaaatctgaagttctaggaccagaggaaaagtaaataataaaaataatctggcactgagtaagcaaggctaaaaattaaaaaggagaagaactgagtcctgacaacattttcttttgagccagtggattaaagcttacatgagagtattgctatttctggacttttaagttccatgagccaataaatccccattatgttttaagtcaatttgactagtatttgctattacttgccattcaaagcatcttgatacagaatccttgaaaagtacattaaactttgttggcaataagagatctactgatatttgtgtctcccagagtgccataatctggaaagtaatccttatggtagtgcacaatgcagaacaccattaagtcaggatagtccaaaacagagtccatgaaagtcagccagtcttttaatttgcgattagtcttattttgttctcattccatgcctagtcattcgacttctctctttgtctcccagaagaggaaaggaagtaattctacttatgtctttccttgagaagaactacctcccttgggcttggagcctgacactgtttttctctctcccactgactccatagatgtattcatttctctttaggtatttaatataaaccagataagccacaaacttataataacttgagtcaatttcaattctaaggcaagttgaatctttagggccaatgcttcaagtacaagatactgtgatttcaatgacaatgaaactgtttggggaattgctttcccaaacttttctaccagtgtttagattatagcatgcagtccaggagtatattatgagtgatcctcttgaactttgtcagaaagtcctcataaatcacattcaagaaaatatatttaacttccatatacatatatatgaaatttaagaacttggacaagtggaataaattccaaactgtcagtttatagcagtaactttctttttcaatttggagattgaaatttggggtgagaaggctctaatggaaatagcatgttctctgagaaaccagaggtgctgcttgacttctggaatactttatatggaatgataccttattttggaattttagaaagcctgagttatgggcccaggtatttgtgggattccaccatatcccagctgctaaaccttagccttttcatcaatgaaatgggtttaacatttccattttatggtagaccataaaaggaaaatattcctgaataaataaaataatatttacaatttattgtgctgttactatgcttcaggggctgtgtaatagacattagtatttatcatttatttagctcttaatatttataaggtactaagtattcatactcacccattcaaataatgtaagtaccaatattatcattttctagataaaaaagttgaggcacaaaaatatgaggaatttacctaaggtcacacaggcaaaatatgtgaaagcagagaatcagaggggggcagtctgatttttacagaacctgttactcttccttttcctagtagcactgagagctgggtactgggaatatcattttatcagatgagaaaactaagactctttttgttttgtgctacaataacagaataccgcagactgggcgatttatgaagaacagaaatgtattttctcacagttctggaggctggcaagtctaagatcaaggcatccatatctgatgaaggccttgttgctgtgtcctcacatggtagaaggcagaaggggaagagggagatcaatcctgtgtcttcacatggccgaagagagcgagagagtaaagccattcctgcaagcgtttttacagtggcattaatcccttcatgaggtggtatggtttggctgtgtccccacccaaatctcatcttgaattgtagcttgcagaatcccatgtgtcatggaagggacctggtgggaggtaactgaattatgggggtgggtttttcccatgctgttctcatgatagtgaataagtctcatgagatttgatgattttataaaaggcacttccccgcacaagctctcttgcctgctgccatgtaagatgtgactttgctccactctggcctttcaccatgattgtgaggcctccccagacatgtggaactgtgagtccattaaacctcttttttttcttttaaatagatttcacagtcttaggtattccttcatagcagtatgaaaatagactaatacatgaggaaagagcatttatgacctatacatcttccatgaggccacatctcccaaaactgcttcattggggattaatttcaacatgagttttggaaggcacaaaaatattcaaaccatagctcttacagactatatagaactttctcaagttcactcagctctttggtcacagtatttagacttaaaacttaactccaacattctttttatctttcagtttatgtactgtgatattttccttatatacccactctcttcatttcaaaattttccattttgtgttttcttcaaattaaattctcaccttcctccttctgagctagatttgagtagcatacaagaggtcaaatagacaaattactgatcactaggtgtgttttaaacccatgttacttttaaggaaactgctggaagaactttatatgaactcttgttatattgactcaattgaatattagtttaaaaaacataatctgtaatttcattttgaagtttactatactttatatttttaaactacattcatgaccagattgttgtcttaaaatcattaacacattattatgttcccctaatgcatgccatgcttattcatttcaaactcaaattttaatcaggattagggagtttgagttctcattctttattattggtaagtttcacagccatatatgtagaaatattctgttgtttttttatggccaagtttgtagattcttctaaaattctcttttctctaagacagaaaatgtagaatattagaatttccagtttttgtatcactggctgccacctcaatcaacttacacagccccatccccgtatatattgttcaacaggcaagatgttaagcaatgtagcatagtggtttgactacactagctaaataaaatgttctattatagaaccaccaaaatgcaaaaaagaaattggccaggttaaaatgagaacaagctatagaaagcaattgaattcagaatcatgagaattagaaggcctgctattatgaaactcctctgcattagatgctcacattggcttatgttgtagcttgcaatgatattccaaatctctcatctcctttaatttatataagcactctgtgagacaggtattcttttttaaattttccaaaagggaggatcagagacatgacaaaatttcccaaggttctgtagttagaaagtcattgggctacgatataaatccaattctgattccagcatccaagcacaactcattatactaactgacatggatattatcagtagataaagggttaaaattccataggctttcattctgtcatctctggtcttggaatctactgggcccccaatgaatgactttgtttttctctgtttttgtccctttctattctttttacagttttcttggccacattcataagaaatgacgccaattaaaactttgcaaggccaaggctggttaatgtatcactgaccacagatttcccaggatttggccaaactctggttccttgattatttttattctgccccctcctgtctggagcccctaaggaccttctcttgccagggctctgatctctttgtcattagccttgggctccatacctagagggtgggcatcctgtttgtgtctacagctgggacaccttctacatgctgtttttatatgaacactttcaaaatacaaagccttttcattttctttactaaccccgcttttttatctcccttcatttcctagatggagggcttatctgtaggttcctcaactttctctgcctacagttaacatgtcgggcctagagtgggccacagactgacatggcctttgctctagcactctcacttagttgtgatcttgtgttctgaacttttggttctctgggtccctctctaaactatctgtttagagagaaatgggattgaatccaggtcagtttgatgccacagccagcacactttctaccacctcatgctggcatttaagctgggatttgaaatcccagtgacctgaagatttctggttgattcccaatattcatcctgctcagattctttttagcaaagacagacattttagagcaatagttagaatgtctgtttttgttcccagtgtcaatgaactggaccagttttcacagtcctcttctcagtaatgttgagctacactttgcagctgagcacattatcacccacctataagctcatttttgccatcctctttctttttctgtaactaagtgttatcatgccacgatgttctggcaaaagagatataacctgatgtagtgtatatggggtacttatccctaaaagagaagctgtgtacccatcctaacctattttttctttctgatgcttggaacagtgttttaaaggttgccactgtgcagccattttggtccatgaggttgaggtacataccccaggaatgatggaatagagaagtaaaacctcctatgtcactgatctaaacagactcatcatactaaattcatacctccatcccacagtgtgcttcataatgaagacagctgatcatctatcttcttttaaagcattgttatttatttcccttgtatacaacagaaaccaatcccaactaatatagattgagagctcattaaagagaagaacagagagagttagatgttgataaagtgaaggaaattgacatgaatagaggcaatctaatgtagctgttgtaggttatatgtgggtgagagaaaatatttcaaaagcttagattcttgcagcattatctggtatctctgtatttaaacaacttaattataatattctcctagtccatctagtcctctgtgaaagcataaggtctgtgatcaaacccttgaatttccgcttgctacctatttgacattggatgagtccatttatctctcaaagctttatttgtatacaaataaaagagtgtgaggtatcaagtgtttatcatagtaatggaacagagacggcactcaagtagtaggaattcccatgggttcagacattccctacagttccaggaacttcattgctggcttgccttaaaggagctgactgtattctgctaagaaaatctctcccttactcctgccccgttcccttccctatttggatatatagagagataagtttcaatgattttgcaaagattccattagcattaaatggagtacacatgacccaggagaattgaaactgtcagtggaaatatctaagtggaaatgttcctgtccatgaagctgttgctttagagaccttgtcagtaagagcttttgtcttaggggtttgtaaatatttatatttttaaactactatgagaggaacaacagccattccacatgaatggattacgttaaatgtacccaaagtctgtaattcaagctgtcaaacgtgaggaaataccagacttaaggctgccattccaatccactccgaataaataaggactttgggcagaactctttaacacaatggcccacagacatatggaagacgttaccagggaagatgactgaagagaaggaaaaacacattaaatgaatttgagaaatacctagtctttcctccagagtggaaaaggtttgaggcttgagggagatgattgttggcctagaaatagaaaaatagattaatattaaaccgagaattaggggtggcacgtggaggcttttcctgttgctaagacagttgtctgtttttcacttattgttttgggagtctgttgatatgacaccaatataggaaccaaagtgtgtttctaggcagactaggtgagggtatgggatttacttactgtggaggctctgtgttaagagtgtggcagaatttcctggagtatagaacacaggtgggagctgtgtttatagaactgagaaaatgcatttcagtgtgagattgaccagtgggtcatatataaatttgattcaattctacaagcgtgtactggacacctactttgtgccaggcataggcaatgaagcttgagaagcaatctgatttagtggaaagaatgtgagcttctagtccttgctctaaggctcacaagctttgcagagtaaaacaaatcacttccactttgtgcgtgtcaacttaaaatgtcagatttttctttttaataaataaatcctaggtcagatcatttggcagaagactaaatgggcttgctaatgctccctctttcactctccggtctagactggggagagttccaggtgtggtaatatgttcactcatgtttgatgcccctccttgcaatacccctacttgtgatgggatatgccagcccacagtttaaaactcaggtatggtcaaatgacttttttgtgcagtgggatgtaggcagaagtgacaagtgtataagcaggagcttttagagccagtaagaggctcagtgtatctgctttttcctcctctctgccctgatgaccaacaatggtccagatagaagctaacacatcagcctgtggcctagggtaaaaatgatataaagctgtactatgactgactctcaccaacatacagcataagtgagaaatttacacttaatgttttaagtcactgagatttgggggctctcttgttactccaacaaaacccatttacctctactcacaggataggagaaaactctagtctgaaaagtacactttcttttttttttcttatgataattataatttagtatgcatttatttatttatttatttattttttattttattattattattatactttaagttttagggtacatgtgcacaatgtggaggttagttacatatgtatacatgtgccatgctggtgtgctgcacccattcactcgtcacttagcattaggtatatctcctaaagctatccctcccccctccccctaccccacaacagtccccagagtgtgatgttccccttcctgggtccatgtgttctcattgttcagttcccacctagaagtgagaatatacggtgtttggttttttgttcttgtgatagtttactgagaatgatgatttccaattccatccatgtccctacaaaggacatgaactcatcattttttgtggctgcatagtattccatggtgtatatgtgccacattttcttaatccagtctatcattgttggacatttgggttggttccaagtctttgctattgtgaatagtgccataataaacatacgtgtgcatgtatctttatagcagcataatttatagtcctttgggtatatacccagtaatgggatggctgggtcaaatgatatttctagttctagatccctgaggaattgccacactgacttccacaatggttgaactagtttacagtcccaccaacagtgtaaaagcattcctatttctccacatcctctccagcacctgttgtttcctgactttttaatgatcaccattctaactggtgtgagatggtatctcattgtggttttgatttgcatttctctgatagccagtgatggtgagcattttttcatgtgttttttggctgcataaatgtcttcttttgagaagtgtctgtttatgtccttcacccactttttgatggggttgtttgtttttttcttgtaaatttgtttgagttcattgtagattctggatattagccctttgtcagatgagtaggttgtgaaaattttctcccattttttaggttgcctattcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttataatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatgtattaaagactgaaaagtacactttcttacctcatgatggactaagtcacagtgtgctatatccctagcagagaggggagaaataaaaaattctttgtgtttatggcctttcaatagattaactctacccaattaagaaatgtagcccaaactttgtcacctagcaattggtttactcactcctcctctatgggaaggagagagtaaaattaggctaagaaacaagaggcagtgttactttagtggtgtctcctgtaaatgaaaataagatgtctgttacctctaatagtactgaagacctattgaccaaggaggtaacctgatcagatatcattcagaaatgtctctcttgatacactttggaggataaactggagtaaatatagctgcagcaagattgaccaagtaggaggaagtaaaataatgaggacaaatgaatgaagagggtgcacttaataaagacaattacaatagagctgaagagtgcaagcatgagaagccttttgtagaccgagtgtcagtgagagttcagatgtgtagaggaaatgtagccaaaggtgcgaatgataggactctgactgtgtcatttattcacagggaaaatttcaccaggggaatcagtttaaaatgttaactaaggcattcagttttgggatttttctttgatcttacatggaatatcagtggtcgcattggtctgtcctttaaggccatgttgatatacagatccctgggcaagatgcatcattccactggacacttgtggcctttctagtaagtttatggaagatttactggaagaccacattgtttatggtttgtgggaggtattcataggcatgttaaagaagtggagatttgaccacagttgtgcaccctgagacaggagaccactagacaaagtgccagaatagcctaaggaatttagtagacctgagttcaatttccagctctagtttggcttagagcaagttacttaaaaccaccgagtctcagttttctcacctatgaaatagagtataataataatatgtacttaaaagtgttgtgaagatcccagaatgtaatcaatgtaatgtgaccaaagcagagtaggtattccataaatgctatttccgtttcctttcccacacaccacttaaataatatggaatgagactgtgtctgaaagacaccattgaatgatatgtttgttactggtcaactcaccctttcattttgaaagtccaaaaacaatctttcatggtaaatcaaagcaattatgccatcaaagaaaagaaagggactagaaatttttggcttactattcatttaaaatagcttgagccagagggacattttccctggaggagagatgacttggttaggtttgtgcgtggggtgaggtggaggcagtggttactctttccaaatatcatctcatctgctgtggggggaaagatttgatgtgctttgtggtccagacaagagaactctggccagtagatcaaagttaccatgagacatttctcagttcaattcattgcagctaatagtcccacagtgactcttcagaggtagtcaatgctctgttactggacacatgcaatctgaggttaggataagactggtaagttaaataaggggtagagattcccatacttaatgagcacttggactagatgcaggtaaatgcaacaaatgtttaatgacagtcaagtacatgaaagaccccagccatactttgggagaggaacagattcaaacataatagagtgtctttcctcttaagtacagatagccaacctaggttctttgattctaggacagacttagtaactcagctttcccaatttcatttcagtcactgactagatattatacattgtcaaacttgtgcactatttactctgataattctacttcatgtagaattagccagccagaattttcttccaaaagaaaatggtcatgtaaacttgacttttaacagagttgcatcttcaatgttaaccatgaaattaaaggagaaaaaagtaaatgaattatgttaagacacacttaattgaaaagcagacagtttaaatcagcaaggatttatattttataaaattgggttataggcctaacttagacaataactgtatgctttcagtgattcatttccagtccatgagcctcggcatccccatctgtactatagagatgcattatttcagtgattcctttctcttctctgagcctcagtatccccatctgtactatagggatggaacttggtaattttcaagcatacctcctgcacctaaatgctatcatgatattagtaatataacaaacatgtactaagtttataccatgtgccagacaccatctgaggaaatgggaacagagaaagtaacaagacagtgaccctgtcatggaaaaattcattgtctcatggataaagtagctaataaatgcatgattgtgagatgagatataaagagttgcatgtactaggtactatgggaataaaatgagttaacaaatgattctgctttgaaggaatgagaaaggcttctttctttaatgagctagtattaaattttcacatcagaatatggggaaaatcaaggtgattctattaataagatagatttttatatattctttcactagaactgtttagaaacatgtactatagaccaggtgcattggctcacgcttgtaaccccagcactttgggaggctgagacgggtggatcacctgaggtcaggagttctagaccagcctggccaacatggtgaaaccctgtctctactaaaaaaaaatatataaaaattatctgggtgtggtggcatgctcctgtagtcccagctactcaggaggctgagtgaggagaatcacttgaacatgggaggtgaaggttgcagtgagccgggattgcgccattttactccagcctgggcaacaagagcaaaactctgtctcaaaaacaaacaaacaaacaaaaaaacaacgtactataagccagataaataaaagtcatcaaataatagttagaaataattattgagtacctactaaagaccatgcattgtgctaagcactttacatatattgactcactcactccttctgacagccgtatagtagatgacaacaactccatttaaatttacaataaggaaacaggtgcatagtatttgagttgtaattaaaatatccattcagatctagtggtagtggctaaacataaggctgtgttgagaaggattctgaagctacatttaataacaatagagggaatgacatgctcaattagtaatttgtacaacaaatattactcagctctttagatgtgcctggcattattatagatgattagaatacactggtaaacaaaagtaggcatgagtccctgcttttttattgctgatattctagaggaagatacaaggaacagcaaacataataaataagtagatcattcagcttgttagacattaaaacacgttctggaaaaacaagacaatgtagaccaaggtaagtggtctctgcaagaaggcacaggtgttgcaagtttcaatgtggtggacaatgtgtgctttgttgagaaggtggcatttcattaaacccttgaagaaggtttaagagttagcaatagcatgacaagaaaagtggaaatggtggattgtgagaaaacatggcaaaatgaaaagaaaattaatctttaaattatggacctttgtggctttaaagcttgaagaatagcattccagctaagcaaaccaagaaatatgagttacaatcttactagacctatttcaaatttaagaaagatttagaatttcaagctatgaaaaattgaaaaaaaatactttctctctgggcttgagttttctcatctgtaaaatgggcaccaaatatctaactcactgagtctgtgtgatcatttcatgtgctaaggattataaagagcctgacatggggcctgacacaaaggtggagttctgtgattcctgtcactctctctgtaaacttttctggtattaaaaggaaagaaacagtgaatggtttgctttgagtaacccaccacattgtgcaaatgtttccgaaagtgaaaaggcaccatccgtctgtttaattggattgtctcagaaatatattcaagtattgagatagctttgaatcacttatacttaagactatcagagaaatttttctctcctctgcttcattagtccaaagatgaaagtgacgtgaattggatatttctgtccccttactgtatctctctgtagatgtctattttgtggatttatgaaatatgttagagtgtagagattttttttttttttttttttttgagatggagtcttactctgtcacccaggctggagtgcagtggctcagtcttggctcactgcaacctgctcctccagggctcaagtgatcctcctgcctcagcctccccagtagctaggattacaggcatgcactaccacacccagctaatttttgtatttttagtagagacagggtttcaccatgttggccaggcttgtctcaaactcctgatctcaggtgatctacctgcctcggattcacaaagtgctgggattacaggcatgagccactgcacccggccgaagtgtagatatttttaaatttattttttatgagtgaaaaagggaaatagaaaaattggagtgcaactgaactatattatatgagaaaactttaaattaggaaaagtggatgaacgtgatttttaggctggtgatagttcacatgcccaaatataaattcaagtcactgaaagacttttttcagatacattctgggaattaggaactttggttaaaaatcattcaaataagcctcactgaagggcattgagagtagtgtttacaaaattttgctttgggtcaattctcacttaaaatacttattgtaaattcattaagacccccatatgcctggcactgtgaaagggattttaatatcccatcttgtttaagtcttaacaacaactctatgagatgggcactttatccttttcatataaagaaactgaggcgttttatatcctttctatataagaaaactgaggcatattctggtgaaatatttgttcaaggtcatagaacttctaagatgcagcatcaataagtcataccctgaatccctcttgattctatactttttctatgataccatgcttttctatattttaatcaaatagattttataagagaaattcaaagtatagatgtgcagtttatagcatacaacctaggaaactttgtggaaagaatttttataacttcacagaataattttttaagagagagaaatgtgctttcaaatgtaaaacttatctaatgcaagagctaaatttcagggcaacatttttgttttggcataacatctgaagatgacatgctatgaatgtcatacattttctacatccttatttagtattgatacagaattatagacaggtaagacaaaagaaacagagacatatctgagtagtttctggggacagaaagataggatggaaagaaaattggcctgggaggcaagagacatacattctggttctttattggtaaatagcttgatttgcatacatcttgatcatgttgctttcccctctcagatagaaaagaggtaatgttcatctcctcaatttccacactcaatcttcagtttctgcacatcttttaagattgaatgggtgttttctgctcccctcttacgggaaactccttagattggctattgagtgtagcttccctgattaggctctttcctgttgtaacactagaataaagagtgaaaaagagtccatagtcatcacctaattcatccttaatgatcggatgagagacactgaggatcacagaaggacaagctttggcttagcaaagccacatgtcaattcagtgcagagctgggaccagacccaggcccccacattccagtccagtgacctgcatttcctccaacgtgattaaatctgatgtcagacttcacagagagaagatgttttgttgttttgttctattaagttagtccagaacatataagtttttactctataatgaaaaatgatcactcttcttaaagaataattgaaatgaaaaaggcaaagtaatcacactgcatctgcagatattggcatttcagaacactgagtgcataataaaataatccttaaggaaattagttattgtctgagtacactggctgctttgacttcctcaaatgcactctcaccgatattaatattgtattgaaaatatccaaggtcttctttctttggtctgcattataatgtccaaagaaaaattagatgttttagtattatagaatacttgcaataataaacatgtaatggcctaaatcaaggaggtaagatgccagcttgccaatttatctagaattatgtttacctccagaccctgggttttcttgggagacaagcagggacattgcatgacaaatgggtatgaattcatatcatatcatatcatatcatatcatatcatatcatatcatatcatatcagtataaagaaagaagaaaagccagtggggaacgtggagagtatagtgtactgattgcttaccatggagaagtcttcatacttgccttctttatttctcacaataatcctgttatgtagtcattatttccattatcttaaaatgtgaaagatgaggctcaccaacactaagtagagaattccaggtcattagtgttcaggtgaaagagaagagtttagaactctggcactttctaaattcaaaagctatgctttcttctggttggtctgattacttccaataaagaaacagggaatgtttatgttgaaagattaaaatatcatagagggagatgcttttttttcttcaaaactcaagaccagtttataaaggagagaataaattttttccctttgcatcctcagaatactgagcaagaaatacagatggacataatagaagatatatgtataagaaagagaggccattgaaataagaagagttgcatgatatcagattggcctgcctgagaattaacatgctattccacatgcccatcaataatagactgtataaagaaaacttggtacatatatatattatcatggaatactatgcagccataaaaaggaatgagatcatgtcctttgcagggacatggacggagctggaagctgtcctcctcagcacactaatgcaggaacagaaaaccaaacaccgtatgttttcacttataagtgagagctgaatgatgagaacatttggacacattgtgggggaacaacacacactggggcctattgaggacgcagggttgtggagagcatcagaaagaacagccaatgggtgctgggcttaatacttgggtgatggtttgatctatgcatcaaactaccatggtatatatttacctatgtaacaaacctgcacatcctgcacatgtacactggaacttaaaataaaagttgattaaaacttttaaaaaatcaaataaaaatgaaaaataacaaactattcaaaagcatgggcaaggaagaaagtaatgacttcacaggtatataagaaagattgaagtcttatctgaaactttgaactggcaaatccctaggaggacatcacactctacatttctgtgatttattatttgatctgtagcactttggttaacatagaagttacattcaattcctgtaattttaggttcctaagttttgtccaaatgcatatttttgaaagaaaaaatcctctgcagtgctatattatggcttttggctgaagtcacatgcctaaaatgtgcaactgaaatatggctttatggaggagctccaagttttttcagaattatgtactatttgagaggggtcaaccgcagaactgcacatctctgcagtgtcttcaaacattctgaattgctgaggtctgcaaaaccaatttggaaacctccagaatgggaggtctttttggcttcctgtcttcaagctgctatccagcagaacaggaaccagaaacaatatgcactcgctcaaagccaccaggttggacacttgctagcattagaagaaggcaggcccaggagaactgtcaagtaggtaaaacccatctttggtgccctgaagcctccataaaaccacaagatattggagataaagagtttcagcaatttttttttcagctagtgacactaaactgaggctcagaatatagaaggaaattatttaagaagggccagtgaatttgtttccaagattagtgctacgttttaagttccttgactcattttgtgcttgaggaattagagaatttcagaatgatagagaaattgagattatgacctcactagacttcccctaatttcatattaataagtgtccatggaaaagggatttcgtggtcagtcaagtttgtgaatcagtggctactatacaagtttattgaagagccaccatgcctgttttcaaagctctgataaatcttacaaagatgctcatttgactttgtttcccaaactcacttgactgcagaataattttccttcttgccacatattgacatgctaggaaacacttggattttgcaaaatatagtttgtaaagtgttaaggttgaccattccaactggatacttggtttcacaatcaacagggtcatcacgtaaatgtccagcttgatgctttacaataatgggacacttacctgactctatttcccctatcaaactgtacgttttctgagcacatcattgtgacatgttcaccattgtgtctcccacacaagaataccagggttcaataattatgtaatcattgctcccataggtatccccattatatttttcaacaattccaataatcaaaatgccagtcctaatattcagtgccacttgccttgctacaattctggtcctcttccatactaatcttccctctatacagatgatagcccttcaagaattgaaaatgctgattatttctgtccctctgtcataagcctcaacttctccatgttaaacattcccaggttctttcactacttcttatctaatttgattttattttctctcatcattctggaaatggattccagttaaaaccatgagcttgtaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaatatacgtgtgcatgtgcagcacaccaacatggcacatgtatacatatgtaacaaacctgcacgttgtgcacatgtaccctaaaacttaaagtataataaaaaaaaccatgagattttacacaattagataaatctaggttcactttgtagctactccatttggtaaatgtatgagctttttgaaaaatgcatggcctttgtgactgtttcttacctaactcataagaagtatttatctcttaaccattgtaaaatcaacctcaaaaaactgtggtgagaaataaatgagaaagaatgtagggcctataacatattgctcaatccatgttattcaatatggcttatttagccctggcaccttcgttcccagaatctttctagttggctttatttgagcctatgttgtgaacatttgcttaaacaagaaaaaatagagtgcacaatcaagagaggtgattgttatcaatttctgaccactttcagagaatggagttccagttcttcttcatatcttacaaagttgcctttttacttctctttctgttcatgttgcctacctcatgcctttacaactgttctttgaaaacactccccaataaatacctccatgcaaatctctagttaaagtaggggagactcaacctatgatacccagaaactgcatgaagatttttgaggagggaggcatgctgaggtcttgcaactgtataggaaggagcaatgagctagccattttcatgcagtgatagaaacgtgccctaacttcatactctttttcagtgaagaagtctggagactacagacgctatgttacctgtatttaaatcagtttctatttgtgcatcaaattcttgtcttctttttgacaatattccaatttcataaatttggggctagggaaaagacataagaaggaagtatgcactagttgggatatattagaccagtcttatttttctctctgggtactaagtctgcactattacaatggatctgttaaccagatgatttctgaagggctgtgtgactctgttctgattcttagagttttgagtcttttgcccaattaataaatagttatggtacaattaccatgtgctaattccgttgcttgattttggagatgtaatagtgagcttgctagagaaagtttagaacttcatgaagattccatctaagtagtaagacatatgatgaacaatatgaaaagataatgagtaatacagaaagtccagaatgttcagggaacacaatgaaagggactcagcaaacaagaactgagaaaaatcttcacaggaaatgtcctttaaactgaggcttaaaaaatgagccacaccaacagataatgaaagagatttcagacagattaaacatcaggtgcaaaatcttaacggcttcaatatgtttgacaatttgagcaactggaagaaggtaacccctgcaaaaacattcaatctctaatggaaattataaaaatatacaatgtgcatcagaaagaagggatatcttatattttgcctcctaacctaaatactctatgtcatcatttgtgtacatgattcaacatatctgtattacctggaggcttcctagaattactgatttttgggccctaccacaaactcactgaatcagaatcttggaggtgggagtccaggaatctgtttcaatacactctctgcgtgattcttaggcacactagagactgagaatcactgttctgttattccaggagttgaaactacctttctaatatatctgattaaaatcttggcatttgagattgcattcacaaagacacagataatcaaacatctagtcctgaatatttggtacccaagggctacatattcagcactccaaatccgcttgccaactccccaaaatttctgaacaaacgatgacctcactggactctaaaatatagctctctagagggcatgatgtttacaggatttgagaatatcaattatatgacaaagacactttcctctctgcaagcagccaacaatagccctgtttctccataaatgtcactagtggggtgggtcagatatgatttggttggtgctaccacgtgaaataccttttatgtgtcattttttaaagaaatgggataatttagcatcctcctaatatcttacattagtatgctgcaacctaggcccagataagaaaaactgcccttcattgctaagagtcatgttaacacctttttagggcagtaaaggaaaagatatatgataatggaagaaagaaaaaaaaaacaatttccatagtgctttcagctgtgactaaaacccagcatatgaggcagaggcttttattgagagatcataacagacaatgcgtcataaaccccacctccatcaaggaggacaaacagtgtgtacgaaggaaagcccttgcctggtaagagacttgcttaatagacttggaaaatccttaaggtaaagaacaattcaagcaaacacatcaaatgttactgtttggtttaaggcctgaattagtgcttacaactttgctcttcttgctccattatgacggtcaaatacctaaagaaagaaacataaaaaacaggtcctaggaatcctaaaagcagggaattgtgaagtaatgaactctagataagagtgttgattagtgggaggattgagcaatttgggtcttcaagagacttacgcctgctctgagttccatgccttcttatatagcataactatataagaataagatgctctggacaactaaaatgcctctcatttagcaagccctattctcttgagaaggctgttttggttttaaatagcaaaggttttcttttttcactgtatacccataaatagttaattcttacactagtcagttacctcatgttagagcaattaatatttatgttggccttccccaaactagattggaagttttaagatatgatatggtttggctgtgtccccacccagctctcatcttgaattgtagctctcataatccccacatgtcatgggagggacctggtaggaggtaattgaatcatgggcgtgggtttttcctgtgctgttctcatgatagtgaataagtctcatgagagctgatggttttagaaaaggcatttctcttgcacgtgctctcttgcctgccaccatgtaagatgtgcctttgctccttcttcaccttctgccatgattgtgaggcctccccagccatgtggagctgtgagcctattaaaccttttttttaaaaaaataaattaccgagtctcacgtatgtccttatagccgcatgagaatgaactaatacagaaaactggtatttggagtggggtgctgctgcaaagacacctgaaaatgtgaaagcaactttggaacttggtaacatgcagaggttggaacagctcgaaaggctcagaagaagataggaaaatatatgagagtttgaaactgtctacagaattggagggctcagaagatgggaagatgtgggaaagcttggaacttcctagagactcattgaatggttttgaacaaaatgctaacagtgatatggacaataaagtccaggttgagatggtctcagatggagatgaggaacttattgggaactcaagtaaggtcactcttcctaggcaaagagactggtagcatttttctcctgccctagagatctgtagaactttgaacttgagagagatgatttagggtatctggagaaagaaatttctaagtggcaaagtgttcaagaggaagcagagcataaaaatttggaaaatttgcagaccaaggatgcagtagaaaagaaaaaccctttttctggagagaaattcaagactgcagcagaaatttgtataagtaacaattagcctaatgctaattgccaagacaatggggaaaatgtctccaggccatgtcagataccttcgtcagacttggaggcctaggagggaaaaatggtttcctgggctgggtccagggcgcccctgttgtgtgcagcctcaggatttggtgccctgcatcccagttgcttcagccatggctaaaaggggccaaggtacagcttgggccatagcttcacagggtgaaagccccaagccttggcagcttccatgtggtgttcagcctgtgggtacacagaagtcaagaattgaggtttgggaacctttgcctagatttcagaggatgtgtgaaaatacctaggatgttcaggcacaggtgtgatgcaggggtaacgccctcatggagaacctctgctaagacagtggggaaagaaaatatggggtgggaggcaccacacagagtccccactggggcactgcctagtggagctatgggaagagggcctacaccttcagaccccagaatggtagatccactgacagcttgcactgtgctcctgaaaagccacagacactcaatgccagcccatgaatgcagccaggatgggggttgtaccctgcaaagccacaggggcagagctgtgcaagaccatggggacccacctcttgcatcagcatgatctggatgtgagacataaagtcaaaggagatcattttggagttttaagattttactgcaccacaggattttggacttgcatggtgcctgaggcccctttgttttggccaatttcttccatttaaaatgggtgtatttacccaatgccagtacccccattgtatataggaagtaactaacttgcttttgattttacaggctcataggtgggagggatttgccttgtctcagattagacttcggaatgtggacttttaagttaatgctgaaataagttaagattgggggactattgggaaggcatgattggttttgaaatgagatttggaagggccagaggcagaatgatatggtttggctgtgtccccacccaaatctcatattgaattgtagctcccataatccccacatgtcatgggagggacccagtgggaggtaattgaatcacaggggcagggttttttctgtgctcttcttatggtagtgaataagtctcatgagatctgatggttttataaagggcagttcctctgcacacactctcttgcctgccaccgtgtaagaagtgcctttgctcttcctttcccttccactataattgtgaagcttccccagccatgtggaactgtgagcccattactatgaggtaagataggcttgttgtgataagtaaggtgtcgataaaatgaaaaagttcagaggagaacatattgcttttggggtaacttcatggaataagcagcattttaactgatacttgaagaatggattgggattttttcaggtaagagagctcctagagttatgactgatgcaaagagtatgtttgcttatttttttttttaaatgcactttatactggaagttatatcccgggttcctggccaagcattacagagaagaaagagtctatcttgcataattaaggtgagaggaaggccagcataaaaattcaaactgtttggaagaagtgtcagcatcaagtgttaggagtaacccagatggtgctcaagataaggaggaggtacctgcagtagaagacacattcagtgggtgtatttcaagtgaaatactgttgctatactatattactcttcctcagaacctactcttcttcagaacctcgtaaattctcagcaaaatatttaagagattaaaaatattgttgttcattattcttagtaaaatcacacaggaacagaatactgcgtgttctcacttactagtgggatctaaacgatgagaacacatggacacatagagaggaacaacacacactgggaccttttggagggtagaggctgggaggagggagaggatcaggaaaaataactaatgggtactaagcttagtatctggatgaggaataatctgtacaacaaaccctcatgacacaagtttacctatgtaacaaacctgcactcgtacccctgagcttaaaataaagttaaaaaatactgctgtgatagaatttctagtgaaagctcaggaaaagctagatgattgtgttaaggtattcatggtgtcaaagaggcaccatggaactaacacagtatattcttggtagagaattgtagaggtcccactgctaatatcttagagaaaattcccaaacataactgagccactgaataaatgaacatctacatataatggctgacgcctatgctcaatgtcagactatattcatcctgggcttttaatgtgacccaggaatcagtacttttagccaattctgcaggtgatttaatgcatcaagtgcaaccctatgtctgaatacctaagtatgggaaatacttgtgtggaggatataaacaaagtaaggaaatctggacacaggaagataaagtgacaattaaaattgagtggttctccacatggacacagggaggggaacaacacacaccagggcctgtcagggggtggggggcaaggggagggagagcattaagacaaatacctaatgcttgctgggcttaaaacctagatgacgggttgataggtacagcaaaccaccgtggcacatgtatgcctatgtaacaaacccacacattctgcacacatatactggaacttaaagtaaaataataaaaagaaatcatgacaaaaaacattaaaaaatattttggtcaggcgcagtggctcacacctgtatcccagcactttgggaggctgaggtggatggatcacgaggtcaggagatcaagaccttcctggctaacatggtgaaaccccgtctctactaaaaatacaaaaaattatccaggcctggtggcatgtgcctgtagtaccagctacttgggaggctgaggcaggagaatcacttgaacccgggaggtggagtttgcagtgagctgagatcacaccactgcactccagcctaggtgacagagcgagactctgtctcaaagaaaaaaaaaaaagaaaagattttacagaagctctaggtttacatgtgagtccaaccagactttccaaacagagcttacagtggcccagtatggtgactatctacctctaaaaataaatagataaataaataaataaaattgagaagttcatatattagttattaaaagaggaaaaaatgatgctctggattcatgttataatagcaggtttgtgtgtagataatgggctggctaaaagactgcaagtcaaatgaagcaaacaaacttttccatgtgtctaggactggccaaagacataacaaaacattgtgtgtgtgttttttgtcttttctatttctgccctcccttgggacagatagctctgggcctcgtggagttatgaatcagagtgttctgacatatgcagctaatagaacatgcattagctttaaaattaggtgctctgttctgagcacccatgatttcattcgttattctaagaatattagcctctcctaatatggaagagatgtgaaattacttacaagtttcactaactcccttatgatgaatccactacccatttagtcttttttctttctattctactgtctctgcccagaagacagatcacaaaaatggatccctcccaccctgattcatgaattactaagactactaaccacagtatttttaagtaaggagttctcagttaattactcctgtaattaaagaaaattgtgtgtgtgtgtgtatgtgtgtgtgtgtgtgtgtgtgtgtgtgtgtatttgaaatctccctccctccagggacataacctatcagattttcaagcaggccataacccatacactgtgaagtacctctgtcatgtaagaaactgcactacttggaaaactgaattcaaggactgactatgacccacaaacgtgtatgatttctggatgagactgtcactccaagtctcatagtgaatgcaaaatatccaatatatttaaagatgccaaataacgaggaatagaatataagagattcgtgtaccccataaacattcagatgcacacaaagactagagcatcatagctagatgcaaggcacattccatttgggagaaaaaagccataagcaaaagtaacttatgtatattgatgatctttgtaatggaagtatcatgttcatatgaagaaatgtactgtgctctccaattcattgatcatcgggattgccatgagtataaaaggaacactgatgtcattgatcctaatggctactgtttattgagtgtttaccatgtaaatggcatgttttaagcctcacaatcttattaggtggatattattatatccaccatgtgaatgagggagaaaaccttacacagattgggtgatcgaagaaaggtcagagtaagtgccagaaccagggttagcaattcaggggaaagaagagaagtttgcacaaaggtggctctcattaacaacaacaaaaaaaaaacagagagacagagaagagaaattggtttcattctttgtgactctagagaatggcagaaattcaatcaggaggggcaacattgtgaggctatgagtgtccagtcattagaaatattcaaatattcactttttcaaatattcacttgcccagaacattatagccaagattcctgatttctatgaagacgttagagttgtcaatttcagggatcttttcccaaacttggaaagatgtttgcatctcatgcttccatgatataaatggtctgttggctcagtaatcactgaaaaccactcagataaagaagtggacttgacccagacattggccctttggactcagatttgacagttcttcttaaattaaagcataggctgattctcttttagctccctcttgagacaagtgggggttgcaatgcctgttgctgatgtcagctataggtgatgctggtaaatgctctcagactgttcagaatttgcatgtgaaaagtggttttgctgttgacatttcatgccatgaggaaactggcctatgaacctgtgaactaatgggtagcataatgacacgttcttcatgctagaaagatcaaacaagataaaatttataaaatttcttggcacagtgtctagcacatagtaagttttcagtaaatattagttgaatccagttctgttctggtagacacaaagatatgctgcctagatacccttttaaggaagggaatgttcccaggtatggagaatacagtcaacagatggcctccaactgtcagcaacttcagggtctacgttggccacagaaaactgcctcattgagctcacatcctccctgggacagtctgcatccagagcctgggtggagcagggtataaaatctgttatttctcctaatgcagggcactctgacaagctctctgctggactggctgaaccttgtcaggcctgcatggcctttgacttctcccagtatcaatcctgtaccctccctcttcctttcagaggtattgatccctaataaacatcttgtatgctgaacttcatttcagcgtctgaacctagagaacagagcctgcaacatctgtccatatccaatagactcatatgtaaattgcaaagaatgtgagcttggatatttttctagcctttagctacctggcttagcagggactgggccagaaaacctctaaggattcatccagtgctaatgctgcacatgctttcgcttcctccatttatattctcatcactccctctaggaacctcctctgtctcttgttttcttccctgcatttccagagcttcctgtattcccagcagaaaacccttatcccactacattgccatgcagctttagcatgtctgtctttcctgtttgaccccttcagatcaaagatgctgtcttttaccttaaagtcacctgcagcacctactgcctggtttgaagtcttgaaggtattcagtaaatgagcatttagtaagcacactcatacagacactcttcagggttactctgactgaggaatacataacgaatggtactccataaccctctttccaattgtcctcttctttaagtaaacagtttcccatttcatgaagatcaatttgttttccagtgaattgctgcaggacataaacatgtctaaggactggccaagtaaatgaagacatggctttgtattttagtctactgtcaaagtcaggtggtacaataccacagcacatcattcttttccaaccaagcatgtctttttaaaaatgaaattacaattgctttgtattaatttattttattttccttgtaagaagaaaggatgagagatgccaaaagacaaaggccaatgagatagctgtcatgggacaggcaaaaggaggtagaaaagtagggaaaggtaaagaaaattatatttattaaatgcttagtacatgtcaggcaccattccaagctttttgtatacattccatttaataattacattttatagataagaaagttgaggttgagattagctaatgtttttccctgagtcctataagaatggtcacacaattggaaatagaaactcgggtattatatgtctaacaaatggatctgtctcaacaaataaatggagttggagaacttggaggtatccggcatatcaagtcatcaagggtggccagagcagattgttcaaagggtaagataagaagagtgagactgagagagagagagagagagcgcgcgcattacctgtaatagtgtaatcaatgcttattgagtagaaagtaatgggctaaacaggagaacatgtataattgcaaagcatatttcctgtccacaaagagtttctagtgtatgtttagggaggcaagacatgagtgcataaaaggagaattagctatgcaggtaaatgggataggaatgttacatcctccataataaattcagagccaagagcctgtcttaagtaggatagtcaaaaaggactgaaaggaagatctctctccacttctaattaatttggtgattaatgtgaggaatgttttgtgtcctcatcttttctttgatctcttctttcagggtcttttcctctaaccaattctccactccatagcttagcagctaaatggttccttagctgcttgaagtaaaggatgttgcttacatggctaggcaattgttatatgtctatctaataatcaaattaccactaatttaccataagagaaaaggaaaatatatccagaatgtcccatttcaaggagttgtacacattgccctaaaaattgtttacaaatttcaatttactttcatatattaatttatttgtagatatagaatttgcctataaccacatccagctgtacaccatgagtattttaagagagtgaatatattagacggtatggaagaatcttagaaataatgcttactgaaaacactactcatttcaaacaaaggctcttagcaggagaaagcctcttcattaaaaaaccagaattcaaaaaatgcaaggctattttaaagttggaggctgttctcaggaaaagccagagaaaagcccatcctatctgtgaagattttgcatatgggtgtgtaatatagacatacaggttcgattttctttgcagagaaggaatgtagcattgtgacgtttctgaaattctaaacccgaacaggggtcggtggggagacattagagtctgagcacatatgccaaaatatgctttatgaatgctaatgctgaaaggtttgcttttaaggacgtacacaggtttccctcctggccaccctgtatccggtctttcttaaaaggggctcccttggaaaataaagtcagtgatttttttttttccaatggacccaaaaagcaggaacagatgtgacacgaataacctctactttgtgcatacctcagaggaaaatgacacggcctaaagcaggggatctggctccaggccagagagaaggacaattggagtttaggcccctaatgacatggttcacctcagctcactcttttgtgcttgtgtaaaaagtgcaggtggagaaagtgagttgtgtttactcattgcaggtacaaatgaagtttctgtagaaggctgccattttccttagctctctgttatctctttttcccacatcagaatagccacactgctttatttgaccatctttcaaggcatggaagaagtgatcaagcataatgcttgaggcctgagttctagagtctgacaccctgagttggaattttggattggttctgccacgtaacaagataatttttaaaaaaattatttgccatctctgtgcctcagtttctttctctgttatatatacaggataataatatgatctacctcactgaagttttttttctgagattctatagacaaaacatgaggagcacttagaacaatgcccaaaacatagcaagtgtttaataaatgttgttataattattaagaatcactttttatttttaaaattaaacaatttaattttagattctgaaactaaacagaacatgcatatgattgttacacaggtgatattgcatgttgatgtgaactgggcacctaacgtacccattacccaaatagtgaacatggtacacaataagtaatttttccatcttcacctcctttccatcctctactttctagtattttttatatttatttggatcaattttttttcctcagcagaaagcaagtccttggagtgcagaaagcatgtcagattcaccttaatattgtgctgtctcaactctgtttcagtcgtgtgctggtaaatgtttaacaataggctctccaaaaaaggaaacctcgatttgtagtgtttgccattttctgtggtgtaaatactcccaccatgttcgttttcaagctatcaacatgacgtcaagtggctcacaaaattcctgaaaatttaatagtagtctgtcgtgaggaaatacaaaccagcttcagcacaccactcaaggcatgtgcaaagaaaagatgtgaaaaaataaacatgtgaataaatgaatgatgaaattaatgattcttatcatggattctcaatgttaagaaagccacagcatgctaccatttatagggtcttttaatactcttgtttatctctgttaaaggagtctctgaccaggaggactatttaccaaggatttctatgcaacactggttgtttgtgttgtcccaaaaaaaagtaaatcttgatccaaaagccttgagtactgtcacacattatatgtttcctgtgaaaattcataatgcacatgcatatattaatgacactgataagtcttttagtaacaaaacccacttaactatgtttatttcaacacttctcaaaatatttgaccactaaaactcttggctgggtaactagtatcatcatgaggaattaatatctctgcagaacacacaatggaaaacattgacagagctactttttcttatttatagggaaaaaaagtaaatgtctttagtaatgctgggaaaatatatttttaaaactttgaacaatgtatgccttgaatatcccccctgaaaaatggattaataaaaataatagggactatctgccaagggctgcacaattctataaggtagataaagttacctgcattatacagctgacaaaatgaggtctcaagaaatatagttgattttcttactgccacactgttgatcaaaattcaaatccagatctttctgtcacttaagctagcattctttctacaacatttaaatgagatgtcatgatgaaattatggtcatcagtttcagcttagtctttcactctacaaagcaatttcagtatgttttcttatttcaccttctctttcttccacattaactattttaaaatttctatattctctctactactccacttgcagaagattaattcacttccttttgaccaaaaatagaaatagctttagaagtatacttcctcaactatccacaaactgacttaaaaatttagttttatctgcacccatcattccacttttcctttgtttgtctaaaaacaaaacaaaacaaaaactaaaaacaatgtctctacacttgcctacatactccaggccttttttgaattttcaaattttaccctgaatccacacccctggctcattttctacctcttcctctctattgtttatactttaaaatttttacaatttttagtatgattaattttctccctatacacaaacaagaataatcctttctcttttttctttcatccctctttttcctcttcctattctctcctctctctctccttgtcagccagtttcttgaaaatcttgtctataccccctatctacatatcttcacttctcagccacttttcagatttctgcaattaggcctttgccatcactccattgaaactttttcaagatcattagtgatcttattgtgaatcactgggcacctttcaattctgcatttcattaaccattccttcttctttcaacatgctatttctttaccttcatggacagctcacttgacttgttttcttctgcttctctagtgatgtcgtctcaatctcttaaggagacttcttttcctttgtctatcctctaaatgctagtcctcctcagagattaattccaggccatctcaacagtcacactctacttgggtgacttcacctactctcatggattcatctacaacctggatgctaatgactccagatttatattcagtctagaagaacccatggcttcaagagcatatccaatttcttacttaaaattccaacttgaatgacctgcaagtatcttgaaatctaaatctactactctcagtaggttccatcacttgtgttcctttttcttttttttttttttttttttttttttgagacggagtcttgctctgtcgcccaggccggactgcggactgcagtggcgcaatcttggctcactgcaagctccgcttcccgggttcacgccattctcctgcctcagcctcccgagtagctgggactacaggcgcccgccaccgagcccggctaattttttgtatttttagtagagacggggtttcaccttgttagccaggatggtctcgatctcctgacctcatgatccacccgcctcggcctcccaaagtggtgttcctttttcaaagtaaatttcactcaggcttctaagccaaatgaaagaatgactgaataataatcctcaaattttctctatttgtcttttcttaaaactaatttattgataagcctaatttatagacaagtaatttatctaatacttccaaaatgcgttcatttctcttcaacacatcataacatactatgatccaatctttttctgcatgagcatcagtagcagcctcctctctcagtttccagtctgcacttctgtccctgtgtagtccattatgtattttagagctgcaggtatatttctaaaattaaaatctgtccctttcagtattcttcttaaaaattctccagtgctttctcttggctttttattcctacctaatcttaaagttattcaaaatatgtcagttggccgaagcacttttattccccaatcttttctattccacaactccagtacacacacacacacacacacacacacacacacacacataatctatttatcttgaccaattctcattcattctccatgtcttaagccaaatgtcatttcttcaggaaagcctctcctcttccaattcctaaggtctttcttccttatattctcatagatccccaaacttccactggcataacactcaccaagcatttttacaaaattatgctctccttcctcaatatgcttgagttatgcatttttgaaaaagtgtatgaaacctaaaaatgccatggtagagcacttcctataataaataacagcaaagtaatattttccaggattcccactgcattctggagataatgcatttatattattcttttctgtagtcatagtattcaaatagtctgtatgcatataatttgcattattcaaattcattttatgttaatacaggacaaaagaattccagttaaaatgatgatctaacacatgtgtttttctatgtttccttctgagtcaccatgaaaatgatgataatcaagttataatgtataaattcacgatgattaagggaacttgaaacaaaatgacctggaaaagagggaacaacaaatttttggaagatgaaaagcagatgaataagtagtaactatcccaacagactggaaaatcctgaaacccaactgcctttcaaaagagattctaataaaaaccaagctgacttacatcataaaatctcagaaaggctaaaaaaattgtaagtactaggtagagggctaaacacacatcctactcatgaatctgtacaaggagctagacccctagatggactatactccgtgcagtgagccaactacttctttatgaccctttcaggaggcaattttttttgtatgtgggaatacagaatgagaaatgctttaaagttggaagtctagtcaagcaaaggctaggagtaagatgccactttgaaaataagagaatataagtgaaagagaatataagtgaatattctaaatggtgaccacacccttcccacaatctcttgtcaaccaaaaggcatacagaagatggtgggcagagatatggatggtttcttctctggagattctgagtggcccaaagagacaaacagaaaatagtgattttaagaaccccagtcaaacaatgtagtcactactagatcaccatacagggagggcaacccaacagtcaacaagtcctacttatgcactagatttttgttcttcattctttaatgtaaatgaatagtcaagtatcctgggacatttgaggacaggctctaccatgaaagacaaaatctgaaatgtaaaaccataatcagaagtttataataattgtaaaataaattattacattcacaaaacaagaatatgttgctataaaatggaataatctgagaacaacaaaaaatggttattgaaaattaaaatcatgattgtgccttaaaagtattttcaaattggattaaaaaataatgttgagaaaatatctctgaaagtagaggaaatagataaatacaaggtaagtgagggaaattttattattttcgaggattgactaaaaagtccagaagtaattagtaaagctttcataaggaaggaaaagaaggctgggcacagtggctcatccctgtaatcccagtactttgggaggactaggtggacagatcactttcagccctggagttcaagaccagcctgggcaacatggtgaaatcccatctctacaaaaaatacaaaaaatagctgggcatgatgacacgcacctgtcgtcccagctactcgggaggctgagatgggagaatcacctgagctcagtaggtcgagactgcagtgagtcctgatcttgacagtgcactccagcctgagtgacagagtgaaatctggtctcaaacaaaaagaaagaaaacaaaaaaaggaaggaaaagagaagaatggagattgattggaggaaataatcatgtgtgtgcatgaatcatacaaatatgaataaatgcatgtcataggcgaatttctgaacactgaggatgttaagaagactataataattttcagggaacagacaaaaagagttcatataaaaatattgagatttatgatgttatcactgctctcaacacaacatcagacaccagaagaaaatagagtggtctttaacattgtaaaaagaaagtatttctaacaactaatttctagactgtcattcaaatttaaagataaaataaggaaaagattaaaatatgcaagaactgaaaaaatgaactttatacagaaagctcatgtgtcccaataaaattaaggattcacaatgtaaataagaaaagcatgggtttcaggaaatagcggcttgtatattggacagaagacaaaaggaatcctgaagataatgatgaagacaagttccaaggcaagagctgtttgccaaggctggagagcggttagatgggagtcagaggatggtaggctctaggagagaggtctcaagggggaaaaaccagatattaggctgatagataatgattgattgatagataggcaggcagacagacagatttttgttttgactttaaccaaaataataaaagttttatcattccggtggatatttggagggttaaggaaaaaaagaaatccctgagcaaatggattaatgaggcaattttaaaccaaaggaggggaaattaatacaaagaaagaaaaaatttatgtcatatttcatgatttagctctgaaaatatctgggttagtaatataaacactaaagtttattttaatttaaaaaacaggtaaaactatattgaaaagttacaagaaggaaaatgtatgtgcttttgtgttgatgtaaaggaatgggtcataggcacttgcaggggagcagataggtcttcatcagatattgctaacagtgggtagataacatctaaaattaagactaaaaatatactaaataatttagaaaaatagaggtgagtaccaaaagaaatatttttaaggtgttgaaaatgtatgcctcatatgaataggaatcaaaatcatatgccttataggaataggaatcagtagtggaaagggaaacaattgctatttatgttaaatctctcataatactgtttgactttttttttaaaaaaagttccatatattactctgataaacaattaaacagtgggatgggaggggcagcacatgtagatcaatgtgaatcaatgtcatgttgtctttgaattgagtgctgagctcaaaagttttgattgtgttattgtactgtataacctacataaagcctacgtatattattttgtatgcatcaaacacctaaaaaggtatttttaatacctaaaaatgtgttaaagaaaaaacaaaagtgctaaaggaaagacttgaaaacaggaaacctcatgaatgttatatgttaaagcttttggaaatggaaaatgggaaatggatttacctaagcttctcgttgagtgttgactgtagtctctaataagcttcattttctttggttaaaaataaataagtaaaatagtaaagtgcacaagtctctggtaaaccttaatggacagttaaatgtgtgatgcttttgaacaacaggtaccattgtgagacacaagaccatgaaaaccactgggtgggagaagagaggctgtaagttgcgtcttaatgatgtgcgttcttctactacaaagacttgcaaagggcagcttagggttgcatgtggctctcatcctggaagctgttgataaaaagcagtggaaaatttgtatcaacgtagatctaaacatcaattgcttattctttctaatgaacctaaaacagagcagagcttatactaacctaattgctgtctttcctgctggtctacaagctccatgaagcttgggaccttgtgtgttgttcacccttgaacactcactactatttgcctggcacattgggagaactaagtaaatggtcattgaataaatagttaaactatagttcctactgatatttttgttttgccattgattaagctgaggttctataaattatagccacatctcatacttgttcatttatctgcctctctctaaaatgatataatggcaaaagcataaggtttatagatagaagactccagtttaactcatggctctgtcctttactgactatattattttgagcaaaccaccacagctctctgaccctaaattctcccatccactaaatggtcataacaagacttttctcgtaagatggttatgaggaaggaatgagccaataaatgtacactttatagaatgtaaagtaatacataaatgtcagttgtatctgcgactgaagttctttctgatacatattttctatgaatcgtacccatttcaatcctctctctacttctttctccaaattggatttgcaagtgagaaatttaagcaccatgttagtcttcatgtatttatattaagaattgttaagataggaattgccacatttatatctgtctccttgagtcacagagcctcaaatatgtgaatcagctacattttgcccaaggtactatttgtcctaccatttttctgatgaatttacacagagttaaacagttccattacgcagttaataattaagatgtagggaattactgaatgattttttaaattacctatgttttagacaaagccatgctatgtgacattccaaataaagctcaattaaatttaaccatggaaaacaaagaaacgattatcattaaattggaattatacttatgtgtatcaatgacacctcttttagactagttaatgtcgttgcaaatataatatgttagacctttctgttaattagttataagagaatgtgatatagtagaaagagctaatgttttatgttttatgacagtatggctgaattcaaaccctgactcagccacttaatatctctgagccctagtttccttctctggacaaaaatcatagagatgcttgcaaggattaaatatattatacagaaagtgcctggttgacattcaattaatattagcaatcattgttttagagtcaagttttaaatatttgaaccctagtgctcagaaataattatctggccatgtttatatttacatactaaattgaatataaggaaaggagtggataccaggtggttctccatagaagtaattgagttgcctctgagagtatagcaggactaatagtgccagaaggagagagtggctgggctgcatctgtgtagctgtgttgcacatgatcagagagccacagatgtcagtacagtgctgagtgctttacatgtgtaacaggagcaaaaacaaagacagacagtgaatcaggagtgtctgcttgctatcctcacactgcaactctgttcaaagaagggtgcctgtcagatagaagcattttgtttttctgaaaccttagatgcctttggctatgcacgtttggtattaaaacctgagaaaagttgcagtgccctacttttagagtgcctagaactttgggagatggaaagggtgaatagaggggaaaaaagacagaaatggagaagtagatagccttatgatgcagggatctttgcacagcttttcagggaagcccccagaatcccccagtaaattctgccaaacatccatgttaaggtgttactgctatataaaggaaagtaatgcagttatagacagaggtggtaagtaaaatatcaagtctcaagggaaactaaatatcttccaatgattcatataaagatgtaccttggagatattgtgagtttggttccagaccatcagaataaagagaggtgcacaaatattttggttttccagtgcatttaaaagttatatttttttggttccatatgaactttaaagtagttttttccaattctgtgaagaaagtcattggtagcttgatggggatgacattgaatctataaattaccttgggcagtatggccattttcacgatattgattcttcctacccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcattcatgatttggctctctgtttgtctgttattggtgtataagaatgcttgtgatttttgtacgttgattttctattctgagactttgctgaagttgcttatcggcttaaggagattttgggctgagacaatggggttttctggatatacaatcatgtcatctgcaaacagggacaatttgacttcctcttttcctaattgaataccctttatttccttctcctgcctaattgccctggccagaacttccaacactatgttgaataggagtggtgagagagggcatctctgtcttgtgccagttttcaaagggaatgcttccagtttttgcccatgatattgactgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttactgattttcatatgttgaaccagccttgcatcccagggatgaagcccacttgatcatgatggataagctttttgatgtgctgctggatttggtttgccagtattttattgaggatttttgcatcaatgttcatcagggatattggtctaaaattctcttttttggttgcgtctctgccaggctttggtatcaggatgatgctggcctcataaaatgagatagggaggattccctctttttctattgattggaatagtttcagaaggaatggtaccagttcctccttgtacctctggtagaattcggctgtgaatccatctggtcctggactttttttggttggtaagctattgattattgccacaatttcagagcctgttattggtctattcagaaattcaacttcttcctggtttagtcttgggaggatgtatgtgtccaggaatttatccatttcttctagattttctagtttatttgcatagaggtgtttgtagtattctctgatggtagtttgtatttctgtgggatcggtggtgatatctcctttatcattttttattgcgtctatttgattcttctctcttttcttctttattagtcttgctagcagtctatcaattttgttgatcttttcaaaaaaccagctcctggattcattaattttttgaagggttttttatgtctctatttccttcagttttgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatactgtgtctttgttctcgttggtttcaaagaacatctttatttctgccttcatttcgttatgtatccagtagtcattcaggagcaggttgttcagtttccatgtagttgagcagttttgagggattttcttaatcctgagttctagtttgatttcactgtggtctgagagacagtttgttataatttctgttcttttacatttgctgaggagtgctttacttccaactatgtagtcaagtcaatcctaagccaaaagaacaaagccagaggcatcacgctaccagacttcaaactatactgcaaggctacagtaaccaaaacagcatggtattggtaccaaaacagagatatagaccaatggaacagaacagagccctcagaaataatgccacatatctacaactatctgatctttgacaaacctgacaaaaacaagcaatggggaaaggattccctatttaataaatggtgctgggaaaactggctagccctatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacctcatgtctaaaacaccaaaagcaatggcaacaaaagacaaaattgacaaatgggatctaattaaactaaagagcttctgcacagcaaaagaaactaccatcagagtgaacacgcaacctacaaaatgggagaaaatttttgcaacctactcatctgacaaagggctaatatccagaatccacaatgaactcaaacagatttaccagaaaaaacaaataaccccatcaaaaagtgggcgaaggatatgaacagacacttctcaaaagaagacatttatgcaaccaacagacacatgaaaaaatgctcatcatcactggccatcagagaaatgcaaatcaaaaccacaatgagataccatctcgcaccagctagaatggtgatcattaaaaagtcaggaaacaacaggtgctagagaggatgtggagaaataggaacacttttacactgttggtgggactgtaaactagttcaaccattgtggaagttagtgtggcaattcctcagggatctagaactagaaatagcatttgacccagccatcccattactgggtatatacccagaggactataaatcatgctgctataaagacacatgcacacgtatgtttattgtggcactattcacaatagcaaagacttggaaccaacccaaatgtccaacaacgatagactggattaagaaaacgtggcatatatacaccgtggaatactatgcagccataaaaaatgatgagttcatgtcctttttagggacatggatgaaactggaaaccatcattctcagcaaactatcgcaaggacaaaaaaccaaacactgcatgttctcactcataggtgggaattgaaaaatgagaacacatggacacaggaaggggaacatcacactctggggactgttgtggggtggggaggggggagggatagcattaggagatgtacctaatgctaaatgacgagttaatgggtgcagcacaccaatatggcacatgtattcatatgtaacaaacctgcacattgtgcacatgtaccctaaaacttaaagtataataataataaaatttaaaaaagttatatttacaccgcactgtagtctattaagtatgtaataggattatacctaaaaataatgtacatatcttattttaaaagtactttacctctggctaggtgtggtggctaacacctgtaatcctagcactttgggaggccaaggtgagcagattgcttgagctctggatttcaagaccagcctgggcaacatggtgagaccctgcctccattaaaaatacaaaaattacccagatgtagtggtgtgtgcctatagtcccagctacttgagtggctgaggcaagagaatcacttgaatccgggaggtggaggttgcagtgagtcgagatcatcccacttcactccagccagggtgaaaacaaacaaaaactctattgcttaaaaaaaatgctaacaatcatctgagtcttcagtaagttgttatcattttgctggtggaaggtcatgacttgatgttgatcgctgctgactgatcagggtgtggttgctgaaggttgggtggctgtggtaatttcttaaaataagataaaaatgatatttggtgcatctgttgactcataaactatttctctgtagcatgtgatgctgtttgatagcatttgactcacattagaacatcttccaaaacagtagtcagtcttcaaactctgtcatctgctttatcaactaaatttattcaatattgtaaaatccattactgtcatttcaacaatattcataccaccttcaccaagagtagattcaatctcaataaatacatttatttgctcacctataagaagaaagtccattcattgaagttttatcaaaaaattgcagcaattctggctgggtgtggtggttcacacctataatcccagcactttgggaggccaagaggcaggtggatcacttgaggccaggagttcgagaccagcctggacaacatggtgcaaccctgcctctactaatatatatatatatatatgtgtgtgtgtgtgtgtgtgtgtgtgtgtgcatatatgtatatgtgtgtatatatacacatatacatatatacacacatatatatacgcacacacatatatacatatatgtatatatacgtatatatacacacacatacatatacatatatatgtatacactcacatatatacacacatacatatgtctatacacatatacacacacacacatatgtgtgtatatatatatcaagacttgatatcaagacatatatatacacacatatgtgtgtgtgtatatatatacacacacacacacacacacacacacaaaatgttatccaggcctgatggcatgcacctgtaattccagctttctcaggctgaggcatgagaattgcttgaacccaggaagcagaggtcacagtgagcagagatcatgccactgcactccatcctgggtgacaaagtgatattctgtctaaaaaaattaaattaaattaaattgcagtaattcagtcacatcttcaggctccacttctaaggctagttctcttgctatttccaccacatctgcagttacctcctccatggaaatcttgacccctcaaagtaatctctgagatttggaatcaatgtcttccaaactcctgttaatgttgatatttttacctccttccatgaatcatggatgttcctaatggcatttagaatggtgaaacttattcagaagattttaaatttactttacccacatccatcaatggaatcactattataggagctatggccttataaaatgtatttcttaaataacaagataatagattggacaagggaaatgtacatatatgctatggaatactaccatgaaaagaatgaaagtatgtctttttcagcaacatgaatgaggttagataccattatcttaagcaaattaatacagaaacagaaaacccaatatccccaatgccacatgttctcacttataagttgaagctaaactgcatgaacacaaagatgtgatcaacagtcactggggattccagaagggggaagggaaggggaaaagttgaaaaactgcctgcctggtggcagtgcttgggaaataggattgttagaagcccaaatctcagcatcatacaatatccccatgtaacaaacctgcgtatgtactacctgaatctaaaatgtaaaaataaaataaaataaaaaagaaagttaaaattgcttcttgatccgtgggctgcagaatagatgttgtgttatcaggcataaaaataacattaatctccttttacatgtttatcagaactcttgggtgactaggtggttgttaatgtaatattttgaaaggaaactgtttttctaagcagtagatatcaatagtagccttaaaatattcagtaaactattttgtaagcagattgctgtcatccaggatttgttgttttatgtatcaggcacaggaagggtagattttgcataatttttaagggtcctatgatttttggagtggtaaatcagcagtggcttcaacttaaagtcaccagctgcattagcctctaacaagagagtcagcctgtcatgtgaagcattgaagtcaggcattgacatttctctagctatgaaacctagaacagcatcttcttacaatagaaaggctgttttgtccacattgaaaaactattgtttaacataaccacctccattaatgatcttaggccttccatgtgacttactgcttcacattgcacttttatgtgatggagatggcttcctttgcttcaactttgtgaacccaatctctgataacttcagatttttcttctgcagcttcctctcagactccatagaattgaagagagttaggacactggtctgcattaggctttggcttaagggaatgttgtagctggtttgatcttctacccagaccatcaaaattttctccacgttagcaataaggctatttaactcttttaccatttgtgtgttcactggtacttttaactttcaactccttcaataacttttgctttctattcacaatttggttaaccatttggacgagaggcatggcttttagcctggctcagctttctacatcccttctgagctgagctgcattatttttagttcttgatttaaaagtgagagacatgcgactcttccttccacttgaacacttagataacattttaaggttattaattggcctaattttaatgttgttgcaccttataagatagggaggcccgaggagagaaagagagatggaggaatggctgcttagtggatcagtcagaacacacatatgtatcaattaatttcactatgttatatagccgtggttcatgacaccctgaaacaattacaatagtaacatcaaagatcattaatcatagatcaccataacaatctaataataagaaaaatatttgaaatattgtgaaaattactaaaatgtcacacagagacacaaagtgagcacatgctattggaaaaatggagctgatagaattgcttgatgcagggttgctacaatcttttacagttgtaaaatttgtaatatatgccaagtgcattaaaacaaactcaataatataaagtacacctataaacttagggaaggactttcaactttcacaggccaatttggaggcttaaagcaattttatcagtttcatgtatgtgggttttgatcataatccccaaagacaaaaccctaaatgccataatcccaaatactgaaatcctgacacatcaaaatccctaatgtttaacatgccgaaaatcacaatcacaggatagttgcattatgttagatggaagtattacctcgttattgtctttatttacatttggtggaaaattcaaataactgatgtgatatggcaatgatgaagacatgtggctttattctagaggtgaaaatagaacctaaatcactaggcttgatatccagtgggaggtacacatgaacacaaactaaaagtccaaacaacatacagctcacagggacccaaaaacaaaaatggcttaagatcatttctttgtaaagaaactcactagaaggtgtaagaacgctcctgtaattttatttaggtgggtcagttctgtaagataagaattcctgttctcattttgttaaaaaggaagccaaaggtaagataagaaattgatttgaccaagaaaacagaaataataaatgcaaactaagaaattgaaacccagtttctcttgcattaaaaataaagactacacatctgataaacaatgcgttccttttcaaagtgtgttatatattacacaagctgctcttaaggttgtaaaaatagggtcattttgtgcataatgaaaagaattcctctggctctcactcctacccactgttgtgcaatccccagtccttcatggagtcttgtccaggtacttctggaagttgtccaggaaaagtgtactatgctctcctgaccagccttctctgccctcagttagaaactagctgggcaaactgaaaaagaaaagaataaacaacagcaaaaaacctagagacaatgaaaggcagccttaatgggacaggatgtgaatacaatgaaaatcagacccgtggataggcaaggagctgaaggtcaaaggtggaggacccagcttaggaaatatatcgtgaaacccacttgtggtaagttttgcagccaagcatcctctactggatcagagcagacactataacaatgaccatatagctataatttgccaactgttgtccaaatctagcccttgagatttttttcagctgaaataaaaataacagcagtttcccttccttattttccttttcttcttccgttccatttcctgttcataggcatcggcatgtcctgctgccaaggaaaatggatggaggtgggagtgagggcatcagtatacctggctgcccagaggtgctgattcatatgggcagtgaggagaatatacgcatgtagtggtgtggccaggggccaaggaggcagaagcagggaagaagatgaagccagtgtggttgggagattgcttacattaagcaaataagtcagatgattgagcaaatgagtaaatattttaagaataatgagagccggttttcttactactagtaaaataatttacaaatataaaaaggaagacatctagaagaacacgaaggtatttcatttgcaattagagatttttacagttttttattgctatatgataaaccatctcaaaatttagtcgtgcaaaacaactttttctgtttgcatatcctgtgggtcagggatccgggggagcacagggggcacagacagcctgctccatgacatctggggcctcagctggaaagacttccatgattcggcagacccaactgcaggggactggaatcatccagagtccttagggcagttgaatttttttgatgctagctccatatacttgtgcattctagtgaacaaagtgaaagctgcatgcctttgctaactgagtctcagtaaacatgtggcatcatttctcccatctctattggttatacatgagtcacaagtttgtctaggttcaaggaaaaatgacatcaagtcacccatcaatgagaagagtgaaaacaaatttgtgggcagccaaagggattgtcatgaattttatgtttattaggtacatttgtatatacataaatataagaattttgtgtatgtatacatggatatacacatgcacacacatatatatgtgtacacacaattttgtatatgtatatatggatatacacatgcacacacacatatatatgtgcgtacacacacacacacatacacataatttttctacctctgtccattgggaagtccttaagccatgacagagaagtggcaatgagcacgctgaatagtcaaacaaacttagcttctaaataccttcttctactaaaaggaatgacaggcccttggattaatggctgaatccaggactgaaattgtatgagaggtgcacagaatatcttgttttgctagaaaataaagaaatgctcaaagaatactgaaacatgtcaaaagaatttcagagccagttcaaaaggttcctaatcaccacagatgggaagatttgagcatcaaatcagaaagtggtagtaacatatattgacccattaaattaattaaaatccatgagtccatagtaaaataaataaataagccattaatcatatcaatgaatggggtaaaagagaaatttcttccctgtattgagatgacaactaaaaaatatagaaggaaatatagaatggaaatagaaaaaaacgccacttggcaagcatcatagttgtggttgatttaggcagaagtcatgatggctgttaggaaagtgggtggagttctgacaaaagtaagacactaaggtaatatctgagtatccacccacccctgcaaactactcatcagttataaagaagaaatgattactgtattgtggagaaatctgatcaagaacaatatgaccaggtgataaagtctgacatgaccacaagaaggatgagtcaacagcatgcatttcctgatggaactcgttgaaaaaagcacagtgtcacttctgtggtacccctctcagaacatataggactctgtagaactataaagactatatactatatgatccaattatatgacattctggaaaattcaaaactatggggatagtaaaaaaatgaggggttgtcagaggctgggggaagagagggataaataggcagagcacagagaattgttagggcaataaagctattctgtatgatactataatggtgaatacatattattacttattagtccaaacccatagaatgttcaataccaagagtaaacctaatgtaaactataaattttgagagatcatgatgtgtcaatgtaagctcatcagttacaataactaccactgatgccagttactgatagtggggaatactgtgcatgatgagggggcaggaggaatatggaaactctgtactctccactcaattttgtcatgaacctaaaactgctttaaaaaatacaatttatttaagacttttttttaaaaaaaaaaagaaggcaaggactgtgtcaggccaactttagaaatactctggttgaggtttggtctacaaaatgaatggattatactcttaaaaactatcaagaacatgaaggccaaagaatggctaaggtgctgtttcaggctgaaggagattgataaaatcgaacagctaaaagcaacacgcattcctgaataatatgcttggccagaaccgccagtgggacactgttaggatggctggtgaaatttgaatggggcatgtggattggatgcttgtactgtatcaaggttgattttctgatttggaggcttatacagtggtgatggaagagaatgcccttgcctggggtaaatacacagtggggaattgaggagtcatggaggcatatctgctgttgatctcaatggtttggaaaaagattaatgacaattgggaggtggcagagaagagcagagaagagagtaaatgtggggaatccatatgttatgggttgaattattgtccctaaattaatatgttgatgaacctaacttccagtaactcagaatgtaactcggagaggttctttagagtggtaatcgagttaatgtgaggccattggaggggaccctgatggaatatggctggtgtcctcaagagaaggggaaatttagtcctttcctctttcaaatttgtagattatttgggccaggaagacaaaataagatgaaacaaaagaagcaattatttctttatggctgtcctggcatatgtgatctttaaagtttgagatttaaagatattggttttaaaaaaaagtaagaggaaatttggacacagagacatgaacagagaaaagatgatgggaagatacacagagagaagatagccatttccaagccaagaatagaggcctgaaacaggtccttccctcacagtcctcagaaggaatcaagttggcccatgccttgctttcagactttggactagatttccatctctccagaactgtgagacagaagttatctagtttttggtattttgttacagtagccctagcaaactaagacactacataagacaaatgcagaagttcttcatattgttcttacaacttttctgtaagcttaaaatcagtggaaaatgcaatataattaataacgatgtattgtatacttgaaaattgctaaaagggtagattttaagtgttctcactgcaaaaaaataaagataagtatgtgagacaaagcatatgttaaatagctttatttagccattccacaatatgtctgtatatatgttatatatctcaaaatattattttgtacaccataaatatgtacaattttacttgtcaatttaaaaagtgataaactataattttgtatgcaacaatctattaatattttcatacgtgccatctcctttgatcttaggtacaccataatgaggtaggtgagatgggcattatgatttgatccatctcacagtacaatagtctcggaatgggttgcaaatgggtcatcacagttcacactgataaagaaaaacagatcttaaagaggtgatttctgagcctgtagttgccagtgagggaagccagtagttcacacatgttaacattttaataaagttatcaaagagagaaaagcaaaagagagactcttttagagtttagctttacaaatttccctgagccctatttccttaaagaaggttgggtacagtggctcatgcctgtaatcccagcattttgggagaagcgggcagatcacctgaggttgggagtttgagaccagcctggccaacatggtgaaaccccatctctactaaaagtacacacacgaaaaaaaattagctgggtgtggtggtgcatgcctgtaatcccagctacttgggaggctgaggcaggagaatcacctgaacccaggaggcgcaggttgcagtgagctgagattgtgccactgcactctggcctgggtgacagagcaagactccatctcaaaaaacaaacaaacaaacaaaaaaaaacaaaaaaaaaaaaacaaagacctagaggaaagaaagggaagaggagagaggaggcagagagaattgggatgcagatagaagtggatggaggcagagagaggagcagtggtgaccactgtctggttttggtgcccacctgaaaggtaataggcaggcagatgggagagaggcaaaggaagtcatcctctgctctcctcccaggcaggcatactctcttgttcctctgtcctttgacttgttcataacatctcagcaacgtcacttaccacatgggattgtcattcaagactatttgcttctctactagagcctgagattttccagactcttttgcttattagttatggaaacttgggtaaggatggcaaaaatgataccttcaaaatacagtcatacaaattcattgttttccttaagacctgctggtggctatcagtctcattcagagttaagccccaaatcattccccagacccacatggtccttcatgacctgtctacctgttaccttcctatcccagatcagctcactccagcctcctggcattccttaagagctctcagactcactgaggtgagctctaggatttgggctgtttctttgcctccagcatgcttccttccgatgttcgtaaggttgaccttacctcctgtggtctttaccgaaatgtcaccttcacaggcaaccctttctaaaatttaaataccccccacttccacatttcctactcaattattttctttagaactcattactatgtaaaatagtatagtttttactaccctgtaaaaagaatttatacaattcttgtataaattgcctatcttcctcactggagtatgtttcacaggccagatttttttttaatttactgctgtatttttaccacatagaatggtacttggcatatactaggtgctcaatcattattcattgagtggctgataggagttatttgaccatcttgtgcctcagttacattatcaaaaattataaatatcaaatgctggtgaggatataaagaaattgattactcacacattgctggtaaaatatgacacggcacaaccactctggaaaacagtttagaattttcttattaaactaaacatgtgattgccatatgattcagcaattgcactttggacatttatctctaagaatgaaaacttacgttcttgtgaaaagttgtatatgaatgttcataacagctttatttgcaatagctgaaaactaaaaacaactcaggtgccttttaggggggtaatggttaaacatactgtggtacatccatactgtggaatattactcagtaataaaaagaaatacactattgatacagcttgaatgaatctcaaagtaaaaagagctaacctctgaaggctatgtactgtatgattcaatttacataaaattctcaaaatgacaaaattaaagacatgaagaacaggttagtggttgcaagtaattagggatgaggatggtggtagagaaagaaatgtggatgcatttattaaaggacaatatagagaaataaaattttaaaaaggacaatataagggatccttgtggtcatatgaaacttctgtttcttggtagtggtggatacatgcattacacatgggataaaatcacatggaaataaatacacacagcacacatacacatgagtacatctaaaactttgaaaatttgaacatgtaggtggattgcattaatgtcgatttcctctttgtgatattgcaagatattatcattgagggaaactaggtaaagggtacacaggatctccctgtattatttcttactagtatatgtaagtctacagctatgaaataaaagtttgattagaatgatagttttttatttaattctgaaaatatgcaaagagtacttaacatgcgcatggccttttcacagcagttgtaaatattaaatgaatatacctatatatgtaaacattaaattgatgtataactatacatacatatttcatatgtatgtacatattattttataaatattatatttatatgtattaagtagatatatagacacacaggagtatatgtgtgtatgtaaagcacttggaatgctgctcagcaatataggaaacattcaatacattttagctatttttatttcaatcttccagggcgcagcctgtgttcagttaatctctgattcccagtatgcatattgtttctgatgtgcattgcaagtgtcagtcaatgtgagctgaataaataacattgctaattccttgcaccaaccttcaaagtcagtaagagtggtgctcagtgtaaagatccagagttatctagaaccatagacgggaagaaaataggtcaacctaaactgcatttctcagctttgccactaatgttataaagctttcaaaagtcccttttcttcactggttctcagtttccccattagtaggaggaagaaatggaatggcattatttgtaagggtcctttccaacctttaaatacacatgtttctatagtttacaaacacagagaattatcttcctaaaacctgagcatgtggctgggagtgcaaaagtaataaatattgactgcaaaattctggcttctagttccatttgggtcaagttgattgttctgtttttgggccccactaaagcatggtttttagcagctggtttctacctttatagttatttgaagtagacagtgagcaaaatatctgtacatgatagcaagccaaggttttgaaattctttaaggggtaagaaattgtagaaatttaagctataattatagtattatcactaccattgcatcattatcatccaaagccaaggggtgttaccttactaaatttaaagacaataaaggcatgttgtaatttatgaaagcataaaacaggcctttgaaaaatagcagcttgattattttagctaatatttgtaatacagcctaatatattcatgcagtgtttttgagaggacccctgggtaattttccatgccaaaggttagccaatagctgacagatgtccttactcaagaagactggattttacactgcttgaacattatatagagtcaattcttgcctggcctcttgctttatgttagtgtatctggaatgtacagccacttcacagttaaaatagttttatattttttaactagctatggattccttggatattaaattgagtgcttattgaacaccttgcttgaaataattacaatgcaatatgcaaagttctctattaatattaatttgttgaggaactaccaagaaacctcattttacttagctaactcacctaatttagctctcacattctttcaaagagatactaaaaacttcagtttgcagagagagggaacagcatcacagagattatatcatcatgcaaaagccacccattgatgaatgggagtgcggagatcaaaactcagttttcttttcttttttttctttctttctttctttctttttttttttttttttttttgagacagagtctcgctctgtcgcccaggctggagtgcagtggcgccatctcggctcactgcaagctccgccccccaggttcatgccattctcctgcctcagcctcccaagtagctgggactacaggcgcctgccaccacgctcggctaatttttgtattttcagtagagacggggtttcactgtgttagccaggattatctccatctcctgacctcgtgatctgcccacctcggcctcccaaagtgctgggattacaggcgtgagccaccgcgcccagcccaaaacccagttttcttactctccaaatcctgagcatatccaacgtggtaggctgcttcaatcaaa

SEQ ID NO: 622 - DNA, 52982 bp, Homo sapiens
tactacttacttgaaggtttgttgtgaaaattaaatgaagtgatccatgtaaagtgcttgaaagtgctgttacaacatggaactcaataaatattagctcccattgtcaccatcatgatcatcttcatcaccaccaccatcatggtatgctagactctcttatagacattggagctgaatagttcctattatcaaagggacattaatattttaagaaaaagaggtaaacacaaactctaagtattgtcacataggtttgaacaaagagctctgagactatagaaaaaaaaaaactgagagtcatggagatggcccgatttgcccaagaccattcaatgtattatccatagtgctagtaccagacgtctagtgttctctcctgtgttatcaaaaactatctttacaaaaagacatttcaagaaactaaatgaaattaacatcatgagtctaacctctgcaaaccatccagtttcttctatttcccaacacttcaaggactactatataaagattattgttttctactcacaactcaacctgcaattgaattgtgagtatgatgtaaaaaagagctacatctggccaggcgcggtggctcatgcctgtaatcccagcactttgggaggctgaggcgggcagatcacgaggtcaggagatcaagaccatcctggctaatacagtgaaaacccgtctctactaaaaatacaaaaatattagccaggcgtggtggcaggcacctatagtcccagctactcgggaggctgaggcaggagaatggtgtgaacccaggaggcggaagttgcagtgagccgagatagcgccactgcactccagcactccagcctgggtgacagagcaagactccgtttcaaaaaaaaaaaaaaaaaaaaatctacatacatatgtgtattcttatgtgaaagtacaagtgcagatgtgtaaaaatatctgcctctataaacacagatagctacatatagagatatacagtaagtccctatgtgcacacattagtatatgcctaagcacataggcatacacatgtccacgtgtacatccatatgtggtcatgcatatatttatacacaggcatgcatgtgtccaaacacacatccacactgacacatatgcacagagggtattttgacaacaccgaacagctccagcagcagatactgtggaggttcttataatttaagccaacaattgtcactaaacttaagttctggtttagaaggcgctggaatctccagctgcattagggccttatctgttaatcttcttaaatcaattaaaacaaagctttaaaacatcaaattgctatattatctgtacaatgtaaaatctaccgtgtgaattcaattccaagtgaatcaaagaatgctaaaacaagaatagaacttaacgatggttctcaaacttcagtgctataacaactccaggagcatgtttattttgccaatcattagtcttcagcccaagagactctgacttagtctcaggtggggaccaggaatctgcatttaacaagcttcatcagtgatttagatggtggtggtttgtgaaatatcttttgagaagcactaaattaaagatgatcaaaacctcactttgcaaaagagttaataaaggtccaaatgatgaagtgacattccagaattatgctactgttaatagcataataggatttggaacacagatcttgtccctgtatcccaacaagatgagatatgaagttattattttatggtatctgtgtctcatcttccaacagaactttaagcttctcaggataattgcaatctctctctctctctctctctctctctctctgtctcatattagaatacacataataaaccaaataaagagaagaaacagtagagaaatatataagaaaaagacatttactgatgaaaagcaggtgactgaattgggaagagcatgaatatttattaagtttatattacgtgactggtgctatatttgagctttgtaccagttggggctgtgattggctgcaaataacaaaaacatctaactaaagtggctaaaaccagtaggagtttattttatcttgtaaaataagggttcagagtgaagaattgctttaacagctcgagaatattgggattgatgtctatagattactagttccttttgccatttttttaatgtttgtccactcatgatcacaagacagttgttgcagctccagtcattgcatctgaattcaaggtaaaaaggctgaggagatataccaatttcatttgccacttttattgaggaacaagagcctttctggaaaatctcagaaggcttcagcctatatatcactgggggaacatggagctgagaatttgctctcagaaatagattgtgtcagcaaagatgaagagggggtggctttggcacgttttgcatcttcacacttataacggagaaaagaaggaatgatccatgtgatataaggatgaaacagtaggcatttctctgccagtattttgtggatgacgttggaataactgtcttttcatgcagcaggcattgttcaagtgttcctcacgtaccaaaagctgagctaggtgccatgaacataaagtagaaatagacatgatttcagtcctcatttcacagttaaggatcccaccatgaaagcaacactgcaattcaatataatatgttctacaatggagacaaacaagatgttttagttttgcatatcatttccatgtcccttaaagtgttttttgttattgttgttgttctctatatggcttagtataaagaactgcaacccacaatgtccagtataatataaactgggaccacctaagtagactcatctcatgctcttcttgctccttcttataatggaccaagcttcctcctacttcaggattcttgcatgtgacatttcctctgtctagaatatgcttttacccaactcctcaacctacatcatctgtcaatccctttatcatttagatcccagctcacatgtaatattgagccccctagactagattacattccttgttgtcatcctcataacactcttagtgtctaccacgtcttgctattatatcaatatgtgccatttgtttcatatatgcctctccgtctatacttcaaactccataagggaaggggatatgtgttcttgaataacaattttatctccaatacctagcacatagtaggtactcatcattaaacatcaatcaaatagattactgcataaataggtggaatgaagctacaggttctgcttagcggtaccaggcttcgcaaagtatataacatttaaacttgtcctctctgatcctcagttttctacatatttttaatgagtaggacaaggtgattgctaaaggcctgctcagcttttcattgacatttactcttgagtcctgactccatctctacctttctgtgtgaatttgagcaacttgcttaacctccctcagcctcaatctcctctgtcaaacaagtagagatgatctctgaggcccctttcaagcctgaagcatcagtacatttttgaaactccagaagcaacatgaaaactgcagggtgagagctggagggattctgccgagttgtgggttttgcaggtgtttcccagcaggttcccaaggagccattctcgaaggaactcagcgtgttacctggactaatttataaaggaaatgaaaaggaaatggactcgttataatgaacaccattaattcaccactccagacttcactgtgtaaacagcaagtatcaagcgattcagttgtcatttgtcgattgaattctgctattttgcctgttggaaatgaccagccaacacaacagcgtgcagatgatggcaagactactaattagcatatatattgtttgtcctggtataaatttatggcaaatagcaatattttacactccagtaaagttaataaatgaagctttgggctataaaaatttcatgttcctttgtgcaaaggtcaattataaatagttaagcacatattcattcaaaagcttgaggcctcacagccaggagaatgaaatatattctggtaaatttgcactctggctggacttgcctttcattttatagccttggtgacatccctctttgctcgtcggcacagtctgcattctcaaagaactcccctggctggagagactaaatgaaatgagtatgtaaacattcctagccctgtggtttgacactcagaatgtgtttaataatgccagtttaatctgaacgggaaagcccatgtgagagaagaggcaactgggattcacagcaacacctaaagttctttgtccacaagaagaagcctagacaagaaacaggagatgtgttttcttattccagttctaccatgaactaagagatcatggaacaggatcagtctcctctctaggcctttgtttccccatttgaaaaaaatgaagagagagaatttcatcagtgttccgattatctgttggctgcataacaaaactcccaagagacagacttgtttaagttgttttgaaaactgcaatcattttatttcgtcttctgattttgtgggtcaggaagttgggcggggttcagtgggagattctctgttccatctgatgtcaacagaggtcacttaatttctttctttcctttctttctttctttctttctttctctttctttctttctttctttctttctttctttcctttctttctttctttctttctttctttctttctttctttctttctttctttctcttccttccttccttccttccttccttccttccttccttccttccttccttccttccttctttctttctttatttctctctttctctcattctgttgcccaggctggagtacagtggcgcaatctcagctcacagcaacctccgcctcccgggttcaagcgattctcctgcctcagcctcccgagtagctgggattacaggcgcccaccaccacacctggctgatttttgtgtttttagtagagacggagtttcaccgtgttggccaggctggtctggaactccttacctcaggtgatctgcccccctcagcctcccaaagtgctgggattacaggcatgactccatttatttagctggtggattgagtggtggagaatctagagaaccctctctcatgtatccagtgccttggggagatggtgagaaggctgggttctgctgagactgtgcactggaatgtctatgaatggcctcttctgcatgacattgccagggtaatgagacttcttctgtggcagctcagggctccaatatgaaaggcaaatgctgccaaggctgtgtcagtaaactggtacagcaccatttccaccacactttattatacaaagcagtcacagaggcttcatggattcaggtagagggaacatagatcctatctcttgatcagagaagaatcaaggttttgcagccatctttaatgtgccctaccagtgctttccgattgggttccaaattaagagatgttgcatggaaaaggatttggtggtcagtaagtttgggaaatagtgggttaaaaaagttgagcaattattttgtgtgtgctgcaagacttcttaatatctttgacttattccctccttctcttagtacttattgtttataccaggacctgtcaggctacaaaaatgcagcagtgaacaaaatggcacattcgagtgtttgtatgtgtgggggaattagacaataataaaataaacccatagtgtcaggtcctgttatgtgttatgaaagcaaactgcaatgatagagaatgccaagacttactctttcagatgggacaatcagatggaaagaggaagagatatatcagcaggtagctacacagtgagaacagaaaccatacagaagttcgatgcagtagcaacagcaaggtgcacagctccccggagtgggagcattgttggtcaaatggctgggatggaatgaataagaacatgagtgatgaaagacgagatcagagaagcaaggtaggatatttggagcaatgacagactttggagtttattgaaagtgtgatagaaagccacaggaggcttctggggtggaggagagtgcattattacttttaaaagattccttcctcactttgggaggccaaggcggatggatcacctgaggtcaggagttcgagaccagcctggccaacatgttgaaaactcgtctctactaaaaaaaatacaaaaaaaaccccacaaaaattagctgggtgtggtggtgggcacctgtaatcccaactactcaggtggctgaggcagggagaatcacttgaacctggggaggcggaggttgcagtgagctgagatcgaaccactgcactccagcctgggcgagagaccgagactctgtctcaaaaaaaaagattccttcctactctatggagataaaccataaaaaggacaaacaagcaggaatcagttaggaagccactgcaatattccaagtgggaggtgataatgatggtatggccagtggttaaggtaaaagtgaagaggtctagatctcggatatcttatggaagtagagacaataggatttgctgatggaaggtgaaatgggaggaaaaagtgaaaaaatgcttcttaggttttgggtctatgcagctgtggaactatggggatatagccttaaataatttggtgtgtgttatgattgttaagatgaacacttgcagacttatactgaggaccagagttccaaggaagacattttgagaaatgttagactacacttgtcaaagaaagattgcaccagattgagttacacaggcagggaagcctttattcaagactattgcaatagaggttaagacttgcaataggggagatgaaacttcactgaaacaaaaggcggagtatttttaagagccaatttaagctagtggaaaggtactggatgatgttagtggggaggttggccatctgtgcttgctaattgatgcttataaagttaggctcctccctacccacagccattgggagatagaggcattatctcctttgacagtattttaaagaatgactcccaggtccttgagaaagtcctttctagattgcaaatcttgcaagaggctgggagaagatttacatcccaaaggggtagagaaagaataacaattgaaagtttcctaaagtaaatgctataagaaaagggaggtcagggacttataatcagaaaatcttgtgtaaagttgagttgccctaaggggaatattatggtcttcttggttttgctctatcatctgatgctttcaggtttgaaaacttagacacactacatggaatcctagcaatctaggtcctaaaactattttgtcaagaccttctatctatgtgactttgcacaattatcttaaattatgtttgtcttcacattctaattcttctacctcaaagcctttgcattctgtattcctccttcctggatggatcttccctacatttatgcatggctatatccttttagtcttttgttctcagcgagaatatctcctttcagtctttgtttttagcgaggcctaccctgaccactattttaaaatgaccattggcccattgttacttcctatctccttaattcctaatgtaatatgccatgtatttatttatttatttatttacttatttatttattttatgtttcctatttgtaatctgttgcctcctgctggaatggaagctttattggcaaagtggccaatcacagaattacttgttataataagaaattgaaaaacaaacctagagatgtaaaaattaagggaatacttaaggaagttgatacctctcatcaggggaataatatgcagccatttcagttatgtttatgaagatagtgtaataaggagagctggtacatggaaaggataaattaaaagaatcagaatataaaattacaaataagtattatcatattattataaaagccaaacttgaaagaatctattctacttgtaacgaatatgtgatgacattcaaagtggttacctttaggtgccattattatgtatattatgttttcttccttttcttattttcaggattttttttcaatttttaaataatgattagattcgtttttagagcggaaaagtaaaactttaaaaaacaaaaaaaagactatgagactaccaagattataaacttctttgttcccaatttgtgacacatccatagagctcaaactgctttggccttcataatggggcatggcttgacatgttttgagtatcaagaacagaaaaagctggagcctatcttttgaaacatttgcatgacatttttaagggagtggagaaatagaagcctggaaagaggaaactagaggaagagaaaccacagagagcagtttgaaggcagaagcacgcccacagggtgctttggagaccctccaggctgcagagaagagcaaggtaaataggcgtggagcaggtattatcaatattacgcagtaactaggcaactaaaagatttgtaaagaaggcacagcatcatgcgaaatgcagcaatgtgttttaaggagacagggtgaggattaacagccctgtgattcatggaaacagcaatttgtcataggcgctatctgccatgtgtaggtgacaaaaagtatagagacaatgcaggagaagtgtgacaatgaactgagtgataaacacagatgggagaagcaccagaatgacttcactttaattattttgagcttggcttcctctacacaaagcctggaggaattgttctcccatttttgtttgttttacttgtggttgtttattaagtgttgaaatcgatttctctcagacattttctttttcagaccacaaggaaggtttgtttttattgaacacctgctaagtgttagccattacctttggtggtatctgttaaacctctcaatgaccaatagcgtgtacatgattcttcttctcatttcagagacaggtatgctaagacttaggagaagtgttgcaatttcattataagattatgtattagcatctgttaaatccttgtgtagaatccatgcctgtctagctttacttacttatttactttaccaatcaaattatacatacaaagaattttttctcttgcactgggttcagagtcctcaaaacctgtttctcagagtttgaggtattacaggtgattgccaatgaagccacagccttcagttgtgtgtctgttgcttttctggtaggtatactgatgtgacaagttccaatgctcctcagctttcaattttctagcaaaatggaaaatgcaattaccgtattaagcaaaatattgttgttggttcaaaaataattaagcatagtattaagttgttattttaccaagtgggatgcagtgactctcttcaaagctacagcaaaaggaaaagaattttagaagctctatttagaaagagggtatgtgaggagcaaggaggagaagactgggtgcatctttgggggaaatagttaataagctgaggttttaagagaaacggctgcaggccgactcctctatggagcaggctctcttagtaagagttcaatgcaaaagttgactagagctaactcttttattgtaatgactttgcagttgatttccccaggatccatttttgttgcttgatattagaggagttggctgcagtaagaaaattcagaaggtgaaagaccagtttggtagatatatagcctgttaaaggggactaaagaagtctctactaggaaaagaacaaaaaggtgagcatttattgtgtacctgctatgctccaggaacaggataaggatattctctatctagacagaaagaatgaggtattcatatcaatgataaattatctatttactgaatgtctattatgtggcaggcattgtacaaaaacatttaacatgcagtttttctttgattgtcatagcagcctgcataagcatttagcagataagaaactataagcacaaagatattaataaatagcctaaagcacatagcaagtaaataggagagatgctgttgatatctagaaacttcacctttgaccacaatagtatactgtttctgacagctaagaaaactaaagcttaggcactgcagaattttttctatttgagaaacaacctcatgcaacattaaacgtttaagggatgagaaacctcacttccaaacctggctctgttctgggaatgtgggcaatttactctgcctcagtgaggttcactttcttcaccaatgttactgaaaccacaatagtgatcagaatcactccaagggcttgttaagatccagattgctgggttccacctccagagtttctcattcagtatgtctggggtgggctccaggatttatatttctaacaagttcccaggtgatgatggtgttgcagatcggggaccccactcgggcagactgcactgtactgtcctctgaactgaaagcctggttctccctggcctgaaagagagtgcttctttaagtagacagagcattggctttggagacttggcctaatctttccttcttcatttcctgtgtgattttaggcagctgatttatccttctgagtctccatatcgtcatgtgtaaaatggagctcttgctttctttgtcatcatcttgttggtatggattatgtgaagcgatttatagaaagcatctaggctgttgcctggacaaaatgctcaatagatgttgattcttaacattgggaagttatcaagattatacaatatattgttgtgtatatatatgttatatgtacaacatatataactttttatcttttttattgactaaatatgccaagcattataacatttcctttgtagtatttttgtttcctaagtctctgccatccttatacagatatgcatctgtatggcatctgtaaaacatgcagattagaacaaagtgctactcaagtgacatgtcattgttggagaaatattacatgtatagttttaattcagaagtcataattcatggaagtctcttgaagagaggattctggatatttttggattgcaggcctctgtaaacttcatggaccagaaatcatcagagaagaaacccaaagagataaaggtcaagttgaggaatggtaaactctttgatgatgtcaaaggctctgtctctcatagtgagaaattctttatctctgcctatcaaaaagacattgctagtgattctactttaacaatggttaatcaaactagttagaaatgccaatagatttttttattatttttaataaaagtgtaagtccagtaccccacccccctacctcaatccaagcagaagtttctgaattctattttccctccctctcatctttgtccaggttgaaaatcaatgcatctggttcacctggaatcttgagctgcatatttttagcatcagaaaagcctgtattgccagcattactggagaaaaagcagataaccccacaacgtcctccagccaaggaggagggcagagggctcagaggagcagagtgcctgcagcttagatgattcaccagccttgattcttacagcatgcaggctggtgactatgacccagggaccatgaaccatgagttagaattttctgacagagtccctgatctcaggctgccattttcattaataattgagataagcatgggaaggaggcttaaagtaatattattattattaatcctaagaagtctgtattaaggaatggaagcaacatgtagtaacaattataatatttaacactcgtctgtgcttattacgtgccactcactgttctaagtgttttacctttgttgactcattttattttaataacatttcatagatgagaaaaaaataatttcagcagcagcaacaacaacaaaatggagctgagaagttaatgaacttgccgaagttcccctagctggcaagtagtggaaacgggattcaaactcccacattctggctccagagcccctagtctttatgcttttagagttcagcataaaggtacagtttataaagcataaagctaatagttttccaagcaatgtctttcacatgcatacgtcatgtgaacctcaccatatcctttcacagaagcaaataaatgggttttattatcttcattgaaatatttaaagttcagattcaataagcatttgttgagtaactatgccgaactttgtgctatgtgctatgttattgattaaaatagagtttcaagagatgaaaaataaaaataacttccgtgatatcacgcagtttgcttgagacacagactctgagctcacagggcagtagaaacctttgctaaatgaatctgaagtcttcttggaagtggtgagacttgatctgagcttcaaaggatgaaacaaaccacactgaagagtgaagcctgttaaggtgcaggaagctgaagttctcactttgcctctcctgaagattttcagggtggaacgcaacctctgtcctatttatattcccagggttattggaaaggtcaaatgttaaaataaatattggagtacgtggtgaactacaacatgttccagtttctttccctctgcccagaatactcattctctgatgcagccagatgacaaattctgacgcatccattcaatggtcagatcaagggttgtcactttaagaggtcatcatttcctctccctctctcttctgggtgagattgcctctctttatcatttgcacccacactttttttttttttttttttttttacttacactgcgcttgagatcctttgcgagaaggcctgtgttccttatgaaaatgagaatggagtcttgccttgttcatatcctcatgtttgttaattagcacatgaacagtcacatagcaaacactcaataagtgtttaattaactatatgtgtggcctgtcttccattccaatgttctcttctccttacatattaacatatagtaaatgatggctagatcattaatcccacaaacacttaccagagtactcttagtagggcactgtggaaaatgcaatggatacatttgtaaacaagaaagaatatatataattttataaggaatgcagctaatgaattggaacgtgtgtggggtgtgtgtgtatgtgtgtgtgtgtgtgtgtgtgtgtgtgtgtgtgagagagagatgaagagagaaacttgttctgtgtatcaatagatccatccagtcattcatcaaaactcataagcatttactatgtgtcatggactgtgttaggcactgagatataattttgaatgagacctactccctgctcttaaaatacttataatccaaccaaatcttcctgcaaaatcagtaaacatagacctgggatgttagctccaagtatagaattaggaattaaagcaaatgatctttcctgttaagggtgcagcctggcctgcaagatttccccacagctccttgtttcctccccaggaaagggggacagtgttccctggagccccactcagtaatgaacacatttcctctggctattaatcagcacctttactgatgaatctgcagcagcactgtggggatggaaggatggaggatacctaagattctatttactatctcttccagagaaagtctctgacctcaatttcatttcttgtttttattgacccatttcatgctagtggagtaaattttcaaggccctttaggaacaaatcagcttcttttgtccttgttaaatggacattctccattcagtcatggatcgacacaatcttatcatcgagaagataaggtctgaagtgcatgatttgcttgcagtgacccagactgcacctaagtcttcagaaaccaggctttagtgggtgaatttcataagcaggacctagaattgactccacattctgatcataatctgaaacagagcagagggtagataaagtgactctgcccctaaattcatttatacttaggttaccccatagagacaccccaaggtgagcaggactgcagaaaggagttttataggacagaaagacaaaattgaaggtaggaaagtaacagaaagagaaagaagacttcaggggttgagagtatgatcaaacttggaaggctcctaggaagaagaaggttaaagttaataggatgaatgcgttagtcggcgggtgagaggggatggaaatgaccaagttatgttgtagtaacagacaaacccaaaatgtcaatggcttaaatcaacactacttctcatttaagctgcgtgtctattgtgaatcagagggactgttctggtcattgcagtcactcaggaacccaggcaatgcaggcagcctcacaaccattgctggtcaccatgtcaaaggaagggaagctaagctcagaagagtctaccagcaattaagtgctctgaatccaagagcaatacatataatttatatccataccttattgactagaactagtgacatgtcccaacttccccacaagggagccaaagctatgtgctcaggagtgagacagcactagtgtctaccacaaggaatgtgggcatagaaagaaaatcctaagaggtgcttatgccagcataatgttctcagagttgggcaggtctccaaatactccctgataagattctagtccttgtagaaatgtgttcactctttctcagggtttaagaagaaacccacaacaaagcctgggcaggaataataaagtcagataatacaatgtataatgaacaaatatcttttatttttcatctctgcttttctgctcaagtttgagtcctggctccatcttttactaactccctgacaaggagtaagtgactttcccatctatgccagagattctttattttttttaaaaaacaaggataacgatattacttaatctctaggactttcatacatattaaacaagtaaaagcagaaaaagggcttagaatagtccctgacacatactaataagtattccatgagtgttaaccatttttctttttcttaacaacccaaagagttgggttctacctcattaataataggttacctcattaataaataggttttacctgatttaatggtgtgaaaagggatgtctggagagattgagtatattccagatcagctgtgtgatcaatggtggagccaggattcacatttaggtcctttaatttcagaggttgaaatttatattttgcatacaaattatccttgcgtttgatcacctcaacagccctgaagatggagccaataatattcttccaatcaccaacccttctgctactattactgccatcactgcaacttccaggtatcatttatagagcacctactttacataaatcatatctaaatctcacaaaaattccctttttatactacaaactgaggttcagagaagtaaagtattagtttgccagggctgccatacaaagtaccacagatcaggtggcttaacaaaaatttattttcttacagttctggagggtaaaagtctgagacgaaggtgttgacagggttggtttcattctgagtgttctcttcttggtttgcagatgattagtttctccctatgtcttcacgtggtctctctctgtatgtgtcttaatcttttcttattaggggaacagtcttatgggatgaaagcccacccatatgacctcattttaacctaattacccctttaaaggctatatttccaaatacggtcacattctgaggtactgtgtgttgaactttgggtgtgtgttggggttgggggggtcaactagtagcctgtaccctaatgaaaccagaagttaaatataggatattctcattgtaagcacacatcatccttccatctttggtccattaatgaaggtctcctatgtgctaggcatagtttatggtgctttttcactccttttttcaaacctagttctcaaaggaaatgctgactcctttgtatagctaaggaaattggtgttcccaatgtggtcactgtccgtcaccttgtgatgtgttcaaatcttctgctccactaagaagaaactttccttttctcccatcttgctcctttggagatgagacagcccttttaaaatgatgccatacctgttatgttatcaagaattagcctttattaagtgctaactctgtacaaacatgaagataggcacttaacacgcagaaacctaagaaacaatgccaactttccaagaaatcacaacctagatgaaaaggcgagaaatgaaaaaatgaaaagtacaatataaataccagttgtttttccctgggaagtgccatcagtgaatagcttcagaggaagctgtaaccactatagaatagttattcagaaaaaaacttcttggcaggttttgagggatgcatttggaagtcggagtagttagcatgtcagcaacaacaagaaacagaaacatgtttgtaggataatttccggtcacattcttgcttagatattaatggctcaccactgtctgcaaggtaaagtcgaagattcttagtttgcattttgcatttgaacaagcttctgcttctgctttattacccaccattcccctaggtgacaaacctgaactctgagacagtcatttctcacctttggcccttcacctgtgaacagaaactgcatagagaaaagagcagggatctcagaatccagcaggtctgaattctggctctgctacttactaaccactgggacatttcacatgttatttaacctttcagtttattcacctacaaaataaaaatagtaacaagtacctgtcaaggaatatgtgaagatttaatgaaataaacttttttttttttttttttttttttttttttttgagacggagtcttgctctgttgccaggctggagtgcaatggcgtgatcttggctcactgcaacctccgcctcctgggttcaagcgattcccctgcctcagcctcccgagtagctgggaccacaggtgcccaccaccacgcccggctacattttcttttagtaaagacagggtttcaccatgttggccagaatggtctcaatctcctgacctcacgatctacccactttggcctcccaaaatgttgggattacaggcatgagccaccgcacccggctgaaataactttttaaagcacccaacatattgcctactgtattatgtggactcaggatatggtagttatcattataataatgatgctttttgtttggtgccagcaattcacttccactgcttcttagcctaaacaagtcccttagcattttttatatttataatgtagctttatattactgcatcatattactttataagtaggggcaatgtaatgtggtggttaggagcacagtcctggaatcagtcagcttaccattgatgaactctacctctcattactctgtgaagttaagcaagttatttggccactcttgtttctcagcttttttgtgtataaaatgacattagggaattatctgcttcgtagagacagttttgaagagaaaatgagtttatgtcatagtttctggaatacagcatacattcaataaatggaagctattgttatattcattttatacaggaagaaagaagtcatgtaacttgaccaaagttgaaagactagtgggacaaaaacttttagaattagaattttgagttgtgtgagttccttacaaattttcaacaccaactcccatcagatatgtaatttgcaaatattttctcctattccataagttgtctttttattttactatttcctttgctgagatgaaactttttagtttgatatagtctcacttgtttatttttcgctttgttgcctatgcttttggtgtcatatccaaaaaaatcttgccaagaccaatgtcaagtttttccttatgttttcttctaagatttttgtggttttcagaccttaagtttaagtttttagcccattttgagttgactttttgtgtatggtgtaacataaagatctaattttattcttttgcttgtggaagttcagttttcccagtatcatttattgaagacactattccttcccccattgcacacccttggtgccctcgtggaatataagtagaccacgtatgcatgggtttatctctattctgttctgctggactatgtgcctgttttaagccaatactatactgttttgattactacagctttatactatactttgaaattgggtagtgtgatgcctccagctttattttttctcaagattgtttgggctattcagggtcttttgtgattccatacacattttaggattgccttttctatttttgtttgaaaaaaaaatggtgcatatccaaaggaattgaaatcagtatttcaaagagatattggtactcccatgttcaatgcagtgttattcactgtagtcataatatggaaacaaagtaagtgttctttgatgaattaacagatcaggaaattgtggtatgtaatacatatagaatgaaatatcattaagcctttaaaaagaaggaaattctgccatttgtaacaacatagatgagtctagaggttattatactaaatgaaataagccacacacagaaagataaatcctgcaggatcttcttttatatgtggactctaaacaaatcaaacttatggaaacagtgagtagaacattggttgccagggcttgggagtggagaaaatgtgattttggttaaagtctgaaaactttaagttacaagatgagtaagttctggagatctaacgtgcgccattgtgactccagttaataatgctgcattatatacttaaaattagctaagaaagtagatcttttcctcttctttattttaattggcaaataataatagtacatattcatggggtgcatagcgaatagaatagatattaagtgctctcaccctaaacacaaggtaactacatgaggtaatagccatgttaattaacttgattgtggggattacttcataatgtatacatgtatcaaaacatcacatttttaattgtcattgtacctgagtaaagctggaggctgggaaaaaattgagttaggtgattccacaatctgtgctcttaatcaccaggcatttggataaccacatgaacaagaaacacttctgcctccaagtccttccccactgtcattatctgaaacacacacttgacagcttctgctgcccagacaactttcagactgcagataggatgagctgcctctcacttttcattcactttataaaaatgtctgcattgatactggccccacttcttttatcatccctcagcacatacaacttttgcagtgaaaacagaagactcagtcaagcaacatgtgcaggggcacatcgttaaaaggcaaataatcaggaccaacatccaggtcaacacagttggctgctgagtatggagcccctgctaactccatgttttagccaatgctaaacacagcctgttttagccaatggtggaggaaactgggcaatgtgtgtgctccattatgtcaggaacttgaccatgtttacctctggcacagaaaggcccctcactaaacatttgcttaatgaatgactcaccaacctatctattcctctatctatctgtcatctatccatccatctgtccatctgtccatctgtctacctaggaaagcccttgcctcatcttgcattatgcaccctcaaatgggagagacagaaatgtaagcaacagctcattgtatgctgtgtaaagagccatgatgggagtgggtgctacagacaccaggaaaagctcttatgactagcaaatctgtacattctgctccacccaaggtgccttcctgcccacacttaattcttccacaaaagcacaaaaagtcatgattacagcaaacacttatataatgctatagttatgctcttagcaagcagtaacaattgtgaaaaactttaaataaaaatgaaacaaaaaatggaagaaatcaagttgcgttatctaatatgaaaaatgcattcgggttttgtttttttcagaaaaaaagtggttctacatgaagaccagaatctatagcacacaagcaaacattgtctgtgctttcttaatcctctcattcatagatccactcacaagcgcttctgtggccaaaaagttttacttggtacctatataagcttggcttggcctggttcctattttctttgtaagttttgtttctttcttgtcatttctcactcccctatttaccttaattatttttatttgttttgttttggtttgggtaagtttaaagacatatttaaaaaaatttttttaactttcatttttaattcaggggtacatgtgcaggatgtgcaggtttcttacataggtaagtgtgtcatgggggtttgttgtccagattatttcattacctaggtattaaggctagtatccagtagttattttttctgctcttctccctcttcccaccttccaccctctgataggccccagtgtgtatcgttcccttctatgtgtccatgtgttctcattatttagcttccacttataagtgagaacatgctgtatttggttttctgttactgtgttagtttgctaaggataatggcctccagctccatctatttccctgcaaaggactgacctcgttttttttttttttaatgactgcatagtgttctgtggtgtatatgaatcacattttctttatccagtttatcattgatgggcatttagatttattccatgtctttgctactgtgaatagtgctgcaattaacgtgtatgcatgtgtctctatagtagaatgatttatattccttggggtatataaccagtagtggggttgctgagacaaatagggtatttctgtctttaggtctttgaggaatcaccacaatgtctttaattaattgtgtgtatatattgtgtgtataatttaattaattgtgtgtatatattaattgtgtgtatatacatatatatggataggcatctatctatctatccatatatacttggtacctgtataagcttggctttgcctagttcctatttatctatctatccatataaatctggtaaatagagagcatataggcaatattaacattatctatacctcatacttcaaaatagcatattggagattccttgatgtttttctcacttccactttcttcattctaataatcaccaatttccattcattctacaccctaaatttctctcaaactcacatttcccttagctcccataataactgccttattacaagtcttcactgatgcatggaccattgcaatgacatcttaagtaagtgatatccatttgctcaccagcaataccattcatccccaacgatgctaccaggacttttaaaaactcagatgtggtcatgatctctgctaactcaattattttccggtttttgaaggattaagtttgaattccttagcatgacatgatcggctgacctagcagaatgtgacttctgcttttatctcccacttcacctctaacccagattaactaagaggcagagattcagcaactataggcacgtaattgctgtccattgtctgccaaatggtttacaactccttgacctttttagataatgttcctttgcctgttgtaaggctctccacaatttctgcatgcctattgtctttttttttgactaccaaactctggttttgaaaagatagcatttgtccttgcagagagcatatatattactcccttatttttaccaccaatgcatcaaatggtgctacctttacataaattgcactgaaatattgtaactttctttttattgtaaagtaatatatgtaccttataaaatcttgagaaaatatagataagcagaatgaaaaaaattaaatcatccataattttgtcattcagatgcaactacttttaatattctgtgggactctgccactagtcttttctccaaacatatgtgtttattttgcaaaaatagaataatactatccatattgttttgtaatgggcttttttgaaatggaagaatatattgtaaaaattatttcctgtgtttaaaattatttcttaatatcattgtcagtgctaaaaagtatttccttggatgaatggaataattttctattatctgaactacagttataaccaaagtttcacattacaaatgagaaggcagttattctctttatatctaaacccttaagtatgatcacaattacttctctttgataaattttaacaaaactaatttctggatcaatgaagatgcacaagtttaagctttttggtacatatttccaaattatcttccaaaaagattctaccagttttcactttcaaacgcaaagtacgtctgcttcctcacaaaggtaacatgaatatatgatctttgataagccatcgaataagcaaaaaggatatagcttgttgatttgacataactcgtctgtgatggggttataacaatggggtatatacgaatatgctttattttgcatattaaatttatgtatatagtatttaaataaatttttttcttttgtgattttcctaattgggtccttgattcactttacactgagttgtttatctttttttctcattgattcatgagttttttatatcatcctttgtctgtcatgtaagccacatgaaaattttatcaccttttgctgtctgcttttgagtctgaaaatgacttatgattcaattcatctaatccccattgcttgaaatgctaccagtattatatattgattcctatctatactcagaccagtttatgaacatttaagaataacccatcagcctgttcccctatcgctactctattttaaaattattttggttcatatcaatattattcttattctcatacacactgttattattttaatagctaccatttattgatcatggccaatatatataacatatttcaatatacaatgcttactacttttacaaaatatgtcggatttattcttccaaacaatcctctgaagtcagtgcaatgattatataaatgtttcacctaaggaaactgagatgaatattatttattatctggtaaaactgagattaaaactcaggtcagcctgacaccacaactacaaactcccaaatccatatactttactcagctccaaaaatgttttgtacctattttcagaagtttcattcttggagataaactttaacattatcaactttataaaaaaacagcttttgatttttttagtaagctttttattgagctgtaacattcatatatgcataaaccacaaacgaacatgtgtgcaatttatatccagaccgagaaacttaccagcacgcagaggccccattgtgccctcttctactcatcactacttcccacacatcaaacctgtcctgacttctacaccattaattaattttatgtggttttgaattttgaaaaaacatacagatttaaatttaggttgttgaatgtcttttcatgtgctttttagatatttgtttatcttatattttaaaacatctgttcaaacctttgactacctttaaatttggttgttttcttattgagttgaaaaggtctttatgtactctgaataccagtcctttgtcagattatacacacatacacatatataattatataaactatatacatatatatacacactctcttgtgtatgtttgtataaaatattttctttgtgtttgcttttttcaaccttattttttgaaagaaaaaatattttaattgtggtgaagtctaattccctattataataaatgcctaccctaagtctgtagataattctttatgtttattctcctaaaacttttatactactagcttttatatttaggcatatatgatccattctcatcacataatggtatgactgctatgatttatgggttggtgtttatttttccataatgatacagttgtttaagcatcatttattgaaaatactctaatttctccattggattacgtaggacactctctctaaaatcaattaaacctataagtgtgggtctgtttcttgatctataggtctgttatttttcagtagcacacggccttgattacttgcagctatatagtaagtcttaaagtcagatagtgtaaaagtttgtaattttattctttattttaaaaatagttttagctattctaggtttttggcatttctacataaactgtagaactagcttatcagtttgtgtcaaaaacttacagctgtgattttcattgagattgcaatgaacctaaaacttaatacagggaaagtattggatgttacaatccatgaaaatggtatgtgtctttcttttttcttatttagcttttctaaacaattttttataattgtagtgtgtaattcacacattttgtcaaatttatttgtatatacttcatgctttacaatgttagtgataatgtaatattctatatttaactttaattttctattttttgcaactttcagaaatatgatgtgactttgctgaaatcatttattacttgcaataattttagatttattagaattgtatgttacaacctttatataaatatacagttgaaccatgaacaatgtgtgggctaagggcaccaatccccccaaacacacagtcaaaaatctgcatataagttttgactcccaaaaaatttaattactaaagcctactattgactggaagcattgctgacaacatagatagctgattaacacatattttataagttatatgtattatatattgcattcttacaataaagtaagctacaggaaagaaaatgccattaaaaaaatcataaggccagtcagagaaatgcaaatcaaaaccacaatgagataccatctcacaccagttaaaatggcagtcattaaaaagtcaggcaacaacaggtgctggagaggatgtggagaaataggaacacttttacactgttggtgggactgtaaactagttcaaccattgtggaagtcagtgtggcgattcctcaaggatctagaactagaaatacaatttgacccagccatcccattactgggtatatacccaaaggattataaatcatgctgctataaagacacatgcacacgtatgtttattgtggcactattcacaatagcaaagacttggaaccaaccccaatgtccaacaacgatagactggattaagaaaatgtggcacatatacaccatggaatactatgcagccataaaaaatgatgagttcatgtcctttgtagggacatggatgaagctggaaaccatcatcctcagtaaactatcacaaggacagaaaaccaaacagcacatgttctcactcatgggtgggagttgaacaatgagaacacatggacacaggaaggggaacatcacactccggggactgttgtggggtgggaggaggggggagggatagcattaggagatatacccaatgctaaattacgagttaatgggtgcggcacaccaacatggcatatgtatacatatgtaacaaacctgcacgttgtgcacatgtaccctaaaacttaaagtataataataataaaaaataaaattaaaaaaatcataagaaagagaaaatatattttctgttccttacatggaggtgaatcatcataaaagtcttcatccttgttgccttcacaatgagtaggctgaggaggaggaggaaaaggaggtgttggtcttgctgtctcaggagtggcagaggcagaagaaaatctgtatataagcagacctgagcagtacagacatttgtggttcaagggtcacctgtatgcatatatatcatctgcaaagagaaacagttgcttgacacagtggcttacacctgtaatctcagcactttgagaggccaaggttggcagatcacttaagcccaggcattgaagaccagcctgtgcaacaggggaaggccccgtctctataaaaaaaaaaaaaatacaaaaattaacgagacatggtggtgcacacctgtagtcccaggtacttgggaggctgatgtagtagaatcatctgagcctgggaagtggaggctgcagtgaactgtgactgggccactactgcactccagcctgggtgacagagcgagaccctgtctcaaaaaaaaaaaaaggatatttacattttactttttttcctaattaatatgccctttatttcttttacttgtgcagtaaaataccttcaagaatgtgacttcgagaaatttctttcaactctcctaacctcttctaagcattcagtaggccaccggcttgtacttttgtaagacacaacgtaccaaagaagggatgtctctcagcaatcctaccctgtcttgctcacttacttggtaaaggccaatgggaaagaattggtgagtgggtgcaggcctactctgtagctgggctgtcttgagattctaatccatcagaataatccatacatagatattaaaagtttggtaaaatgtctggctactttcactttacccacatgtatggcagattcttctgcctctttctgttctgaacaagacgacagcagttgcaagctactgctttcctaagaatatctcattttaaaaaattaatttatataggtttctttgggtctacagccatccaaagggttagcttatctggcttttttatgttgttagggcaggaagggcatacatcttaactagaagttaataacgtatacatttccttaatatattaatgtctaacatttggatttgttggttttctctattaaattgttgttttctattaacctctgcttttgctatttgtttctttattctttagagtcacaacaagatttgcttttctttttctaatatcaagaggtaaaagtttagatcattgattttcagtcttactccttatctactgtatttaaagattttaagtgtaagcatggcttcagatgcatgtgacaaaatttcaggtcacattttgaatattaatcagttcaaatattttaacatttttattgcaatttctttcttggcccaaaattatttaatttcttggcaatgtagatttttcaaattatattttgttattgattttcagttttaaacccattatggtcaggattttactctccatgatctcaaatcttcataatttgttaaggtttgctttatgtactatcatatgatcactttaggtaactactttatatgcctcagctaagaatattgaatgcagtgtttatatatgtcaatggttgtctttgtgcagtaaagtgtgagaacataaaaattgttcatatatttatatatttttgatcttttatgtactctcattataattcaagagagaagtgccttaaaaccccctaccacaattgtggatttatttatttctctttttgagttatttcattgctttatatatttggggaaacagttattaagtgtatacaaacatagaattactatgtctccaggtccatcaattttatgatttcttttccaaatgtcccattttgtttttttgttgttgttgttcatccttgttttaaacaaaaattttagtatatgaatttttgaatacattttcatgaattgttacttttgtttgatctagcaaacacaatatgtgtatttaattagtcacaatgtacttaaaataatactgaatgtcttctgtctactaaaataaggatagacaattctggctacagtaaatttccaattatccaccctccatccttttttggtactgtgttgccatatattacacacagacacacacacacacacatatatgtatatatacacatatatacacacacgtgtatatatacacatatatacacacacgtgtatatatatatatacacacactatatatagcatatgagtccatacctatatttatatttcacagatatgtgttataaacccaaaatgattgtcataatttttgctttaaattgcctttaatgtaataaagtgtgatcactatggagaggaatttcttggatcaccttcaagagaacatgctaaaaattgaagaggaaaaatccttccaaactcattctataaggtcagcattaccctgataccaaaattagacaaggactcagcataaaaagaaaactacaggtcactattccttgtgaacataaatgcaaaagtcctcaacaaaaggctaacaaaccaaacactgaggcaccttagaaagcattcactgtgatcaagtgagatttatccccaggatgcaaggatggttcaacatactcaaatcaataaatgtgatacatcacatcaaagaattaaggatgaaaatcatgatcatttcaatagatacagaaaaagcatttgataaaattcaatattccttcatgataaaaagacacacaaccaactagatatggaagaaaggtacctcaacacaatagaggccgtatgtgactaactcacagctaacatcatactgaatgaggaaaagctgaaaatttcttctctgataactgaaagaagacaaggatgcccacctcaccattcttattaaacatagtactgaaaatctttgccagagtaattaggcaaaggaaataaaggacatccaaattggaaaggagaaagtccaattgtccttgtttgcggaccacatactcttatatatagaaaccctaaaaagtccaccaaaacttttagaactgataaataaattcagtaagattgcaggatacaaaatcaatatggaaaaatcagtagcatttttatataccaacaataaaagagcaggaaaacaaatctaatttacaatcactacaaacaattaaaatacttaggaataaatttaccaaggagatgaaagttctgtacaagaaaaactacaaaacactgatttatatatatatatccaccatttttagtattctttatcatttcttatatacacaagtacgaaagtcattatctgatactgtttttttctttctggaaatgtttcctttatcatttcctaaattgtgtttcatagcaataaattctgtcagttttgtttaactgaaaatgacttcattatgccatacattttttctttcagcattttgaatatctcaatccaatatcttctgcctttcattgtttccaatgatcatttagcattaatcatatcgtgtccctgcatgtaacgtgttgttttttatcttgctgctttttttgtattatttttggctgttggcaattttactatgatgtgcttgtgtgtttatgcatgtgtatgtgtgtgtgcatgtgtgtactcatctgtatactccttgacagtttttgaactccttggatcaataaattaatgttttatttcaacaaatttagggaaaatttgatcattacatcttcaagtatttttctgccctatactatctttttattctgggattctaattgttgggctgctcaatattcaccataggtctctgaggcttcttacattttttttcaatctttctcctctcttttattttgattagaaaatgtctattgatctacatttaagttcggatattctttcttctgccatctcaaatccgttgttgaacccacctaatgatttgttttcacttcagttgttatacttttcttctgatctcaagtgttttaagttactctttatagtttctatttctctcagtttttaaatctgttaattcattaatatcatatagtcttaattcttcaagtttatttgcctttaaatctttgactacacttgcaatagtttatttgatgtttttgcctactaaatccaacaggtggacacactcagagtcaatttctattgactgggttttgtttgtttctttgtttgcttttctacatatatattgatgatgcttctttgcgtgtttgatatcttttgattaaaaatggaacattgcagataatatgtttttttttttttttttttttgagatggagtctggctctttcacccaggctggattgcagtggcgctatctcagctcactgcaagctccatctctcgggttcatgccattctcctgcctcagcctccctagtagctgggactacaggcgcccaccaccacgcccagctaattttttgtatttttagtggagacggggtttcaccatgttagccaggatggtctcaatctcctgacctcgtgatccgcctgtctcggcctcccaaagtgttgggattacaggcgtgagccactgcacccagcctgcagataatacattatagatattctggaatttgttgggttcctctgaatactgtcaattgattgttctaacaggcagttaacatgcctttactgaaactatgaaatctgtctccctgtggtgtgcagcagctgatatatttgctcatttatcttggcttccaagctattgctttttaaggcacatcttccaggtatttcccatatctgcatatctttagtggccagccaaaagttagggtagactctgtcctcagatttgggggcgcttagcctctctgtgattttcatgatcccaggatttctcacttaattttctgattcctttatcagctcttgttgctacttgaacactgtaagccaagacggtttcactgaaattctgtatgggttgaaaaataactcagtcaaaggtgaagaaaacacacaaatcatattaggagtagttcttttatttcaactgtagaccttttcagtttttgcttattcttttgatgagctctctgaggtcctccgtgtgagtagtttattgaccagctagggattagagcagccttattactcaaattttagatataagtctttcagtggctttctgacttcaaaaactctcttttaaatttccagtatttcctttgctctgtcatctttaccctcaaaccaacaaggctgttgtttcccatcatccaatctgtgaggattcggcaagacactgggataagaaagccacaatctcctggttcttctttggtgcatgacagtctctgaagcataagctttcctccagttttaacctgctctttattattttgctcatctttaaatttttttaaactaatgtccagtttttaaactatatttaaatgtataattaatacagtaattgtacataatatacaagcattgtaacatcacactgtatcttgatgttctccagtttttatcattattttctgtgaaagaaatcacctgtcctcatcatgcagtcattattagaagtcatgccctgatttaatagtctttcttgtgctatgtttcatttatatgtatagataaaattatataatatattggctgggcacagtggttcacatctgtaatcccagcactttgggaggccaagacaggcagatcacttgaggtcaggagtttgagaccagcctggccaacatggtgaaaccctgtctctactaaaaaatacaaaaaaattagcctggcatggtgtaggtgcctgtaatctcagccactcgggaggctgaggcttgagaattgcttgaatccgggaggcagaggttgcaatgagccaagattgcaccactacactccagcctgggtgacagggtgagactccgtttcaaaaaaaaaaaaaaaaaaaaagattatatactatatttatcacattttagaatcagtatgatgtttattccaaattagtgaaataaattttaaagaattccttccttttgttttaaataactaagctacatagaaactgcattttaaaaaatttaaagacctttctattaaacactctgggcgttgctgtctctgtattacttgaatagttttcacattacatccgtgggtactttcaacatatgcttacatcagtcttgataatttatatttatttcagaagtaattttctatatattttaaagtttattagcaaagcattgcacattacattctttcatccatcattctttcatcttttcatccatatatagtttctctgtatccacggttataagttatttctgtttcctatcatggtttatttgagttttctcctattttcgattactctcgtttaatttggttgtttatatatgagtcctgttctttaggctgtgaacaccctgaagtcaggcattatgctttgcctacttctatcactaaaacaccagtacagtgcctttcacattgtacgtctttacttactgtgtgttcaactgaactgcaaacgcctggagttatttatggagaaactctccattaagccaatccaaaatgattcattaaacgttagcatttacatgggacaacatagtttcattttacaaattatgaaactgagagaagagttggtttgcccaaggttagttacacagcaagtttgtggtagaacagacttcttcccagcaaaccatgctgtcttcctaaattgagttaaatctaagacagtctcgattaccatctcttccatacatatatattcaagtaaaatcagtaatgattccaacacaatttccagctctaaaattacaaaagtctttctgttagtattctgctttgtgaaattactttttgttattaatgacacctacactggggctccgggttctcagtattgtgtcatcccaggaacatgtcagtgtgtggtggatgtggctaatttacagattctttgcaactttgtagagaattgccctgccagttttggcaagaaggcttggtgtattaaaattggagcccaccgtcgaaggtaaataatgtctatgggtgtcccattaagaaaatgtgtatcaattgggggaaataaataagctatttcttttcttttggccatattaatatctatttgtatctatatgacaataaacatagactattaaagataggactaaactggaagttgggaaactgggcactagaccaaattttgccactaacttgctagcgacttatttcctttctagaaatcacaaattcctcatctttaatttgaaccacttaaaaataggtacacagagtttgaacataccttagaggtattttagggggctctatttaatagataagcccagaaaagttttcagaagtcatgtctttgcctaaccctaaaaaaataagaaggaagagcagtttttaagagaagttttcctataaactctgccattaatttgggatccaaaaagtaatgctactattccaatagaagccatcctccaagttgcacaagaaagaatagaaaatatgttctaaatattcaaatgactaagaaatcacttttggcatttttgttttaaggtgatgagaggaaacatgtgaaaaggttttataagagtagtgacattagagatagtccttgagaaatgaatacgattttcacatttacgtattaattcattcacttctctagttctttgtttatttagtacataattgttgaaactatatgttgtacccacactatgctagccattgaggataggatggtgagcataatggaacttgcagtctaggtgaggacatagacactaatccaatgatcacatacatgtgtcattaccaatgattgtaactattacataataagaaatgtttaatatttgtggaaagcagtgtggcaatttctcaaataacttaaaacagaattacctttgaacccagcaatcccattattgggtatatagccaaaggaatataatttgttctaccataaagatatatacacatgcatgttttttgcagcaccattcacaacagcagagacatggaaacaccctaaatgcccattattggtagactgaataaacaaaatttggtacatatacacaatggagtactatgcagccataaaaaagaacaagattatatcctttgcagcaaaatggaaggagatggaaaccattatcctaagtaaactaacaaaggaacagaaaactaaatactgtattttctcacttataaatcggagctaaacagcaagaatgcatggacacaaagaggggaaaacagatactaggtctgcttgagggtagagagtggggggagggacaggataaaaaaaaatacctcttggatattgtagtttttacccaggtgacaataatatgtataccaaacccctgtgacacgtagtttacctatatgacaatcctccacatgtactgccaaacctaaaataaaagctaagaaacaaaaaaggaaatgttcagtgtaacttgatgtgatccaatgagagtggggaagggtgtccaatgcatgaagaagtaacacatgcattgatgtctacagtgactgagttaaatggaagtcagagagtttggtagaaggactgtcatgtgcaaaagccctgaagagagggagcatgatgtctgtggaatagaaacaaggtcagttaaatagagtcaataatcaagaagggacaataggaagggatattctgggctacggaatagatatgggggaaaaaaaggcataaactttccttagaaatacaggtaattgcatttggtaagggctttgaataccggaggaagtaaattgggagttggtgagggaaaagtgagttgagtttgtattgtagagaggtttagttgacaggttaaataattccagcatagacaccatgtgttaaagagagattcagaaaacttattgaccttagagtgtgcttttacaaacttacacttattgccaggtgaagagattacaaagaaaggaaaaaaaaaataacttcactgtaagaaatgggctctgtgagagccacaatgtatacagacagctggatgagtatctgcactgatattactgcacatcttgtgcgttcttttatgtggctagttgcaaaaatgtgtgaggaatggaagcttagcctcttccttttcatcacggatgctgtttgttgttgctttctgcccttttttcttccttgaggtgtcacccaagcagtacaaagtgacatgagaaaaataaaagcatctctttttcatagttgggttgtagtaacagatggtcatgttcactcagcaaagacaaatagctcgaatgataaacacaacagggttgagaggtgcaggagggagatttttgccagcatcctcactcatagctggctctggaaagagaacaatcatcttttacattttagttcttgcaaaggaggggaatttgaatacctgtgctggaaagaatgtgagctcactagagagaggaggagtctgttaaggtacatgtttcatcacaccatgggaagtaagctccacccacaccccctcagcttctacattcaatctcgtaccaaggcccgacaagtttgtttcttaaatttctgtctgcctctcctcaacaaaatccaagtattcaggcctccataatcttttctatgttatttcaaaagcctcccgaataattccctcttctctgcaactgcttccttgcttcctagtatctatgctgctatttgtcatctttctaagatggaaatttgatcatgttgctctcccatttaaaatcttacacaggttccctgttgcattcagtctataactcaaatttctgaatctggcataaaggaatcagccccttcctaccttggagcctcatccctgcccaacactgctccaacacagacatgcacacacttctgctcagtgactgatggtctattttcagttccatgaaggttcttcatgatctgagccccgtggtttcccattctgatttgattttactagagtagctttccttgctcctgctcacccattaagaccccattcaacatctcctctctatgaggtccactttgagcttgcctttaagaacattgaataattaattactcccttttaacaatcacatgtcttttacatttatctgtcatctcaacaataataattgtattataagtatttgttaatgtggcaatatccccattatttggggctccctggagaaaatggcaaaactttgttagtcaccatttatctctatagtgtattatgggctctcacaataacaatattatagctaatatttatgaagagttactgtgagacaggaattgtcctcaggccctctttcaatggcatggcattaggacctcaatattgtctttttaaattcaagttgctcatcacataaggtatgatccatttgctgattcacaaattatgaggataaattatgtccttgaagtataaactcagctaaggacttgagattaaaggaacaatttaaagacagatggaagagttgtgtgtctgccatacaagacattcagtctaatttgagaagtattgattaaatacctgctgtgtacccaatcatgtactaagcaattaaccaagtgtttgcttcaacagagatgttccacgttattcaaagtcaattttttcagtctgtaaatgaaaataaactagtatttttacaataatgttttaatcgtatgcacataaaagatcatagcaaggactcaatacagtactgaggtctgagttcaatgcttggcatacgatgtaagagaaagagaattggcttaggaatcagcagaattccagtccctattctgctactttctaactagcagaagtttgggccagattccctgtctctctgtctatcagtttcaccacctagaaatggagaaaagtgggttattttgcctcttccatctttgatacattccatggctctacagctccctcctcaaaagattctctaaaaatgctgctttcattaccttgtattaaagtaattccccttctaatctttcagatctacacaccaagagaagctgctagtgctatcaggggtttctgttctaaggttaatcataagacatttttggagaggaagatatatccatgagaccaaaacagagaccagtgaagaacccatttctgaccctgtgttattctcatgtcatgtattgttagataatatgatttggctgtttttcctctccagatctcacgttgaaatgtaattccaaatgttgaaagtggagcctggtgggaggtgattcgatcacgggggtggatccctcacaaatggcttagcaccatccctttggtgataagggaattcttgctcagttagtagtttgcttaaaagcctagcatctccacttatttctctctctctctttctctctctccgtctctctatccctctcagtctctaagaagttccccccaccgtctctgtctctcccagtctctaagaagttccaaactttggagactgaaagagagacagagagaagtttggtatttcttagagaccggtaaaatggttgcaaccaaaatgttgatagaaatatgggcagtgaaagccagactgacaagatattagaaaaaaatgaggatgttactgggaactggagtaatggtcacctgtgttaagccctagcaaagaacttggcttcattgtgcccttgttatctgtggaaggttgaacttaagagtgatgacagggtatctggcggaagaaatttctaagcagtgcttctaacagcctataatcagatatgagagccaagaaatgatttgaagttggaatttatatttgaaaggaaagcagaggataaaagtttagaaaatctgtaacctggacaagtagtagagaaagaatctaagcaggctacaaaacaaccactggctaaagagattaccataactaaaaggaagccaggtgctaatatccgagacgatgaggagaaggcctggaaggcatttcagaagtctttggggctgggcttggttgcttacccttttgggaggctgagatgggagcattgcttgaacccaggaatttgagaccagcctgggcaacatagagagaccccatctctacaaaaaaataaaatataagcaggcacagtggcctgaacctacagtcccagctacttgaaaggctaaggtgggaggataacttgagcccagaacattgagagtgcagtgaatcatgatcattccactgcactccagcctgggtgacaaagcaagacactgtctcaaataaaaataaaaataaaaaaagtctttgagacagcccctcccatcacacaccctgaaagctgggagaagagaattatttcaggggccaggcccagggtcttgcttccctcctcagcttcaggacattgctccctgcaccccagccactccaggtccagccttggctcaatggggcccaggtacagcttggggcactgctttgaggtcacaagccataagccttggcagcttccatgtggtattaagcctgcgagtacacaaaaagtaagagtgaaggaagcttagtggcttccacctagatttcagaggatatctgggaaagcctgggtgccaggcagaagcctactgcaggggtggagttttcacagagagcctctactagaggttagagcccccacacagagttcccaccagggaactgcctactggagctctgagaagggggttgccaccctccagacccaagaatggtagagccagtgcagcttggatcctcagcctagaaaaaggtgcaggcactgaactccaacccatcaaaccagccatatgggctgcatccagcaaagccacagggtagaactgcccaaggccttgggagcctatccctcataccagtgtgccctggatgtgggtcagagtccaaggagattattttggagctttaagatttaatgactctcctgctgagtttcagacttgcatggtacctgtagctcttttctttggtctaatttcttccttttggaatgggaatgtctacctaatacctgtaccgccattgtatctcaggagtaaatactcattttttaaatctcacacatttataggttgaaaagaactcatctccagataaaactttgtgcatcagacttcggacttgggacttttgagttagtgctggaatgagttaagactttgggagactattgcaaaggcatgattgtattttgaaatttcagaagaacataaaatctggggggccagtggtggaatgatatggcttagatgtttgttgcctccaaatatcatgttgaaatgcgactcccagtgtcggagttggggcttagtgggaggtattggatcatgggggtagatttttcacgaatggcttagcaccatcctcttggtgataagtgagttctcacttggttagctcacataatatctggttgttgaaaagaatctgggacttctcctctctctctctctcgctcctgctctcactatgtgatacactggttccaccttcaccttccgccatgattgtaaacttcctgaggcttcactaggagcagatgccaatgccatgcttcctacacattttgcagaactgtgagcaattaaaactcttttctttataaattgtctagtctcaggcattcttttacagtaacacataaatggattaacacattagacaaggtactaaagaggttagataggtggccctgaagttaaaatgtctaaaataatatcccagttctgcaaactgtgtgccttgaggtaagaaactcagcctctttgtgcctcatttttctcaaattcaaaagatggataataatgttacctatagcataagcttattttttagtaaattcatttacaggcattacttgttttattgtgctttgctttagtgcactttgaatatactgtgtttttcttgaattgcaagtttatggcaacctcacgtgaagcaagtgtatctagtgtcaccactttccccatagcatgtgctccctttgaggctctgtgtcacagttttgtaattctcatgatattttgaaccttttcattattattatatctgttttggtgatccgtgatcttcgatgttactattgtaattgttttggggcccaacaaaccatgcccatataagacagcaaacttaattgataaatgaatatgttttgactgctcccctgatcaccccttcccccatctctttccctctccttgggcctccttattcattgagacaaaacaatattgaaattaggccaatcgacaatcttacaatggctctttattgttcaagtgaaaggaagagtcgcatgtccctcactttaaatcaaaactagaaatgattaagcttagtgaggaaggcatgttgaaagtgaagagaggccaacagctatgccttttgcatcaaatggttggccaagttgcaaatgcaaagaaaaagttattgaagtacactaaacctgctactccagagaacatatgaatgataagaaagcaaaacagaattattgttgatatggagaaagttttagtggtctcgatagaagatcaaacagctacaacattcccttaagccaaagcctaatccagagcaaggccctaattctcttcaagtctgtgaaggatgagagagttgaggaagctgcagaagaaaagtttgatcagtcagcatgcatcaacatcaaggcaagacttccaatagtaaaaagataacttgctaaaggttcagatgattgttagcatttttggcaataaagtatctttatttaaggtatgtactttggtttttttagacacaatgctattgtacacttactgaactagagtgtaaacacaacatttatatgtactgagaaataagactttgtgtgacatgctttattgtggtgtttggtttattgcaatagtctggtgcaaaatctccaacattcccaaagtagcctgtatagtgagcctgtatcatgtttagaataatttttgcgcatattgagagctccttaaatatcattactattattgtttatgttattaatcaaggtgctacttatcatataagaaaattaacatccagggaagtgatacgacatttccacagtcagaaagcaattccttcatcagaaaataacactaaaaatttaaaaaataataattgtaacagcaacaaagatttgtataaccttttaggtttgcaagtgccatcagataggaacacttattccacttacaagagaagaaccagagaggttaagagatctcttcaaggttgccaagtaattcgtaataaagctaggatataaacctggataatcaatgtcacagctctctctgtttctttaaaatcacaaggttgagagtagatataagcccccactcacattcccttgtgcctccctaagtccttgacacctgtatcagttccataagaaaggtttgggaagttaggagatgagagtataacaaggtcaacatatctatcagagtgtctgttcatctgcctatcaatcatttgtcttccagttactgtctgtggatctgggggatattaagccctgattgaacttagcagaatgtgcttcctctctctccagagtactgctacagtctgtctgcctcccccagtgctcctttgagcccaccgggaaaccttgaattctcctctgaaactctgagcccatgcccccaagcagatatccaaggacatttgctcacttaatggtctgctcaagacgtttgaggatgcacactatctccctatcagccttctgaaacatgcattatccatccgtccttgaagcaggtcccctggtgcagtgattaaaacagtcctgtgttggataaacccagtgcaattttccaaaagtcatcatctctgcatttcccctgctacagcagagcaccttgcctccaatctctgggcttgctcgtttgttttccttcagacaatcttagagacactctttcagtgacctctgctaagggaagagaacagtacgcacatatccaacattatgcagacacagtgacaaattggtctatattttatgcttgacagaaatgggaggggtgggaaacagaagacacatatcaactcacgatatctttgaccactggtagacagagtttggaaaaaacttgtttttattctttctttttttcttaagtttccttccttatatctgttcccagcctcttcctttaattagtcctggaatgtgacaacagtaggctgcaatcctagtagatatgaagcaatatgaccaagataaattatttagtactctcctaaaccatcttctcttcctaacctctcccccaagcctgtccttagtgagtaaaacaatcattgtccagttaatctggtattcaaatgctggatgcatttccactccactctctacttttttcctcatgtcattaagtcctattgattcttccttagaaacatatttttttgttcacctctcttcgcatttctacattgtgtccctagtacgggtttatgaagggatgattcccctacatctgcatttgtgtaagttttgttatttcaacaactttttgttgcactgcataatcacttattgttttgaatcatattgtaatgaatgtaaagcactcttggactgattatccctccttgcctgtatggtgttgtatgcatgttcttccctgaaaggcacagtcattcagggtttcattgtgtatagtgtctctcaaaccagaaagcaaccaaaaggatgaatggtagatgggtggagaatttatctttagtgatcttcatcataaagggatcatggtggctgggagataattctatgcagttaattgtaacattgaattgttcactttgaaatagattaggagatgcaaagaaagaaatcagaaaagtgatcagctacatcactccttcctctgggtggctatcttccttattccctgtgctcttactgagcccgtcccaccatactctcataactccttattgatgtactcccatacacacaagatactggactccttgtggaaaaaaaaaattctgccttttctgaccaatatatcctcagcctctacagaatttctcagtgtttctgaatagatgcttgatgctttttgaattgagttgaattgtgatagtcattggggctagagactttgtaacttaactttcattttaaaacttccctttttcctctcttgagtttatttttattttgcttctttcttttgaagtatttttctcttctttcttttttttaagaatcctggccgggcgcggtggctcatgcctgtaatcccagcattttgggaggtcgaggcgggcggatcacaaggtcaggagatggagagcatcctggctaacacggtgaaaccccgtctctactcaaaaatacaaaaaattagccaggcgtggtgacgggcgcctgtagtcccagctactcaagaggttgaggcaggagaatggtgttaacccaggaggtggagcctgcagtgagctgagatcgtgccactgcactctagcctgggtgacagagtgagattccatctcaaaaataataataataataatattaataataataatagaatcctatctggtctcagctctattaatgagaaatagaaagaaggagaattgtgtaccaactggtgggccaaagcatcgtactggaggagtatattgcttggaaattattgcactccaagcaggaaaccatagaaggagacaaaactcctcgaaaagtatgagatcacctgtgcagagtgttagttactatagttatgtttgcaagtaaaaaagaaaagctccaatgtaaactaacttattcaatgatagtatttattattcacattatgaaatttctgaatgtagggtagacttccttgcaaatagattcagtgtcttcaagaactggaatcttttctgtccctcctctttattacttttgaaatatgaactttaatatcagactcacttcctaaagttcagaacatggggaaaatgcgatgttgtttttctctgtgtaccttgaccagggaacaaaattcccaatcttgaaatgtgcttcttcctttagcctattttggatgtgtgcctacctttcgatgaataagaggcaccaacacaatgagatacactcattggcttgttggattcctgaacccatcaatggtaaagagagaagagtcagcatgatttactaaaaacaagatttctcaaccacggcactattgacatttaggaaccagtcaattcttggtcctgggggtgctattctgaacattgaagaagcattatccctagcttgctagatgacaatagcactcctcaccagttatgacaaataaaaaaattctccaaacattgccatatgttctcttgggggtaaagttgtccctgggttgagaaccactggataggaccaataaacttgaacatttgagaatcaatcatgatgtccaccataattaacaatccctctcttgactaattttctcctttaaaaaataaactttttaagttgtaagttttattttaaaatgtccattttacttacaaggtctttatcatagtatgccaagactattgcacagtaacaggtcttgttgatgtttgcttcaaaaatgtcagaatgtggagtgtgcactggctgcatgtcctctaaatatcatcctgtttttgcttcacactaaccatgctagtctccaatatggtgccttttcagtatcccaaaaggtgctctttgaggagagcaacctgtttggggatattcactggcattgagagaaagagaggaaaatggagagagaaaagaaaatgagagggggaaatgtgacattcgtagcaagcaatgttattcctactcattagaatagttaccttttttttcggctgggcgcagtggctcatgcctgtaatcccagcactttgggaagctgaggcgggtggatcacaaggtcaggagatcaagaccatcctggccaacaaggtgaaaccccgtctgtactaaaaatacaaaaattagcttggcgtgctggtgcatgcctgtagtcccagctactcaggagggtgaggcaggagaattgcttgaacccaacaggcggagattgcagtgagctgagatcataccactgcactccagcctgggtgacagcctgagactccgtctcaaaaaaaaaaaaaaaaaaaaaaagaatagttacctttttttcttggctttcattccataaacactgtgttcatagggcactgtgttcaatgttttacatgcattatctcatttaatctacaataatacatgtaatttaagcatttgtatatccactttacaagtgaggaaacagaggctaagagatgatttatctttgcctaagctcacaaactaatgcatttatgcattatagtacatgtacactatatgttatatgtatgcacatatataacatatataatgtatggtacatatacattatagtacagcaaactatggggatgccatagaaacacaatttgaacctaacatcctgccccttcaaattcactatcttatagtccaacacctgccaatatgtatgtcactcttcttttatgagtgcatccctcagagctctaaccatctaggattctatcattatgaagacagggatcctgggcacatggagtgagaggaggttgggagagctctgaaagaaaagggaggtcaggggagcaaacgcctgctcttccttatagactcatgtctacaaggctgccttctgacttgtgtgataaatcctgctccctcaagtcactttcttcagcctcagctgcacacaacacagtcatcatcatcagaggggtcatctcctaatggcgaaggacagcccagcggaggaagttataacggatatcacatcctgcctgtatagatctgtcatgcagaaagggctgcgtacagaattctaactctgttccttgcaactctccactgccttccattccttttccaattgccctgatttgaaccaaatttttcaaaagtctcttaactgacctccctgccttttttcttcctctaccaatccattttacttaattggattaatttgttttttcctgaaagacttaacatttcacttccttgctaaaaaataaacatacaagccaaccaagaactataaggaaaagcaaccaagccacggcttcttggctcattgtgcacaattcctggcacaatgtccccactcttccatgatctggtctcatcttagatcccactgctctatcagatgccattacactgagcctcttgcatcagatacatagagactgttcccctctgtgtctttgctcattctgcttagaatgctctcataactctgcttatctaggttgccctgtttcgacaagaccactttttacatgctgacatgctagagtcactatacccattctacagaagacaaaaatgtaagaaacaggatttgagtcatgaagtgtataggttgcagagcagggcaccagaatccgtgtcttcagattttctaattcttcatctgatgtaataccatttccacctcttaatcaaagcataaacatgtacattcaaaaccacacccagccccatttctcacagctactttatcttcagagttcagctggtaataccaatgcagcccatttaagggcattatcaacaaaccttctctcatgctctctttgttctaaactcagaggaattatttccgtgagattaattctgaagccgttgtagcatttgtataggagatggcatctccccttatcttaattgcatatttggaaaacctgccttgtgcttgcttcatatggcatgccatttggtgtttatgaccatcatactggagttaacagcatatggggagctcacccactctgaatactaagcttatccaatctctctcccagagctgacatgagaaataactaataaaaatgattacaatattagagggtcatataaatgccaaatgcaatagggattctttattctaaagtttcttgatctcttcaccaacatcataaaagtgtggaagggagaaggtaagacatcctatataaaaaatgagcacaattttctcaagctttatttcaaatttttctattgaggattaggattcaattttaaggtcaatctgaagatgaggtgaagtttcagggatgactgaactagaaatagtgtgacctttccaaagacctctctttgtatgtatgcatttttccccaaccagcaataataataatataaaaagctataggaataatgcttaactaaatcagatacagatggctgttttatcaagcagaggcaatttttatcattttaaaagcttttgtttttgtaaagggaagaaaatgggacatgttccctcacttttttttttaaagaggaaaaagcatatgttttttaatttgaaatggagtattaatggtgttatctcccgagaattgctgtgctagagtgaattgtggaaaatgcatttacttgcaagctttctggtaaattcttctctgacttagagagttagtggcatattatatcaacctccctttccaagagaatactgtgcatacaatctgagagtcaatttcctgagcctcttttactagatcatcttgttttctttgtttatattattgatttaggtaaaatcatttggtgaatattgagtgttcacctaagtgagaaggtggtaatatgtagcaagtagacagagggttataatgtaactgggataataaaaccttgtatcgctgctgaaatttacagtttgcattatcctatttgaacctcaccatgcacctgagagttatgaggatagagactattgtttcaattttatagttgggaagtcaaagcacagagaacttaattggttttcctgtggccccctcatcctgtacagccagtaattgagccagaattggagccttcgccagtcaatctcatgttccttctgcacagagctgcttccagattaaacttcaaccaatccatccagaggcatttatagagtgcctactgtttagctgtcactggagtcaaaacagtgacagacatagcaaccttttagatgctgtttctgcacacaaggtgcttttcactgactctaaaagacaggacagaaatatatgaactgtttagtgaataagttatgagtatgaacaattgcaggatccatatatgctggtaacatgggaggtcttactgagaaggaggccttttataaagaccctagaaatgagtagaaaattaatgatgagattggctgacattatataagccattactatgttccagtcacttgagttataacttcattcactcattcaacaaacattatctgccttttgagccaaagaaggtattatggagacgtgcaggaaaaaaataaataaattctggttctggcattttaatgaccaggagcatgtgacttcatttcttaggtccttattttattcatctgaaaaaataatggtttagaaaaagtattcaaaagtttctgtgaattgtgaatgaagtaaaatgtttgcaaacaagaattacctcatgataatgtgtttttgttggatttattattattatttttataattactactctttggtaaggactagagatacaaagatgaacaggaaaattaccctagtcttaagaaactccatctagtaaaaaagatcatccatataatttccttaacccattccttcatccttttctcctccctatcttccttccttcgttttttcatcattttcttcctttttcccttcatttcttccctctttccttccctttttccttccttccttccttcttttcaaacttttgttttccacttgccatttcttcctttctaccctccattattattgattcagtgcctcctctctgccaggcaaaaagcaaggtgtttaactttcaggaatatattaggtactgacccagcccgaaggagatctcaatatagaggagaaaataattcacaacccactagtcagacttaacgtgacttaaagagtggccaccagaccatgtgtccctggaatgcaataggaagtccccattactatctactaacctgaatctaatcaatcctctagacatagctttcagattttataataacactataaagatgcaatcagataagatacataacatgggaaattctgcatgacagataacccagtttttctctaaagtaaaaataatgttaattctgtaagagaaaagaaattccttttatgcctagttcaaaaacaggcacaagtaagttatactataaataatagaatggtggttctttacagggggcatataggctcaaaggagcatatggctagacatcatctggctcataatttgtgtggtctaaggagcatgcatgtacttctacagacatggctatgtaaaatgtactgatatatagacttaggatgtgttttagtaagctctaaaccaaaaacatttgaattaactaatataaagagggagtgagaactgttactgattaaagtagacttaataagcatattaaatacattaaatgtgtagatcttgttcagattctgatttgggaataaaaactatacaatgtggaaatattgaacacagattgaatattacatgataataattgtataattctgttgtgcaataatagtaatatggtaataagaatgaggaggaggaggggaaaatgagggaaactgggaagagtcaggagggagaggagagagttctgatctgttagagatacttactgaattaattattgaaatataggataagatgtgtggtatttacctcataggaccctggggcaggggtcaattaactatggtcaatgggccaaattcagctaccacctgttcttataaataaagttatattagaactcacccactctcattcatttacatactgtctatgagtgctttggcatcgcaatgcagaattgagtaattgtgacagtaatttctgccttaaaagttgaaactatttactatctggccctttacaggaacagtttgccaacccctgctggggaaagggagtgggagagaaaatgagaaataaagggaaggaaggaaggaagaaaagagggaaggaagggagggaagggaagggaagggaaggatatataacagtagacaggacctaaggcttatcttaaatacaaacacagcccattatttctcttgctgcccctatttcaagccataaccatgatctggaagtttctagtggtttctaactggtctagcatctctcgtcgtcctaccttcttttctctacactgaagccaaagtgatccacttataatgtaaattggatcgtgtcactgtccacaacccaagagtcattggaaaaaatgtatactttagtctataatatgaccataaatcaactgacatcgctcagtctcatgggctgagttttctcacactctctcttcttgttattcgtggtaagctccaagcctattccagagtcaagaccttttactttatgtaccttacctggaaacacctttatttggctttttgattcatctcatctatcactgaagtctcatcagagaaaccattcaacctactaaaatagctcgcccatccccaattaatctatattgtctattatcgtacactgatttttttcagagtatgtatatttacttgttatctgtatatcattttctcatccactagaaagtaagctacatgtaaatagaaaataacttatcttgtttcttacttcattttcagcccttaggaaaaaataaaacaaacaaacaagcaaacaaacaaaacaggggaagtgaaaaaaagaaaagaaaagaaattgagaaactagatttagagtgagcagatagatatattttaaaacaaagaatatggaaatttgcatgaagtaaaaagcaaaaagctgacagatataagaggctctgcagagtagaagttcaagaaagatggaagaaatagcagttcaccatgattcagctcaccagacatttatgaaacacttactgtgtcaaagacatgatgctaggcacagggggtatagaaatatctaaaccaaattcctttatacacagtctaatggtaataatggtaaggatagttaataatagcaaagttgttaactaatattgataatttcctgttccggtccctgttttaaagattttacgagaattatctcattggcacttatttctcacaacaacatgatgagacatgtactattagaacatacatgtcaagaaaagggaattgaggtgcaagaaatagtgacttattaagagccagtaggtgaaatactttgaaccagctaccaatgtaaaggacagtattagtgaagtatttgccgaatccttctgtacaaatgaagggataggatgatctatcaggacatgtcacagaaggcttcatagatgaagaagggtgaaattagtctgtgcctaatgaaataagaaaggtattgccacctggagattggagtgaggggttctctagggtgatagaaggccatgagtaacactacagagatgtcaaaacacagctaagtacttaactgctggactttagtatctgatagtacttacagttgaaatctcactctcatatgtagtagctctgtgaccctcattaaggtcatagccctgatttctgactctagaaaatgtcatctatctcattggattgtactgaaaattaaagcaacccttgcatttcaagcacagtgcctggcacataacaatcactgaaattttattcagctcttactccttgcattcaggaacaataagtataagaagcatcaagaaatttgtgcaagtctgtaaaaggtaatctgagacggcactgataagccatcaatgtgaaaagtttggacttggttccataaacctagggtttccaatgcacaaaaaggaggctaaatgaactaagaaggaaattccaggcagttgcagttaagaggtgaactcagcagggcacctgaaggaattatgttttatgactcttattatacacagttcatggctaaataaaagaaaactccaaaagcagcctctaatttgagacctataatttgagagcactgcagaggcagtggtactcttttgagtaaggacatgccccaactttgtttgaagtactactcaagcaacagtgtggagaatcgatggcgggggatgagatttaagtcagagggtcaatttgaagggtattgaaatcaagtaagcagtgagtatctgaacaagaaaaatgccttggccttcactcctccatcaaaatactaccattcctagcctctacccactagatgccagtagcactcttctctagtcatgtcaatcaaaaacgtcttcagacatttccatatgtcctttgggtcgggggagagttccattatgcacgttaaacacttttgcagagaatttaagaagacaagggtgattagacaagcatggattcaaagggggaaaaatgtagacacaaaatagaaaacttaaaaaacagaaaatgcggacatcaggtttaattatttttaaatccagaatgtctaaaagttttaaaagtgattttgagcaaccttcagaaccacagaattagctctggaagacccagacatggttcagggactaaagttggtgatgttgctcacaagtctaagaatgttaaagcctgctgccccagggtgatgttggtgacttcattgcaatgagtctcttgtagctgagacagaaagataggcattaaaatgtcaaagtcaaatatcagagactggcattcagaaaggtgatggggggtaaccaattaaaactttcttctgtagtgaaatagctctttctataacacaacagaaaagcctgtcttagaggcttcataaacctgtgtctcccatggaagtatgtattgaaacaattcttcctaacagatcgcattgagctctactgtaaaaatatttgtgctctgggcaatgcagataatttttaaaatgataaagtccttgaacctacatgttctctagtcctataccatccaatatgatagctacaaggcacatgggagatgaatgagcacttaaaaaaggtgactagtccaaattgaggtgtgacagaagtgtgaaatataacacagaattcaagtattacaaatgaaaaaagtaaaatattttattaatatttttgtatttgctatatgctgaaaaataatattttgatatattgagttaaaattaactgtttaaattatttttacctgtactt

SEQ ID NO: 623 - DNA, 201 bp, Homo sapiens
gtgggaggcagcctggaggctggtatgcctagaccctgcccagctgccccaaagctgcggccctgtgaagggcctgagattttaccctgcttgcaagctawtgacctagcctgccacagcttcctggatgctggcagactcctgggccaaaggcaaaggactgtattgctctgggaatgccatttgccccccaccccaagt

SEQ ID NO: 624 - DNA, 201 bp, Homo sapiens
gtcagctcctaacaccaaagggtttctgatccctatgggaacattaataattgacacagaacaagtagaaggcagtgacacagtggtgtccaggctcagcwgggtggcctggtccatggcagcagaagtgtgggtctcataggacagagctgtttctcaatcctacttgtaaagtcaagaattcgggtgtcataagagcgc

SEQ ID NO: 625 - DNA, 201 bp, Homo sapiens
tgttcagcttgtatttcttgataataacccccctcctccaaaccaacacagatgtacacacccaatcagcgtgcatgactgctgactggcactctttccartgactgtttattgagtgtcaggaacacaactgtgattatacaaaatgaagtggacaaacggtcttgcacaaatgacgtacatttcacagttaatcgtgaa

SEQ ID NO: 626 - DNA, 201 bp, Homo sapiens
aagggcctgagattttaccctgcttgcaagctaatgacctagcctgccacagcttcctggatgctggcagactcctgggccaaaggcaaaggactgtattrctctgggaatgccatttgccccccaccccaagtcccccaaggaggtgatgtgtgacaacccaatttatgatgtatcatctgtatcacagctgaggaaccc

SEQ ID NO: 627 - DNA, 201 bp, Homo sapiens
aacgaacaaatgtaacaaagtagatggaaaatatttatgttagagaggctgacttagcactaaaagtaaatgacctgataggatgtattatctgcacttaycagccatgtgtgttgcaacctgtcctgggatttgcctcccaaaccagattttcagggcacacagcacagggcccttcatcatctttccatggtaacttac

SEQ ID NO: 628 - DNA, 201 bp, Homo sapiens
aacaatacatgtggagtgagtctgaggttgataacgactcttggtagcaataaacaaacgtgaaattggcatagaacctggctgcaaggaaataggataartgtgacagaaaataagaaagttggcagctatgagactacagtatttcaggggctcacatggcatgaacgcctaagtcgtttatgcaaaaaggttagtttt

SEQ ID NO: 629 - DNA, 201 bp, Homo sapiens
gatgtccagaactgccacagagaattgcccaacgcacaccagtctagcatcccctgtgccacctggctgggaaacccactttatcaacataagagggacasagtgccctagggaaaaagagaggactgattttcatgtgagctgagcaacctccccaagttgtgaaggttgaggagcccagccacacttccccaggcttgt

SEQ ID NO: 630 - DNA, 201 bp, Homo sapiens
gattttcatgtgagctgagcaacctccccaagttgtgaaggttgaggagcccagccacacttccccaggcttgtagacggggccagcatgcagctcggtgwggtctggagcctgctggtcacatctgtcatatgtgaggctaagctggcaagtattttgtaaattgtcaccaataaacaaaaactatgcttcactttgtga

SEQ ID NO: 631 - DNA, 201 bp, Homo sapiens
caaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttca

SEQ ID NO: 632 - DNA, 201 bp, Homo sapiens
tagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctca

SEQ ID NO: 633 - DNA, 201 bp, Homo sapiens
aaagtattttggagttttgtttccttttttaaaaacaaaatgctttttaactgttcattgcctatattaccaaatagttttaagttgtacattcaggttcrgctccccttttttgagtacccaccatttatgttaagtatattactgggttctttaacagatataattgcatttggtcctcataaagcctatgtgagataa

SEQ ID NO: 634 - DNA, 201 bp, Homo sapiens
gctacttattaatctgttttatcaagagacaacattaaagttgtaagacacaattagaatagaaaattttatgtgtaactttatgttctccccttgacttrtaaagattgctattgaattttagtattggaaaactttggccaatgtaaagatgattttaatttgaacatgtacaacatgcaaaagaatattttttctcct

SEQ ID NO: 635 - DNA, 201 bp, Homo sapiens
tactcacaggagccgcggtctcgggcttggacgctggggccttaaaggtggatgtcgtcctggccgaatctgctctcctgtcggcagctgcccccatggayaagcattccaagtagtcgggtggggggatgacaacactgctattctcagacaagttcacggtgctgatgcttctcactggtgtggggctcaaacccaaaa

SEQ ID NO: 636 - DNA, 201 bp, Homo sapiens
ttcttcttaagaccctgctctaccacacccttgcttcagcaagtgtatgtaaaacagtcccaacttgagacagctcccatgcacagggattcccctcaaamccccccgccacttgtgtgccttaccttgcattagactgtaatgtcttcccagccactttcctccctcccacctgaaaagcctagctttcttgttacagct

SEQ ID NO: 637 - DNA, 201 bp, Homo sapiens
tagtcttcatggcccaagtctgtagccacctctggtgggtgtcactctagataggatggagatgtgcctgatggagtctttggaaataacagccaacagarcagctggggggtggagaatgggtatcagtgagctctgggggcctggttcagtgtacaaacttaaggagacgaatgcacgtgaaaggtcacaacccctgca

SEQ ID NO: 638 - DNA, 201 bp, Homo sapiens
agtgctgggattacaggtatgagccaccacacctggcccacttttgccttccaaatcacatgcaaacttctctgtggccaaccctaacccacaccctctarcctagtttggttgactcagtataaagctaccacacgtgagctaaccagagctttcttgggacgattaacttggcagcagcccgtgaaggatagatggtca

SEQ ID NO: 639 - DNA, 201 bp, Homo sapiens
gcttcttttctggctggtccgaagtctccagagcagtcagattccctagaggtttactttgagagaccttgcctgccatttgggaccctcttcccctgtcygctactggttgcctccactgtgacagctattctagtcccttgcctggctagctgctgacacaacttctgctcaccttggctctgctcctgacaatcatga

SEQ ID NO: 640 - DNA, 201 bp, Homo sapiens
tggaggcaaagaataatcaatttcctatagctaaaatagaaaaagaccaatatattgatttgtttaggaactaaattaactcccaatgaatcagcacatayaaatagttgaaaaataaaccagtctcttaggtgtattcaaacattaattacttaaccatttttatttatttatttatttttgagggtctcgttctgtcac

SEQ ID NO: 641 - DNA, 201 bp, Homo sapiens; identical to SEQ ID NO: 107

SEQ ID NO: 642 - DNA, 201 bp, Homo sapiens; identical to SEQ ID NO: 108

SEQ ID NO: 643 - DNA, 201 bp, Homo sapiens
tggggactcaggaggcgcctcccctgaagaccctcttaccaggttgataatgatcccccgggggccaggagctgcataggccacagagagggcgacaagcrggaggatcaggatcttctccatggtgagtgggacagctggtgtgggtggcgggagacagagccagctgtggtgatggggctataaaaggggccctgacct

SEQ ID NO: 644 - DNA, 201 bp, Homo sapiens
tcaattatataaaaccagaggacaaaaaagttgaaagtacaccaacaagccttgtcacatgtaatgtacagcaaaaatacaatcaggagaagggcacaatrcaacagaaaccaccttcaagtgtacacaataatcatggttcatcattaacaaaacaaaagaacccaacccagaaaaagacaaaatccaccccatcaagag

SEQ ID NO: 645 - DNA, 201 bp, Homo sapiens
acagttaagaaaaataataagatgtatttgtaaatttttacataatgaaaaatgagatgtatttgtaaaattttaaaataacctctttataaatacgtttrtaaatataaagaggtaggatgttttggctaattagcacattctgggtcatacacacacacacacaaacaggccaaacactctagatagtcaaataaattc

SEQ ID NO: 646 - DNA, 201 bp, Homo sapiens
tgagaactgtagggaaacttgattttcttacccaaagggtattttatcactgggaaataaacaagtatcagatgcttataaagtataggctttcaattccsctggaactagtgttaagcatatacaagaagttataaaggcatggatgattgaaataattaaggaaagtgtatttccactgtatatactacctagccatgc

SEQ ID NO: 647 - DNA, 201 bp, Homo sapiens
tagtggcctctcatagcaatggaagacacctgagaaatcacagagctcaatcactggggcccagagagcagatcttaatgctagattgtaattagaatttmaatagatgaaggccactttgtgttgagaactgtagggaaacttgattttcttacccaaagggtattttatcactgggaaataaacaagtatcagatgctt

SEQ ID NO: 648 - DNA, 201 bp, Homo sapiens
attcttattggaaagtgaggctatctgaaaaggcatagctgtaggcaaattattgcaacatgtttacatcttaaataactttccaacatctttgttactcmgtctgcatgttgataatttcatttattaaatatagaacttcaactagatgagatccataagtaatttacttaagacataaactcaatacatatttaattg

SEQ ID NO: 649 - DNA, 201 bp, Homo sapiens
ttatataaatccagcctggtaaatactagccaggcagtggttcatcaccatcacttggccaggacattttacctgaattacagaatatctgtgatcaggcygaagtcagttcagagtcaagctaagtttcagtttctcttctctgcgctctttgacttccagggcccggattactcactcaatgagggtcttatccggaac

SEQ ID NO: 650 - DNA, 201 bp, Homo sapiens
tggaagtagaatggcagtaactattaaaatcataaatgcacgaaatctgtgaccaagcaatccttttaagaagtttgttttttttttttttttagagacaktggaggggtcttgttatgttggtaaggttggtctcgaactcttggcctcaagcaattctcccacctcgtcctcccaaagtgctaggattacagtcatgag

SEQ ID NO: 651 - DNA, 201 bp, Homo sapiens
cctggtttttggaaggagggtaattaaaaagctgtttaaatacttggtttttctgtttcctatatgcatgtgacatgactagaagccaaatttgcctgctrtagcaaaaacctctatggggctttgagctgcttctgtccaagcctcgaatattcaagaataatcttagctgcagttgcctcttggaaatttaacagtatc

SEQ ID NO: 652 - DNA, 201 bp, Homo sapiens
tccttccaataacatgtaaaaatcatagaaaccacagaggcattcctttgtgtatattaattctcgatagtaaaatgagtcacccaaaggaaaagccatarcattcctcagatggccaaaattcgttgtcaagtttatttttaatgttgagagttcttggttatttccatctaactacattagatggtttttttccatcgt

SEQ ID NO: 653 - DNA, 201 bp, Homo sapiens
actggtatcttgaatagctaatggtatttaacatcttttcatgtgcctcttggccatttgtatgttttctttggagaactatctattcatatttaaattgmgccatttgactgtttattattgaattataatagtactttatgtcctacacacaagtcctttatcaaatgtatggtttgcagttattttattctgttagtt

SEQ ID NO: 654 - DNA, 201 bp, Homo sapiens
tttctgttagacataattttttttctcatccaaagaaagctttgtttctctgcttcacagtagaaatgctaaaaaaaactttcagattttagcttgatgtrtataaaattcatagagcaaatgtagaatattatataatcctatagaagacataaaaaaaatgaaacctgtgtttgggagggagagtgggagaggaataca

SEQ ID NO: 655 - DNA, 201 bp, Homo sapiens
ttttaccagttagattttttttttgactgtaatcagctttttcatcttttatagctttagggtattttatcttaattagaaaaatctttaccacttgtagkttataaatctttcattttcttttgtagtattttaatgattttattttttctataatgaagtattttatatttatcctggtttagaatattggtagctatg

SEQ ID NO: 656 - DNA, 201 bp, Homo sapiens
ccagtaatgggattggaagagcatacagttttataactacaagaagaatatatggtactttcgttgtcattcttagcatatagtttagtttaaggctttakaaatgccctaaaagttatacacttaagatttaattaaatgtaaccggttttctgctccatttttttctattatgcactttttaaagtttttaaaattcag

SEQ ID NO: 657 - DNA, 201 bp, Homo sapiens
ccaagctcacgccaccgtactccagcctgggtgacagcaagattctgtctccgaaaaaaaaaataaataaataaaataaaaatacaaaaattaggcggatrtggtgctggacgcctgtaatcccagctactcgggaggctgagttaggagaatcgcttgaacccgtgaggcagaggctgcagtgagccgagatcgtgctac

SEQ ID NO: 658 - DNA, 201 bp, Homo sapiens
ttcttactacacatgagtctaaggggccaagttaaaaatagcattttttaagaaacataaaattcatgctcacaaaaattcaagtggtgcagaaatacgaygcaaacatcttcctatactcccattctatacaaaagaacattattgattttaattttgtttccatttttacaaaaatttaaaacaatctttctacttggt

SEQ ID NO: 659 - DNA, 201 bp, Homo sapiens
gagaaaaattcagatgccctagtcagtcttaattctggcgtaatgccactggttattcctcctaattcggaaaacttagctcttcctgccctttcatttcytcattcataaagtgaatacgaccaccactgaggtccagggccaaataactaacagaaatattatgatgaactttgcagacatccagcccagagtcaggga

SEQ ID NO: 660 - DNA, 201 bp, Homo sapiens
aaatttcttatgtttctatttgtttggcaactttaatttattctattcaaaatgttttaaccattttcattccatttgcatctcatttagtgaatttcatsgtagtctttcttttataagcaatgctaagttacgtatcaggcattttccaggctttcacagtgaaaacataaaaaatagtttttttctaaatttttatat

SEQ ID NO: 661 - DNA, 201 bp, Homo sapiens
gccagcctgggtgacaagagactttgtctcaaaaagaaaaagaaaaaacaaaaaacaaaacaaaacaagagtttcaggtctgggacaaaccaatcacctcyctttagttctccccttgaaaaggtaacttatatttttgataatcgtcttaacaggagcgttattcttggcttttcaaagaaacaattatggacaattgaa

SEQ ID NO: 662 - DNA, 201 bp, Homo sapiens
agataccacaaggatgaaaccagtgccactagttttttcctgtgggagcccattgaaacctcaaaactacctcattttagatgaaggaacatggactcagytaagtagttctctgaaggacacagagctggcgatcacagattcaaacccaggactttttggtgtgagatcatctctagacatgaaactaaacagtgggtc

SEQ ID NO: 663 - DNA, 201 bp, Homo sapiens
aactcctgacctcaggtgatctgtccacctcaggtgatctgtgcacctcagcctcccaaagtgctaggattacaggtgtgagccacagtgccaggccgatkctgtgatcttgagagagactgttgatatcctactatagtgagctttgcttttgcttagagcttcatcttattttgggtctgggtaggcaatctgaaaaga

SEQ ID NO: 664 - DNA, 201 bp, Homo sapiens
tgagagagtaactcatttgtaggcagtcaaatcttgcttctccatagattgtgtgagactcgagtaaatgaatttagaaactaaagaaataagccttttcygaataactggtctcatctcaacaaaaacagcctacataaaggccgggcacagtggctcacacctgtaatcccagcactttggatgaccgaggtgggtgga

SEQ ID NO: 665 - DNA, 201 bp, Homo sapiens
ttccttatttggatctggatgttgagtggtatttaggcatgtttttctatgactttaagcaaagcaacatataatgaaaccaatatttttctcatcaacgytgtagcaatattgagcgatattcggggaactgctctaggtggtttcacttataatcagtttctaacagcctgttgacatcaagtgagaaatgactatact

SEQ ID NO: 666 - DNA, 201 bp, Homo sapiens
gcctggcagagattatattctttaggaaagaatctctgtgtgtgtatgtgtgtttgaggaggttattctatattatatatataatttccacctctgccagktcactaaccaagataatttggtaagcagagtagctaagatgttttggagatagagcaatagtaaaatgagaaataactgtagagggaacttgagttaggt

SEQ ID NO: 667 - DNA, 201 bp, Homo sapiens
taggtgttttatgtatgtactctctcttctccgttataggaacctgttacattgtaaccaagttacttgccatttccccttgccagcaagaacgttgtttkcatttattccaagtgtgcaatactattgaataaatataaaacatagctctcatttttcacaacatgaacagtattgtaatttatctctaacactatttaa

SEQ ID NO: 668 - DNA, 201 bp, Homo sapiens; identical to SEQ ID NO: 113

SEQ ID NO: 669 - DNA, 201 bp, Homo sapiens
agatgaaggccactttgtgttgagaactgtagggaaacttgattttcttacccaaagggtattttatcactgggaaataaacaagtatcagatgcttatamagtataggctttcaattcccctggaactagtgttaagcatatacaagaagttataaaggcatggatgattgaaataattaaggaaagtgtatttccactg

SEQ ID NO: 670 - DNA, 201 bp, Homo sapiens
aataggtaaagatctgctaagtaattccctctgtatctgacatgcatgttcattctaatgaaataattagaaggtcaggattttacaatatgaataataarcctgtaatagtaaaataatactaatagggccgggcacagtggctcacacctgtaaccccagcactttggaaagctgaggcaggtggatcacttgaggtca

SEQ ID NO: 671 - DNA, 201 bp, Homo sapiens
tgtgggggtttttaggtcaccatttgtcctccttacaggtctcctttctccgtgttttatgccttctgtttaagctcagcctttcccggtccttactgctrtcatctaatcacccctgggatgtgctgcttccctgaggatttcagtatcagtttcatagtctctggggtctcagcatccacactgacccttccaggtttt

SEQ ID NO: 672 - DNA, 201 bp, Homo sapiens
catgctctggccccatgttaatccccacgcttcactgcaggcagcctctacctcttccaaactcccccggtcatggctagagaaagtcctaagactggatkcatcacttccactacagatccactctcctgtctcagctccgtctttccaggctcagtaatctttcgaatcatccgttagtggccttgcatctcaaacaac

SEQ ID NO: 673 - DNA, 201 bp, Homo sapiens
ggaagctccaggccagcgcccaccagcgtccctgcaggaagcatggcagttgtatgtgaggaagcccaggccagcacccaccagcgtccctgcagggcagrcgtggactgtgaatggataaaggaaggtggaagtctgtcccttgtgggtgttagggggcctgggcaatcaaaaccagggaatggcaggtggcactgaggc

SEQ ID NO: 674 - DNA, 201 bp, Homo sapiens
tggtggagcctgtctgggctgaggcgatgctgggcttgccgtgccgagatctcatgccagaagtcctccctcggagctacctgtctccagcctcattcttyggcatgttgactcctggaattgaggggctatttctaagatgcatgctttttcggcttttctcatgggtgcctcatcagcctgcacaggatcccccatctc

SEQ ID NO: 675 - DNA, 201 bp, Homo sapiens
tgttcctgacaggctccttggttgagcccagccccactgtgtagtagctgccacgtgaggctctcgggggacctggctatcaggaatctgtctccagcacyggtcccctgtgtgcactgaggacgggagtctggagcccaggggcctgccacagtcccgcccttcctccctgccctcggtgctcctcagaggtgctgtcct

SEQ ID NO: 676 - DNA, 201 bp, Homo sapiens
tggagcatctcctactttttcctgcctgtccagttgctggagggacataggagcttgtctccgcttcttatcactgtcatcttcttcctcctctccactarcaggcatttggtgttcacacactgtataggacgctgggttagggactgaggtgaagactggtcccagagggctccctaaatagcaagaggccaacaggcc

SEQ ID NO: 677 - DNA, 201 bp, Homo sapiens
tcttttgaaatttgcatagctgcaatcttattgagggtattacgcatgtagtatcccagcagaggccctgaaaaccaggacgacgattgctcttcaccacragattctagctgcatttctaactgaggacaaactaagaaggaaggatgcatggctcctgtcctagtgctaaagggagagctaacggatatggtaagtctg

SEQ ID NO: 678 - DNA, 201 bp, Homo sapiens
ccttcccttggccacatctgatctcaccataggcaggaaacctgcagcctgctcctcgcgagcgtccatgaggaaacttgcagggctggtagaaagaaagsgggatttcccttcagtctcagaaaattctgctcaaggcctgtgggaatgtggaggttgctgcctaagccagccacaacctcatgggccctaagtccattc

SEQ ID NO: 679 - DNA, 201 bp, Homo sapiens
aggtctttcatgcttgttttgaggatccagaataggagttctcggtctcttcgttcataatagggagctactttcattccccttaacccttgtgatcaccrcagggagatgcgtcctgacaatgaaacggtggagtgggggagtgagaaccttctttttccttaccactttctgtctcatactacctatgttttttttttc

SEQ ID NO: 680 - DNA, 201 bp, Homo sapiens
aggtgacatgtggagagttcagtctgatgatctgtttagtaccttcgatctcagaccaacttcttttccattcaggtcagagagaacctctgggaagcagmatgaggcgctcgttttcttgtgtggggatatcccatccacgcatgtgctgtacgtttgttcctccctggcaacctggatccaagtggactcacttttcag

SEQ ID NO: 681 - DNA, 201 bp, Homo sapiens
agttcagggcaaactatgagaaatgtggtcatggacacaggtggggcagctggtgtggggttttaaagggaggcagaaagactgggttcacatgaagaaaygaggaagcatgagagatggcattctgtgctggagaataacatgacacaaaagaaaagagtttgagggaaattatttaacagctgttgtcaaggtgagctg

SEQ ID NO: 682 - DNA, 201 bp, Homo sapiens
cctcattaagccttgttctcctcattgagatcgagataataataccttctctgctaacctcagaggttgctatgagggtcactatgatgagggactccacmacaagaaaccacagtcatagtgtttaaaggatgatttgcaaggcacgattaaacaacaacacaagatttactaaggttaccaaactggaagtgcaattcc

SEQ ID NO: 683 - DNA, 201 bp, Homo sapiens
gagaagattctgaattttgaggctcagattatgccacctaactgtgatggtgaagcacgagagatcatcttacagtgtaataataatgagacaagtttccygaataaatatatatatatgtttgtatatacatatataaacaaatatgggcttctgtttttgttttattttggttttgttttgtttttgtttttgtttggt

SEQ ID NO: 684 - DNA, 201 bp, Homo sapiens
tagcctcaatcttggggatcatggctgaaacacatgcacgaacttctgtaaatgtcttagaatcagtgaccccaaacctgaacctgcctcagtttcagaawcaagtggcttccaagatagtacctgtagtaattctggagcttgttggtcccatcaccaagaataccatcattaaagatattcttcaggtggcctggtttt

SEQ ID NO: 685 - DNA, 201 bp, Homo sapiens
tgcctcttcagcaggttcacggagaagttgtcactcaaaggacgaccaagaaaccaacgtgcgcctgctgagccctgccaaggattatgctctgagagccrgaggccgttttgtctctgtacagagggaactttgtgcaaattctctggaaccagagctccttcccttggccacatctgatctcaccataggcaggaaacc

SEQ ID NO: 686 - DNA, 201 bp, Homo sapiens
gcctctaagcaaacatgtagacaccaggagaaggttcctggaaaataacaagtgcccaccgacggcgcagaaacccaagaatggaaatacagctttccacrgcctttctgcctcttcagcaggttcacggagaagttgtcactcaaaggacgaccaagaaaccaacgtgcgcctgctgagccctgccaaggattatgctct

SEQ ID NO: 687 - DNA, 201 bp, Homo sapiens
gaatgattttttgccatttgcatttattgcataaacatatttagcaggtttttggaaacttcattctaatttcactggtttccatttttaccaaaagttcytttgggctgtgatagtccattcttaaggctttaattttgaatcacttcttagttggtgtataccttcaagaagatgtttcaacaaggggtacatgggttt

SEQ ID NO: 688 - DNA, 201 bp, Homo sapiens
gactgataagccctacgtgctggcagtggagatggctctgttggaagcagaggatggtagctggtgcctacatttcccgctggtagagcccctcccccacwtttttttatttttgagacagagtctcgctctatcacccaggctggagtgcagtgatgcaatctcggctcactgcaacctccacctcccaggttcaagcga

SEQ ID NO: 689 - DNA, 201 bp, Homo sapiens
ctggggaacggaatatgcagtgtgcatactttcacactgaaaacgtaaactgataggaaggaaacaatttggccaattttactaagtataaaacttccttrctgcttgatccattaatttctttcttggtattgatcatgaaaatcactgatagaaactaagttcatacaaatatgtacattgtggcatcatttgcaacag

SEQ ID NO: 690 - DNA, 201 bp, Homo sapiens
ggccagtgagcgtggcagcgccaccactgagcaggtgctcctcaaacagtcagctagaaggcccagagtacgtgccaaaaactccactctgaaaggggaaytggcctggtctctatgttgagtgagaggttgcatcatgtcaatgaggtaatgtctccaatttatacaacatacagctcaggtctgagtgtgtcttgcctt

SEQ ID NO: 691 - DNA, 201 bp, Homo sapiens
ggccaattctcatttaaacgagtcattatcctcagagcagtttgccatgagcagggttaatttataaaatcttgtctcctcattctctacagaaagaaatygaagctctccaagcaaggatgtttgtgctggaagccaaagatcaacagctgagaagggaaatagaggagcaagagcagcaactccagtggcagggctgcg

SEQ ID NO: 692 - DNA, 201 bp, Homo sapiens
tagtacataccaggcaagctcagtaatgttttttctttttctgaatgaatgaatgaaatggggtaggagtaaaaggagacaaacatagcacaacatatatkaggatcagttactcattttcttttctaagaaatgcggaggcagtgcgaccctgtgttaatatataaataagaacatgcagcttcacgcttctcctcattg

SEQ ID NO: 693 - DNA, 201 bp, Homo sapiens
ctgagcacttacacagtcaatgtgcatcattataacgtttggatagctgaaaatgtgaaatctggtttttgatttttaataacatttgccaattaaaggtytacacaattcctgagacagtcagagtgtacagaaaataattttagccctgggcacttagtgtttgaagcactctgggaaaggtacttgaatattcattta

SEQ ID NO: 694 - DNA, 201 bp, Homo sapiens
aatataaacggcttctggattttctaggacacagactcattgaatcattctataaatatttgccaagcccctactaagtgctgggcactggggccctcacsatgagatgagctcagtcccttccctccaggttcacagtcaggaacgagtaactgcaaacaggctgagactctgcagcccagaggaggaagtgcgtttcgt

SEQ ID NO: 695 - DNA, 201 bp, Homo sapiens
gaatggattttatcctcctttaaattattgatggaaaaggccaagatttttcccgtactggggtggtgccgatggagacctgtatgacactgtgggttccrggtgtgatcttggacacctgaatccccattggcactgagtgctgttctaacattctaccctgcatgtttttatttcttgcccctgagggatttgctcatt

SEQ ID NO: 696 - DNA, 201 bp, Homo sapiens
ctgggcctggggggcaggaggttgaaatccccccaggctccagaccctgaagaagaggagaacagggactcccagcagcctgggaaacgcagaaaggactyagaggaagaggctgccagtcctgaggggaagagggtccccaaaagattacggtgttgggaagaggaagaagatcatgagaaggagagacccgaacataag

SEQ ID NO: 697 - DNA, 201 bp, Homo sapiens
ccaggtaccgctagagcgacatgatggtggaatctgcctcggagacaatcaggtcggctccatctggtcagaatggcgtgggcagcctctctgggcaagcmgatggcagcagcggcggggccacagggacaactgcaagtggcacgggcagggaagtgaccacgggtgcagacagcaatggtgagatgagtcccgcagagc

SEQ ID NO: 698 - DNA, 201 bp, Homo sapiens
ccttacaaatcgaaggctttggtggagcctttcagataggaatgtctttgccctgccacttgtactgatctcctccgagcacccaagtgttgtgctaagargccttgaatggtccctagagttggggtaggcagcttctaggatgtcacagtcattgagggagactcccaggccaggaactcaggcagagatgggggtaca

SEQ ID NO: 699 - DNA, 201 bp, Homo sapiens
gccttggggaaggaactagagaaatcacagtccagtctctttccgcagtttctcattgttacctacaaggccctcatctgtcagtcgggtcagggagaccrtgtggttatagggtgtgcctaggccaaaagagatcgaattgggaggaaagaaactggctggcttccacgggccttgctaaatgctcatgtggcttctatc

SEQ ID NO: 700 - DNA, 201 bp, Homo sapiens
tctcaaagaagcaaaaggaaactccccttgagcctgaagttattggctcccttcagcgttgcctcccaggattctctgtggaaatacacaccttcagtccrctgccagttccaccaagccgggatcacagcgggaaccctctttcctctgaattctgccactttggatgctgtggtcttgtgagatgttgctcctgggccc

SEQ ID NO: 701 - DNA, 201 bp, Homo sapiens
tgttgggttagcaacttctgttggggcccagtaatctgtgttttaacaaactctccaaggtaactttgatgcactcaggtctgcaaccccctgatttaacsttgtggtccgtcattctcatcttctactccgtgctattgtattttaagaaatcttacctcttattgcaatctgcttcctaatctttgttggaattataaa

SEQ ID NO: 702 - DNA, 201 bp, Homo sapiens
aattcttttccctgctgattagaactggggatacagaggagaatttggggaagggagatgaatgttccttctgagaaaggatttatcttgaggattgaagyggggaaggctgcatcctagggtcacctcatcagggcagaacttggcctggaaccctcagtgggagagctggcttttcccctgggggagcacctttattct

SEQ ID NO: 703 - DNA, 201 bp, Homo sapiens
ccgaagggagtgaatacttcccgaatgccaactggatgccaaacattggtcctttaatccccctagtaatttggagatgggtagtttcccagttttgcagrtaaggagactgaagtgcagagaactggaataacttgcccaaggtcgcagctggcaggccgcacagctgggattcagacccaggactgcctaaggttggag

SEQ ID NO: 704 - DNA, 201 bp, Homo sapiens
cgctggccctaagtagccactctagtgccatctgcaaactcgataggaagtggggtaggagagggtctgtggaccacacgctggtcccattctcctcgtaytctctgtggctctccaagctcctctgcctttgtctgtctgttggtccttgtccctctgctctcagtaaacaagccctggaaatgcaatcctggcctttgg

SEQ ID NO: 705 - DNA, 201 bp, Homo sapiens
gaccatccggcatttgttcaaggtaggcaggactggtgggagcagaagttactcaagtagcagcaaaggggtggcaaaatgatggcgacttgaaggtaggrtggcttagggaatggagccagggactcagtagttgtatccatcctacgaacacactgtggagcgcctactgtgtgctggaggccaggctggtgaagggca

SEQ ID NO: 706 - DNA, 201 bp, Homo sapiens
tctcagtaaacaagccctggaaatgcaatcctggcctttgggagtaatgagttgacagagaggagagagataaacagggcgagtcagaagtcaggcctgtkacaggactttaggctgaaacaaacagtgctgaagagggtggccacgtcactttggaacaagagcaggcacttgtttccatgcaacgagcaggctgggagc

SEQ ID NO: 707 - DNA, 201 bp, Homo sapiens
ggacaacagcaaacgttcccccaaaccagaaaggggctgctgacccaggggtaggagggtaggagcttgatggtagtgggagggactggggtaagacatcyagaaggactgctcagctggggattaagggtcacagatctgaaataattgagagctgaagggagactatggaatcttccttaggaaactccctccctccaa

SEQ ID NO: 708 - DNA, 201 bp, Homo sapiens
ataccttccttgccttctgcccctattcctaagtttattatctccaaggaggtcagatccttgtcctgaagtagggcccagggccttgaaatgttcttctrtgagctcaagattggtgaggggataggggagagcaaggactgggctccccacccgagcagaagagtgcatcttgagcctgagtgcagtggataatgaagg

SEQ ID NO: 709 - DNA, 201 bp, Homo sapiens
ggttggatattttgactgcggttgaaggaaagctcacaggtgctgaccgtgtctcccccactccgcccaggcccctggtggacttgtacagccgccggtayttcctgaccgtcccgtatgaagagtgcaagtggaggagaaggtgcacttggtgtctgggggtgcggtgggctcctgagggccctgtcttgaattactggg

SEQ ID NO: 710 - DNA, 201 bp, Homo sapiens; identical to SEQ ID NO: 130

SEQ ID NO: 711 - DNA, 201 bp, Homo sapiens
ctattgctgtggtaaaatgtatgcaatcggaggtcgtgtttatgaaggtgatgggagaaactcactaaaatctgttgagtgctacgacagtagagagaatygttggacgactgtttgcgcgatgccagttgcaatggaatttcataatgctgtggagtacaaagagaagatctatgttttacagggtaggtgcctaagtga

SEQ ID NO: 712 - DNA, 201 bp, Homo sapiens; identical to SEQ ID NO: 133

SEQ ID NO: 713 - DNA, 201 bp, Homo sapiens
aaactcctgacctcaagtaatccacccgtctcagcctcccaaagtgctgggattacaggcgtgagccactgtgcctggccagaatcaagctcttaacaatyctgccatcaagcccaagtaactccttgtaccttcccaatacaaacctcccaattcaggttgattataatattatctgttatattgtgtcatggaatgaca

SEQ ID NO: 714 - DNA, 201 bp, Homo sapiens; identical to SEQ ID NO: 131

SEQ ID NO: 715 - DNA, 201 bp, Homo sapiens
tatcatgtcttcttggggaatataccctttcataattatgtaattgcttctctttatccttgataatcttttttctgaagtcttctctgtttgaaattaayatagccactcaagttttcttttaattactgtttgcttcatttatctttctccatcccttctcttttaacctatcctaatctttatacttaaaagggcttt

SEQ ID NO: 716 - DNA, 201 bp, Homo sapiens
agatcctctctggaggacttacacaccctcagcctaggccttatgagattcccatcagtctctctaaatatgggctcacaatacaaaatttaaaaacacamaaggaaacatgcctccaagaacaagaatccaaaggaaaattaaacagcagcataagacaacccccaacaggaatttcagataatagaattaatgtacata

SEQ ID NO: 717 - DNA, 201 bp, Homo sapiens
caacagattcaggtctgtgcacaccagctgggtggcgtccttctgactcaatagcacagcagaggaaataactggcacaggaggcttcgtcgggtgcagarcaaggggaggctggggagcctcatgcttccgcaagttacttaaaaccctttctttagctgaaagaaaattaagtcatatatactgagcaatcaggtgaat

SEQ ID NO: 718 - DNA, 201 bp, Homo sapiens
aaccgtctgggccaggttggtcaaactatcctcattgtaaaaatgctgacaaggaagccactccaggtagcaaattatccaggctgtcaaagccaccaacrtgggaacatgatccgtgaggctgcatggtcttacctggcctgctgttgcaacagattcaggtctgtgcacaccagctgggtggcgtccttctgactcaat

SEQ ID NO: 719 - DNA, 201 bp, Homo sapiens
gcagttctggtgaagtcaggtaaccaggggtgccagagtggctctctggcagcccttcactgccctctgctggaacacggagggccttgcttgcagcatgrtggaagtcagccacctcggtcaaacgtctcttcatttctttcaacaaattgatatgagcaggactttgaaaaaaccttcttccaatacaaccatctatgg

SEQ ID NO: 720 - DNA, 201 bp, Homo sapiens
gaagggtgaagtatcatgcccaaattcacataatttcctagagtaaggtcaaaatgagaacgccagtttgcaaatttctaatccagagtgctctctactaycatattttatttctcaaaaagagcttctcctaagagccgtagggactctccttgtctggatattcccacaaggtatcacagcaaagaggagactcaaaag

SEQ ID NO: 721 - DNA, 201 bp, Homo sapiens
aagaggttgctaagtagttctctcctccagcttctggctcagtgaaatagatggccactttatgaacacataccaggagggggatataacagaggcagaarggaatatcaaagactctcttggcttatctaaaatattcacagagaaagccgtccactggttaaggctggttaaaaataagttctccttcaacaagcaaca

SEQ ID NO: 722 - DNA, 201 bp, Homo sapiens
gcacctccaagccaaacaaaggtgagctcctgatctcctccatgcaaccaacctcccacatcacatatggatccctacaaattcttacaaattcttacacygcatgtaagaatgggagtagagataattgcttaaaggtattcagctactaacaacttccaattaaaaaaaatatacagtcagaggaaggttatgtttatg

SEQ ID NO: 723 - DNA, 201 bp, Homo sapiens
tgaggatggaactgaactcaaaggatgtcaggacaccatggtctcatgtgtatttttcttgtttctctggccctatactctcagtcttatttctctgtgcsttaaatgctgttatctctcaatgttccatcttcagtcctcttcttaatctacatattctcttaccactaaatccacatatccgactttgcctcattcctg

SEQ ID NO: 724 - DNA, 201 bp, Homo sapiens
gacacatggcatatgtggggagggggagaagagcatgcccattatactgctctccctattttcctataaaatggaattttttcataataacaggtgtcaartaagtaaataaataaaatgagaaaacaataaatatagtagctctagtaacctctccctacactcccatgggctgtcttgcatattctgaattatatatat

SEQ ID NO: 725 - DNA, 201 bp, Homo sapiens
gaagatctcttcatgagaagcatacgaaaatcttagctggcactgctgatgctcagaaatgccaccacaggaaatgtgaaattgatagttggtgagagtamcacataatttcgatgtgaaattataagacttgtcacaacttggttaaccaagtgaaccgtctgggccaggttggtcaaactatcctcattgtaaaaatgc

SEQ ID NO: 726 - DNA, 201 bp, Homo sapiens
taacggtatgtatcattacattaatgggcaggtgcttatatgtgcactcaacacacacgcaacaaatgcctggaccaaaaacagacaaggaaaaaaatacygataagaaattgattcatggcctggcgtggtggctcacgcctgtaatcccagcactttgggaggccgaggcgggtggatcacgaggtcaggagatcgaaa

SEQ ID NO: 727 - DNA, 201 bp, Homo sapiens
ctaacttcatcaccctcaaggggtgccttaattataagtaccaatgacttcttaggtattagcaactcaaaacgaaatgtcaaagaccaagaaagctaatsgcatacatggggtgtcaaaactggtctaacggtatgtatcattacattaatgggcaggtgcttatatgtgcactcaacacacacgcaacaaatgcctgga

SEQ ID NO: 728 - DNA, 201 bp, Homo sapiens
tctgcctatattccagtgcaagaaggtaactctgagaggcagttcaagtttcagtcacattgttgcatgtctctcctctgcctgtcagcaagttccacccractaatctgcttcccatatatccttcccacgttcatcttcaggggctccctgccatgtgcagcagacagccagagttcccaatgatggtgcacaccaagc

SEQ ID NO: 729 - DNA, 201 bp, Homo sapiens
ccgcaaagacttcaaaagaggtttggcctgaactaaatactgaaggctgagcaagaaagaggtcagaaatgggtgggaggagaacaaaagcagcatatgcraagaacaaaggtattaatgtgtatgttgtgtttagaaaaatgcagaaagtctaaatggctgaaaagtaaaatgtctgtgaagtgggagagaggataaatg

SEQ ID NO: 730 - DNA, 201 bp, Homo sapiens
caaaagcaaacattcagaaccttttatactttccttaagtggctcgtaaagcatcatgggttaatgcaaagagtctagaaacagaagtctaagacctgagytctagtcgcagcttcagcactaaccaaccagctatgagacttgagtttgacattcatgttctctgagtctcagaatcaaattcaagtttttgaaaacaac

SEQ ID NO: 731 - DNA, 201 bp, Homo sapiens
aactgcatcctgaccaaaaaaaaaaaaaaaaatcattcaaatgaatccaagcaaggagtgttaactgcatatttcctgggagcatggcactgcaatgaatscttgggtagggagtagaggggacagaacaggaagccacatgaagacttagtcccacgtggcccaaggggcctagtgaaaggcaaatctatggtaacactt

SEQ ID NO: 732 - DNA, 201 bp, Homo sapiens
ttcaaaaccacatgagggtcagcttgttatcaattctcaaaacagatatctcttttcctgcataaacatttaacctaacaacgaggccaaaacaggtaackgtctttgccttcctctcacaagaggaggtttacttctagcttatctttacagtaaaaatgtcaccctgtggattatgcatcggatttccttttaggctcc

SEQ ID NO: 733 - DNA, 201 bp, Homo sapiens
aataaatagacaaatctgaagctggtgtgaaagagtaacttatcagaacatgcctagtcagtctttattttccaacctttgctcatggaaaaccaaatacrtagatctcaccagtcattcagtaaaccaagtagcaaaagtacccactgtcactgccaccgctgtcaatattctagggtgatttacacacattaaaggtta

SEQ ID NO: 734 - DNA, 201 bp, Homo sapiens
gtcttaaaaaataaagtcgtttctgtgctatagcattgctatgaggattaaatgagttaaagctttaactcactaatattggtcgagttaaaacttataayagtacctggcacagagggagtactcacgaatgctgatcatcattttttactgtgcacctttgtacctggccagcatgtccataggttataggaatgtggc

SEQ ID NO: 735 - DNA, 201 bp, Homo sapiens
ttccaacttaacaagctcatccaccccaggattctgacggtgttcccctcctcactggggcacatcccccaccatggagtgccccactccctccttgtccsttttacagaaaccactgcactagaaaatatgtattaaaagatggaatgtgcttgattcaaaaaccataagagaggggatttttttgaggatgataaataa

SEQ ID NO: 736 - DNA, 201 bp, Homo sapiens
taggaaatggaaaccaggctcccctctctcaaggtatctgggaaccactgtctcaggagctgaagccgggagacctgaggggaggtctggccggagagtcygtgcgtaaagcagctacagctctgacctctctgacctgcagcctctcagggcgtgcgaagtccaaacgcactggcaacttcaccccctttgccctaacgc

SEQ ID NO: 737 - DNA, 201 bp, Homo sapiens
aaaagactgtcaaccaacttgcaggaaacaatgagacaggcccgccatgtgtaaattaaattcgaatctagtttatttgcagaattttacttaaccagttrtcatttcttcctgtttctcaccattatataaaaacttaccctttgtacaagtatgaaaaatgtggaacaatgaataagtagtgaatattgcacatttaat

SEQ ID NO: 738 - DNA, 201 bp, Homo sapiens
gcattaaactacgtactcacacgtgacaaagtctaggggatgactgacatattatagataaaatctttctctgggttttaaaaatggtcctgtagatgttytaacacgataaaatgacttccacaagacactgttttccacaggcaccaccgaggcaacacagaatgtattcatggtccacgctagcacacactgccacta

SEQ ID NO: 739 - DNA, 201 bp, Homo sapiens
actctgtctcaaaaaaaaaaaaaaaaaaggaaattgattcacataggatttgtaaaagtaaggctcgcttactgttaatgaaacagacttactccacgtaygctccttctcacaagatctcaagttagatcaaaaccttaaatggttgatcatattgtatccaccttgtgaactcaaaacaatgacttttccacacttcaa

SEQ ID NO: 740 - DNA, 201 bp, Homo sapiens
ctctatatatgtagaaatatgtttacatatacatatacacaaatagacacacatatacaagacaaactataatgaaatgttagctatgtagtcagtatttytaggtagttaggattataagaaagttttcttcttcatactttctatgctgtctgcattgcttataataagcatacattaattttttttttgagacagagt

SEQ ID NO: 741 - DNA, 201 bp, Homo sapiens
attccaaagtgcagaattatgtttaaaacacagatggcaatttaaagttaaaaagaattgtataaaaatgaacacaatctttgcataagctattccaaatytgaaccataatgaaaacggcctttctaatcacctggaactggcatttgtaaacactgtagcattttgtaagtttttcccctgacaatcatcttccttttt

SEQ ID NO: 742 - DNA, 201 bp, Homo sapiens
agctcctagaagccaagtaggttgggcggcagaatccagatccatagccgagggaagggaagccacagcttccataacccagggatctgacaccactggasccacagcccactgagtagcagctcctcgatccatagcccagggagcggcagctgctggatccaaagcctagagacccagagtaagtcgtcttgcaaggac

SEQ ID NO: 743 - DNA, 201 bp, Homo sapiens
tatcaattttgaaatgaatgaggttgtgttccaatattgtgtttatttcctcttagaaaagtgttagggacaagctgccccaggaaccccccactccctcwatgtagctgacccttaccctgaatactctgcagctgcattcctgaacccttatctaggtgccacagcaaggtaaccagatttgctatgctgaagccctcc

SEQ ID NO: 744 - DNA, 201 bp, Homo sapiens
aagtacttaattatggccttgtaattacttattcttgtcaattcacatcaaaacaacatagctacaagggatttgtttcttgattttagaactcgattaarcagagtccattcatgagctcccagtcctgctgagtggtctttcacttcctgacacataattaatatcaaacaattttttctaacctggaatgtgattttg

SEQ ID NO: 745 - DNA, 201 bp, Homo sapiens
gccatgagcattaacccatttttaattaatagtgttaaaacttaagttagccaagttacacttctatcagcttgtttctagagcatattatgttaaatcakatttttaaaatgataaattacactctgaagttgtataagaaatagaggaaagtagggcagatgaattctaaatatggtcttaatttataatctatgatta

SEQ ID NO: 746 - DNA, 201 bp, Homo sapiens
cttctttgtttaatgttgccactagtatggggtttgaacaaaacatgtgggacaaatttggctcaaggttggccagtttccatgtgtcaaaaaccagtgayctctagatatcaattgccatcaggaaagctccttatttgaatgggcactgaacccagccatgtttcagatcctcagtcaacaacaggagagcagaacctg

SEQ ID NO: 747 - DNA, 201 bp, Homo sapiens
aattaaaaaaaaaaaaacatttttaagttgtataaaactgttttccacatggttatttttggaattgcttgaaaaacaaattttttaaaaaaatcccttartctcccataataatcctttctactgaaatgtaaagcatatgaagcattgaatgaggagaacaaacggtccatgacaaaagtttctggccaggcagagact

SEQ ID NO: 748 - DNA, 201 bp, Homo sapiens
aagcagagaagagcctaaaataaaactcacctttggctgtatcagcccatcactatgcctctgaatatgccttcttaagaggtaaacttatgtcccagtgkgttcatgaattttacttcagctttctttaagtttcctaagtatgccctgtgaactgaccttcattttctcatttattctatctcatttctctcttctcag

SEQ ID NO: 749 - DNA, 201 bp, Homo sapiens
ggattttggtagcttttataccccaaagtactcaatctgcagtggtttagagtttggaaactcttggataagcagttaagttgtccaaagcagttggaacygttgcggagggtttggcaggctttggatgcatttcgagtgggtatgtggcaattgcatacatacccattggtctgggtgcttgggctgcagctggggctg

SEQ ID NO: 750 - DNA, 201 bp, Homo sapiens
agcatgcccagtatttcagaaattctcctaagtatatactcaatagaaatgtaaacatatatgtacctaaagatatatacaataatgttcataacagcacyatttgccatagttaaaaaaaaatggaaactgcctaaatgcccaccataccagggtacataaataaaatggttatattaggttggtgcagaagtaattgtg

SEQ ID NO: 751 - DNA, 201 bp, Homo sapiens
ttcagatttctctattatccttaatttttgtctaccctcttggctttcagctgacctaagtactcctccttagagacgatctgtttcatggagccctttcractataatccactgttattaaactggagccttgccggtgtggggcgaaagatggaggagaggcgaagcatttcataatcttataattaaacctcagtctt

SEQ ID NO: 752 - DNA, 201 bp, Homo sapiens
cagcttaaggaataaaccatcaaacaatccctctactgtcaggtaagaatatatggttgagtatcacttgtccagctcagtcatcttgcaagcaattgacrttggttatttctgtgttgaaattaagtcatgaaacacaaagcgctgaaccagattcttaatttggacttaatcgcatttattatagtgcaaaacaaatac

SEQ ID NO: 753 - DNA, 201 bp, Homo sapiens
cacacatgctgtcatctactttaaatcatttctagattactaataatagctgatacaatgcaagtgctatgtaaatagttattatgtgttttctagggackaattataaggaaaaatgtctgtatatgttcaacacatatgcaatcatctttgtttcccttaatgttttcagtctgtgattagttgaatccacagatggtg

SEQ ID NO: 754 - DNA, 201 bp, Homo sapiens
ccccgttccataaattacaaaagggattccactgattgtgaagatctgtattcatagaagtgctagtacttttggggtctctgtgagttacaagtcactgygactgatgattttgttattggagcacttagcataggtagacgcctccattcactgaatgccacttggagtcttgttaatagtattctaacctgaatgata

SEQ ID NO: 755 - DNA, 201 bp, Homo sapiens
cagagggcaaactatacttttgctgttgtgttatatgactatgttaccccgttccataaattacaaaagggattccactgattgtgaagatctgtattcayagaagtgctagtacttttggggtctctgtgagttacaagtcactgtgactgatgattttgttattggagcacttagcataggtagacgcctccattcact

SEQ ID NO: 756 - DNA, 201 bp, Homo sapiens
gcagaaacttggttaggtttgcaattagaaagaacattctggtggaagtgtgttcatggggtagagagataagagacatcactcctaatttttccttttcmaaacagctttcccaaggactttttgggtctctcaagtacatagggtcagaagtctaaaaagcagcttaaggaataaaccatcaaacaatccctctactgt

SEQ ID NO: 757 - DNA, 201 bp, Homo sapiens
aagccatcaaaggcgtaagcagaaacttggttaggtttgcaattagaaagaacattctggtggaagtgtgttcatggggtagagagataagagacatcacycctaatttttccttttcaaaacagctttcccaaggactttttgggtctctcaagtacatagggtcagaagtctaaaaagcagcttaaggaataaaccatc

SEQ ID NO: 758 - DNA, 201 bp, Homo sapiens
ggtctcttggcagttgtctgtgacccaggtatggtcttgagagctagtgggtaagtagaggacatctccacagctcacgctggtagggcagaggtcgatgkaggtgagaggaatatggcgggaggttctgagagatcctgagttggagtttcccgagcagtagttggggcaagacatagtgaggttgtgagagcaggctga

SEQ ID NO: 759 - DNA, 201 bp, Homo sapiens
agactattttactactgggggagaaatataaaaataaaatggtataatcccggaggtcctgtactaacatgttgaatttatctcagtattttaggtcagaygatttgtacctgatgtatttgagaaagccccactcactccaacccccaaccccaggccctcatcacctaatactgtttgtataaccggatactttgtata

SEQ ID NO: 760 - DNA, 201 bp, Homo sapiens
ctgagataaaattcaggctgagccaatgtgtgattagggtaagaggcacagagagggccggggaaaggcttcaaaaaataggggatacagatgtcacaaawtcaaaatatccaggagagcaagcaaataaggcaaataatgaaccagaatgaaattaacaacagtggcatgatcatgatagtaagtggaactggcattctg

SEQ ID NO: 761 - DNA, 201 bp, Homo sapiens
catttcagtttggggcgtttctattggcttagcttcaagttcactgattctgcgcttcaccatgactagtctactaatgagaccattaaaataattattcrtttatgttgcagtaatttttatttctagtttaattcattctttaaatttctatctccctgcttccattgtccatctgtctttatatgttattatatctac

SEQ ID NO: 762 - DNA, 201 bp, Homo sapiens; identical to SEQ ID NO: 141

SEQ ID NO: 763 - DNA, 201 bp, Homo sapiens
actggatcttctcctctccccctctgggatatggtatttgaaaaaatgactgtcttctatacaagggatccgttttagggttttcagacatctttctgtgrttgttctgggttaaaagactgagcaactacacaagtcagtaaggactggagaggtgaaagggagaataaggccatctgtcccggtggaatgtaggggcag

SEQ ID NO: 764 - DNA, 201 bp, Homo sapiens
gaagtcggagcgggtggggagggagccgggcgggcggccagagacctggcggcaggtgcctgccctctgtgatccaactctctccccagctccacccacaytggcctagacccagtctctaagggctgaaaatattgcccggaagctcccgagcagaatcagatcgcgctaagtagggcacaacgcagaggcgacaaagct

SEQ ID NO: 765 - DNA, 201 bp, Homo sapiens
gggtgccaggtcctctgctgggctccagtgtttcagaagtgaaccaagacatggtcactgttttcacagagctcacagctcagtggaacggttcttacccrgagatctgtaggcaggctttagggttgagcaaatctcagcaagcccgtgagactggatgcacactcatgtgtaagaaggcatggtgttgctgagaggggc

SEQ ID NO: 766 - DNA, 201 bp, Homo sapiens
ggcttcagcgtgccctgtgtgcccgtcccctgagggagcccctcatgtctttctccctggcctacacactctctccagccctaggtccagttacagcctcrcggtctatcagggctgcctttagcctgaacagatccttgcccccctggcgtccagaggctgcctgctggtggtgaccacgtggtgtgtctcctgcagact

SEQ ID NO: 767 - DNA, 201 bp, Homo sapiens
ttgaggagttttggaactcttgatctggtgtgatggtctttgtgttgatgtaaaaatttacttctcatctcttctttttcttttcttagcttcactataaygtgactacaactagattagtgaatccagatcaactgttgaatgaaataatgtctattcttccaaagaagcatgttgactttgtacaaaaggggtaagaag

SEQ ID NO: 768 - DNA, 201 bp, Homo sapiens
aatgtcgttttgcatgttatctttttgtgtgctatttctgctttgatgttgaagactgaaccttgttttttaaagctgatttaatttttttcttgagtgtygatatttttccttctaaagcttctgctctagttttctattcattgaccaaattttttttgtttgtttttgagctggagtctcactcctgtcgtgcaggcc

SEQ ID NO: 769 - DNA, 201 bp, Homo sapiens
aattgggaaagaggatgtgtgtggtaagtgtgtaaagagatattctatcatgtattagcatttagccaagtccctgatcttttctttgatgacttggtggycataatttctgagtatactaggttgtatacatttgccttcttagtctcttttagtcctaaaagaggtatttaccttagaaagtggctttcactagttttc

SEQ ID NO: 770 - DNA, 201 bp, Homo sapiens
gtagggattatttggataatttctgtccttaagcaaaatgaattttgtatagaggctcttacttatattcttttttaaagttgtggtccagcaaaataacratcgtgtggcatctatggcaccatcgtaaaggctccttgaattgtgctaaacataaacataacctgaggtaccctgtgctctacaagtttgaatcactct

SEQ ID NO: 771 - DNA, 201 bp, Homo sapiens
cctccttcttccatctcctgcctttctcacacatatgccttgtggtaaaggtacaggcaggaggctgcgggagagaggggttcttttacagttaaaaaaayattttttttttacacttaagatgatggagggaacctcaaaaatttattttcttgcttgagcagtgttgacatcaacaagaggataccaggtattaaggtg

SEQ ID NO: 772 - DNA, 201 bp, Homo sapiens
tgcttctgtgttcagtctgttttgataggttgttttgattgaagccaaggaataaaatgcagcctcacacagatatgcaataggaaaaggaagaaaaattytaatagccattcagacagtttctgatagcccattaaaacttgacaaatggtagtttcttaaagggtaattgcatgtggaatctgaagccatatcaatgaa

SEQ ID NO: 773 - DNA, 201 bp, Homo sapiens
accctgtgctctacaagtttgaatcactcttttaccagtctgttgtatagccactgattttagatgcctaggtggctgctctttgatgaaaataccaatgyaggtcttgtggtagggaaggggagtatacagtccctgggctgtacaacagaacttttttttttttttttttttttttttttgagacagagtctcgctctg

SEQ ID NO: 774 - DNA, 201 bp, Homo sapiens
cttttctgagtcttcattttatcacctctaatatgggtattctaatgtcaatctgtgtatgtttgggtcatgttttgccatttatagagtaactttacatrttgtatcattaatctcttttgcctgccttgcagagctgttacaggatcaaatgaattatatacaggagaggcataatgaattgttgttgctttttaaagg

SEQ ID NO: 775 - DNA, 201 bp, Homo sapiens
ttgtgttagatgccaaaatgaagaaagtctctgctttctacaaccccaagagtttttttttatttgggacacagtataaagtaaaatatataaagttatgwgtgttccaaaagagtatacagtttcccttacatcttttttttgtttgtttttttgaaatggagtttcgttcttgttgcccaggctggagtgcagtggtgt

SEQ ID NO: 776 - DNA, 201 bp, Homo sapiens
acagagttctaattttgactactttaaagttctctaacatgcaactgggtttctgctgtggaaatgaggtaaacacaaagcaattttcttttcacctgaargcaacagcagcgtcacgtcacccctaagtggacaaaccaaataccatgaaagcattatcatgatttctggtgttggattattttggctctttcagatgct

SEQ ID NO: 777 - DNA, 201 bp, Homo sapiens
cttcgtttatcttttgcatttgttgactattttaaccaaaatgctcaactgcactttctagcatgattactaatggcttgagtattaatcttattaatgtyacctatattcatttgtcatcactgcattcaaagacaagcacgagtgtactccagctgtggtatacaaatattagggaagtataaataatttagcaattga

SEQ ID NO: 778 - DNA, 201 bp, Homo sapiens
atacagaacccagaagcccatcttgaattcacatgccctggcatacaggttcaaggcaggaagaaaggccaggtgtctataattcgaaggatctgcacctmcttaggagttaggctacacaggactatacaagtgttgcaaatcgggtcttttggtgttgggcacaacacagcgcacctgggcaaagagcagaactcctga

SEQ ID NO: 779 - DNA, 201 bp, Homo sapiens
agaattctctgcttaaccaaatcagaatcaattgtgaagatagaatgtagtcacttatcagacatgcaagatctcaaaaaatttacttcccatgcatgcgycctcaggaagtcactggaggatgtgttccacaaaaatgagagattaaaccaagaaagaagaatacttaggatctaggaaactggggctacattgtaagat

SEQ ID NO: 780 - DNA, 201 bp, Homo sapiens
aaaaggaaaatagaatttacctataaaccaactacctgtggaggatgtagttaatatttattgtgtctttccagtcttttttttaaagcatacttttacaygcattcaagtacttttaaaggacacattattgaattgcagagaacaaaaaaattgttgggagtaagatctgtgatatggaatatataatactttatatga

SEQ ID NO: 781 - DNA, 201 bp, Homo sapiens
ttgcagtgagctgagattgcgccactgcactccagcctgggtgacagacagaggctcctcaaaaaaaaaaaaaaaagaaaaagaaaattgaatcatgatgkcaacgtagccatatatacttaagatttgaggttcatttttaacaatagtgtatataagtccttatttaaaatagtcttgctaatttcaagttttgcagac

SEQ ID NO: 782 - DNA, 201 bp, Homo sapiens
atgttggctgggctggtctcgatctcctaacttcaagtgacccacccgcctcagcctcccaaagtgctaggattaaaacatgtatgagccactgtgcccgrccatgaagccttactgtcctttctttgcctcaccctgtttggattaaaggcaacatttcataatttatgacactattttatgcttcccctactagattga

SEQ ID NO: 783 - DNA, 201 bp, Homo sapiens
tcgaactcctgacctcaggtgatccacctgccttggcctaccaaagtgctaggattacaggcgggagccattgtgcccagccgttttttacttgctgatartaattttctttttctctccaagtaaaatgattcatggaatcagtgtttcaggcatagaaaaatgatatttttaaaatgtcctttgtggcttttggggttt

SEQ ID NO: 784 - DNA, 201 bp, Homo sapiens
actttgttcaatagttaatgaggagccattgatttgtgagcaagagagagagaaatgaacatgattttgaaaaattaatccagtggtgtatacgattgttyagtcaggggtgatatgtgtgctattagtccctactggagtacccatgacagccgtcattcgtacagcactgtacttctccccaccaagcctagacttagc

SEQ ID NO: 785 - DNA, 201 bp, Homo sapiens
ggagtgcaatggcacgatcttggctgactacaacctccgcctcccagtttcaagcaattctcctgcctcagccacccgattagttgggattacagccgcckgctacaacgtttggctaatttttgtatttttagtagagatgggatttcaccatgttggccaggctggtcttgaactcctgacctcaggtggtccgcctgc

SEQ ID NO: 786 - DNA, 201 bp, Homo sapiens
agtgaaaggaagagtcacacatctgtcacttgaaataaaaatctagaaatgattaagcttagtgaggaaggcatgtccaaagctgataggctgaaagggargcctcttgtgccaaataattagccaaattgtgaatgcaaaggaaaagttcttgaagaaaattaaaagtgctactccactgaacacatgagtgataagaat

SEQ ID NO: 787 - DNA, 201 bp, Homo sapiens
ggtgttttcctctctgtgtagctgtgtctctgtccaaatgtctctcttcttaaaaggacccaaggtttaggcttaccctgatccagtgacagttcaacccmcagcactgggtagcttccagtgtcttttatgtaaaccaagcaatttcaagttttaacttgccatttttgtcttgaaagatgtctttagaacttgtattat

SEQ ID NO: 788 - DNA, 201 bp, Homo sapiens
aagtgatcagcctgcctcggcctcccaaagtgctgggattataggcatgagccaccgtgcccggcctctaaaattctgaatgttaacatggcattttacaracctcctcccctgactccttttttttcataatagcaattcctgatggctatagaaaatgtttaagccaggccgggtgtggtggctcacacctgtaatccc

SEQ ID NO: 789 - DNA, 201 bp, Homo sapiens
ccaggctggtcttgaacacctgggctcaaataatcctctctcatctgccttcagagtgctgggattacaggcatgagctgccacacctggccttaagtcayttttagaaatggctagaggtgggatgtgatataaggaagtcagtatacagttatcaaaatatctttgttttcccaggaaaatttgctgtttgatgaatat

SEQ ID NO: 790 - DNA, 201 bp, Homo sapiens
ccgtgattggggtctgctgccaccgggtggtagcagcatgccatagccgcaggttcaaggagtagtaaaagggaaaaaacactgctgtgagatcccagacrgcaggacttgtcctcttcattgaacctacaataaatcatcatgattctcaaacacgatacttcaaagctacttttattttattattattattatttttgt

SEQ ID NO: 791 - DNA, 201 bp, Homo sapiens
tcgggtcttttggtgttgggcacaacacagcgcacctgggcaaagagcagaactcctgaatcttacactacagtagtgatttataaccctggatgctaatwagaaccacctggggaattcttggtcccaaattctggtttaattggtggacgttcagtctgggcatttggaattgtaaaagctttccaggtgattgtaata

SEQ ID NO: 792 - DNA, 201 bp, Homo sapiens
cagagtgagaactgtaccatcagctccactggttctgaggcttttgaacttggactgaaccacaatactggcatactaagatctccagattgcagatgccstcttgtgtctcccataattaccagagccaattctccttattaatcctcactcttatatttatatctctttggtatttttttttttttttgagatggagtc

SEQ ID NO: 793 - DNA, 201 bp, Homo sapiens
atccacccacctcggcctcccaaagtgttgagattaacaggcgtgagccaccactcccagcccggactttctcttatataaccacctaacaacagttcagwtatcataattacaaaatttaacaaattcctgaagtagtttctgaattcaaatccctaaagtatttgtaatagctttttaaaactatttccttttctagca

SEQ ID NO: 794 - DNA, 201 bp, Homo sapiens
ctgtgaacactattacgagcttgtgtgtgaaaaaaaattttatgtgagaaaaatgaccaagagtgaaattgctgagtcatatgttaagtccattttgggtkgtaaaaaaaaagcagccctggccgggcagggtggctcatgcctgtaatttcagcactttgggaggctgaggcaggcaggtcacgaggtcaggagttcgag

SEQ ID NO: 795 - DNA, 201 bp, Homo sapiens
ttgcaccactgcactctagcctgggcaacagagcaagatcttgtctaaaaaaagtttttttttgatgtttttattgttggaatgagatagggcttaatatyaattgttacctacttttttaattgttaaagatataagttctgattaacacataaataagtcaaagggagccaggcactgtggctcacacctgtaatccca

SEQ ID NO: 796 - DNA, 201 bp, Homo sapiens
gaaagatttttaactaacatataacatttaactaacatagatcataacatttcatttgaagctctctagtggcctctttctcatctcgagtacaagccagygtttgccctgtgtgctgtgggttttcccccgtgtaatgtggcctcccatcacctcactgccctcatggtctactccctgcctcacttgtgccacccacat

SEQ ID NO: 797 - DNA, 201 bp, Homo sapiens
aaacactgggctcagtgctatagtaaaaacacattccaagaggtgtgggcccaagcaggggagaagatggtagtgtgcccatcatttggggactgggtctrtgtttagtttttgcactgagactctcgtaatgagcaaatctgggcggtttgagggaaggaaaatgctgagcttttgggcagaagggtgttttagaggaga

SEQ ID NO: 798 - DNA, 201 bp, Homo sapiens
acgtttccctaatgactttgggatccatcacatataaacatatatgaagcactgcttagccttactgtaagtgacaacatattctattttctcttataaayatctagtctgacaattgtaatctttaaattagagttctttagcacatttactttaaaatccttttgggggatcaggtttattgagatataatttacatat

SEQ ID NO: 799 - DNA, 201 bp, Homo sapiens
gacccttcttcaaacaaatagtgaagccgcactgaagagcagatttagcagagaatagcagaaagcaccgcacaaggagtctgaagacttagcttctagtkctgactcccacttactatctataaaatctcagatatctacaatctctttagtagagcttacctctttcttaaccatctattttctcatcttcataatgaa

SEQ ID NO: 800 - DNA, 201 bp, Homo sapiens
tcttagcattgccagaaggattaaaacaaaatctgatctcacagtttctcaggtattgtttttttctgatgttgctgttgtttttaaactaaaagtcagaygccatgaaacatcctcagcgtggcaggtaagtgggaggctatgatataatttattgttcagtcctgacatttgtgttggtggacacaaggaggctatttg

SEQ ID NO: 801 - DNA, 201 bp, Homo sapiens
tacaaatttgtcataaactatctggaatgcaaataccctacttagaataaaacacaaaattctggaacagggaatataaaaaataatcaaagcttacatcyctttttttttccgagatgaagtcttgctctgtctcccaggctggagtgcaatggcgcgatctcggctcactgcaacatctgcctactgggttcaagggat

SEQ ID NO: 802 - DNA, 201 bp, Homo sapiens
tcaaaatgattctaaaatgtatgtggaaatacaaaggggcaagaataactaaatcattcctaaagaataagaagatgggaggaaactggtcaacctgatamaagaactattataaaattaaagaaagtaagatttccttaataaataaaacaatgaaacaaataaaacaatgaaacctttcataccttatatttaggtatg

SEQ ID NO: 803 - DNA, 201 bp, Homo sapiens
tattataaatcacatggaaacatttcttgaaagaattagagccttcgacatcacaggtcaagtgattatactgtttctgagtcaatgaataatgtgatacmtgcattattattaataatagaaatttcagaaccatagtatgtgctgcatatggattgtgtttgttctgtttctaatagctagaaaccagtgcctgaaaga

SEQ ID NO: 804 - DNA, 201 bp, Homo sapiens
gtagacctgggctccttctggtacagattgaaaaccactggtctttgggatagagaaacaataattactgctggctttttaaatttcaggtaattacactraatgagagtacattaagatgagaatggcttttaatactttgctataaaaatataaaaccctgggtgagctttttaaaatcacagtggtagttggttttac

SEQ ID NO: 805 - DNA, 201 bp, Homo sapiens
atgaaaactgtttttataaatatttctgattgctcttattttcttgttcttgtggaaagtgagaatgtagccaaatagtcataaacaaaaccaagcccctwatctcttttaaaattttgatattatatctttgtttttatagtgtgaatattatctctaaagggtataaaacttttagatcatgagctaatcagtataacc

SEQ ID NO: 806 - DNA, 201 bp, Homo sapiens
aagttgcttagggccttagtgaaaagcacaccgggtgccaccaagatgcatacaagtttacacataagattttttggtgggtcctttctacacaattttcwctgtaagccacctgtttctcatagcatatgagagaaaggtctggcatatgacctcttattcctactgtgaggcacagtagaattctcgaagaccagctgt

SEQ ID NO: 807 - DNA, 201 bp, Homo sapiens
gattacaggcatgagccaccgtgcccggccatacttttttatttctttgcatgtatatgtcttgtaattgttgaaaactagacattttaaataatataatstggcagctctggtaatcagatttatcccctcctcaggatttgatattattgctgtttgttgttgttggttagtgacttttctgaactaattctgtaaagt

SEQ ID NO: 808 - DNA, 201 bp, Homo sapiens
ctttaaactttcaggtgcaagtaacacatctgggtccaggaaaatgcaaaaccctgaattttgcatctgctcaaggtaattggagaaagctattagatacstatacctctatgcttagaaaaatcactttcactaaattttaaaatttacgacacctcagttaaggggcctgagacattttcctgagacattggattgtct

SEQ ID NO: 809 - DNA, 201 bp, Homo sapiens
agtatattgttataattattctattttattatgttattgttaatctcttattctgcctaatgtataaattaaactttatcaaacttgtgtatatatatatrtatatggaaagaaacatagcacatatagggttcattgctatccgtggtttccggcatccatgggtgtcttggaaagtattacctgctgataagggggact

SEQ ID NO: 810 - DNA, 201 bp, Homo sapiens
gatgggtatggaactttgtaatgtcatcttccctcagattaattcaggttgcaatgtaaataatcttagcactaggaaattgtacctcatcctcagagaarggtagttggttggccctgtttatgaaatccaagataacacaattgactgtgtggatgaaagtttggtttttttcccctttataggcctcaaaactgtaaa

SEQ ID NO: 811 - DNA, 201 bp, Homo sapiens
tatttaatgtttctttatgattagattcaggttatgtatttttggcagaaataccacaaaaatgatgttgtagccttcttagtgcattataggaaagggaycaaatgttttctgaacgtttatcatagtcctggaatcatgctggatactttttatttttaattgtggtaaaatacacataacataaaatttaccatctta

SEQ ID NO: 812 - DNA, 201 bp, Homo sapiens
ccaaggtgggaagatcacttgagctaaggagttcgggactagcttgagcaacatagtgagaccttgtttttacttaaataaaaaaagaaaaaaaggctggrtatggtggtgcacacctgtagtcccagctacttgggaggctcaggtgaggagcctgggagatataggctacagtgagctatgattgcaccactgcactcc

SEQ ID NO: 813 - DNA, 201 bp, Homo sapiens
tttggcctgagcaccagggaaaatggagttgccctttgttgaaaggaagaagaccatgggagagactactaggaagttctttttggaaatgttaatttggrgatttcttttagctgcctgagtggagacatttgtccagcttttggttcagttttgaaaaataattgcttatcttcaaagtttttttttttttttggagat

SEQ ID NO: 814 - DNA, 201 bp, Homo sapiens
ctggccaggctaaataatgacagttttctgagcatgaagctttgaaggagctccaacctgttctgccccctccagcggctcctaggttgctggtcttcatygtgattgtgggctgtgggtttctaagactatcatagagctggagagagaagaatggggataggtagggcaaattcaaacacctcaaactcactgtttcta

SEQ ID NO: 815 - DNA, 201 bp, Homo sapiens
tttttttccagagtattatataggtggaatcgtttactacatgggagttgggtataacttcttttcatttagcatgatgattttgagacttatccatgtgsttgtctatattagtagctcattttttattgttgaataatagtttgaataatattgttgacagtagtcaattggatataccaaaatgtgtttattcaccag

SEQ ID NO: 816 - DNA, 201 bp, Homo sapiens
gtcatacttatgtattgattgtttttatttttttaatggagtctttctagacactgaaaaagattatttcttttttaaaattgtaaacattttgatttttraaatgtttttaagagatggattttcactatgttgcccaggctggtctttaatcctgggctcaatgagttaaatccagctaaccatttttggctgcagggc

SEQ ID NO: 817 - DNA, 201 bp, Homo sapiens
aaggagagctgtcaaagggtttttaatattttaacaacagctttgttacgatgtaattcatatatcataagatttacccctttaaagtgtgtacaattcartgggggtttaagagtgtattcaggtcgggcgccatggcttatccctgtaatctcagcactttgagaggccgaggtgggtggatcacctgaggtcaggagt

SEQ ID NO: 818 - DNA, 201 bp, Homo sapiens
atgaattttgtttctatacactaacactgaagaatctgaaaatgaaatttaaaaaacaacaattaagaaagaaaaatacttaggaaaaaagtgtaacacaygtacagtgaaaactacaaaacatcattgaaagaaataagacctaaatggaaagacatcccatgttcatggattggaaaacataatgttgttaagatggca

SEQ ID NO: 819 - DNA, 201 bp, Homo sapiens
aactatctctatttgcagatgacatgatcttgtatatataaaacactaaggaatacacacatacaaaaacaaactattagaactaataagttcaacaaagytgtgggatataaggtcaatatataaaaatgaattttgtttctatacactaacactgaagaatctgaaaatgaaatttaaaaaacaacaattaagaaagaa

SEQ ID NO: 820 - DNA, 201 bp, Homo sapiens
ttgtgaagtgtctgttcacgtcctttactgtctttctcattgatttgtacttggagcctactttgttgccaaggtgacgtatacagaacccagaagcccaycttgaattcacatgccctggcatacaggttcaaggcaggaagaaaggccaggtgtctataattcgaaggatctgcacctacttaggagttaggctacaca

SEQ ID NO: 821 - DNA, 201 bp, Homo sapiens
aacaatatttatataaatttatagagtacaagtacaattttcttagatgcatagtggtcaagtgagaggttttaaggtgtcagctgaataatgtacatcgsaccccttaagtaatttctcatcaccaacccccttccatctcctcacccttccaagtctacattttctatcattccactctctacatccacgtgtacaccc

SEQ ID NO: 822 - DNA, 201 bp, Homo sapiens
tgttctccatgggaggcagtggagaaggtttgtgacagaccctgtgagccttcatttatggctgccacggattacacacatagacaccatctaaggaaagyggggttgcctgggagaggattgcctcagccttcttccaaggagcacactcctgggcatgttgtttcagttgtaaatgacatctcacaattcacaaatcct

SEQ ID NO: 823 - DNA, 201 bp, Homo sapiens
ggaatcaattcgtctctcagtctttgtgccggctctgtgtacatctggggtatgcctgcaactttcagccaggcagctgacaactctgcattagatttcayttcctatttgtataaaacctcaaggtcagcttgaggtgagatcttagatccttctaaagtgttttttgttttttatttttatttttttgagatggagttt

SEQ ID NO: 824 - DNA, 201 bp, Homo sapiens
aagggagggtgagagggccagtgcagcctgagtttagcaagtgaggagggcagtaggaaaggaaaccttgggaacaggagtcaagctgctttgggctgggyaggctctcataaggactttggcattttttctacgtgaaatggggagccattggaggcttttgaggacatgatttggtttagtttttaacaggatcacact

SEQ ID NO: 825 - DNA, 201 bp, Homo sapiens
ctggcccatttattcattttctaacccacttattccagttcaaggttgcgggtagccagagcctagctcggcaggtcatagcacagggctggaacctgccytggactggacactatcctgttgtagagcacactctcacacacacctgcacacacacccacactcactcagaccaagacaatttagacatgcaatgaaccc

SEQ ID NO: 826 - DNA, 201 bp, Homo sapiens
atggggactgctttcccctagtacttgcaaggcagagagcatagtacatttaggcaaataaccccccatgtgttgtaatgggaggttttggaggagccagkctgtaagtctgtggtcggagggacgaccgcagcgaggaaggcaggctgcttagccagcagacatgagggattcatgtcaggtcctttttaatgggcaggg

SEQ ID NO: 827 - DNA, 201 bp, Homo sapiens
tttaaatcaagcaagttgaacctctaaacctctaaacacagtgctatctgtgttctctctacttggaagaggcagggtgtgtctggatttcttaagggctrtagtaaagtagctcatgttaggctaaaatcaaggggcctgcaaatgtgtggctatgattaccttattatgtgccagcactatgcattcacatggttcatt

SEQ ID NO: 828 - DNA, 201 bp, Homo sapiens
acacagacgggctgcagcaacttcccaggatggtttattccaaagctgtggacggtgaacattaagacgaaagaggtgactcgcgtggaacctgaaacacrgacgcctttcttccaagaagggctgtggcgatcaggccactcaaggcagccagcccctcagcagggcacgatggctaatgctgcctggaccgcagggact

SEQ ID NO: 829 - DNA, 201 bp, Homo sapiens
taggcctgagaaccactcttagccatgtgtttgagcagaaggctgagcaaatagctctgaagcctggtagaacagtacctgtcaaatgtgcacgtgcaaakgattcagtgggcacctggcaaaaatgcagattcggactcagcagtctagagtggggactgggaccgggcctttctaacaagctcccaggcgatgctgctg

SEQ ID NO: 830 - DNA, 201 bp, Homo sapiens
gtcaccccagcccctgaaaccagagcagttcttcctgatccctgttgggtaagtttcctcctgctcagattgcactgagcgaactgaaaatggacaaatcygatgcctacagaggcaggcaggaagcacagctgcagacagctgtgggcacagcagggagctggcggcacgcattctaccaaagaaggcagcactgctctg

SEQ ID NO: 831 - DNA, 201 bp, Homo sapiens
ttcagctcctcctggtcctttggttgcccttctgtgggcccaatgtgatcaatcactttgcctgtgacttgtaccctttgctggaagttgcctgcaccaayacgtatgtcattggtctgctggtggttgccaacagtggtttaatctgcctgttgaacttcctcatgctggctgcctcctacattgtcatcctgtactcct

SEQ ID NO: 832 - DNA, 201 bp, Homo sapiens
gaggcttatgttgggaataacatcaagcagctgatatttgctgttttgttcacttgtctcagaacatgttttggggaaaaccaagggagagaacaaactcragagggagcaggatgatgatagtcctcaggcctgggaaggatgtttctaatgattgaggagagttctttgatttctgtgattccaggctgtcagctcctg

SEQ ID NO: 833 - DNA, 201 bp, Homo sapiens
tttctccaattatgactgtagaattgtttattgatttctttaaacctgagaaagaaaaaattgcagatgaagaaatgacatcaagggaagttaagtcactsttgcaggttatatatctagcaaataggagagtcagccattaaacaaggcaggttgactccctggtccatgcttttaagcaccatgttatatcactccttg

SEQ ID NO: 834 - DNA, 201 bp, Homo sapiens
ccagttgcatgctgctgaggttctgtggttgttaatgttacacaaactctttagacttgacctgacaaatatgcatatcaaaggagaatagaaaagtcaaygtactggactaaaagtggttaatatttattagacctggtacacttacctcatagttctttacaatgattttgctgagcatgggcattgaacatgtccttt

SEQ ID NO: 835 - DNA, 201 bp, Homo sapiens
ctttaaaagataatgactccttaaaaatttatccagaatagtattataactctaatggtgaatggaatcatatcattatgaaatgttccagttatagtagytttctgcttttaaatatattttgtatgatattatagcttcaccagaggtctttgagtttggatgggtaagtctttttccattctttaaccttcaactttt
